United States Patent 11,001,841 (CCCTC-BINDING FACTOR (CTCF) RNA INTERACTOME) - sequence listing, part 55

SEQ ID NO: 129705 - DNA, 1080 bp, Homo sapiens
aacttggtggcatcaatattcattctgtgcacagaactcttgtttggacagggcttcatccggatagctccactgggcattagcgggtgcccccaaggccggtgggagtcacagaaggctcctacgtccaggccacagctctggccggaccccctcacagcatgtgtgtggatcccacgggccagctggaagctgggcacctttcctgaccaggcgtggaacatcacttggtgtcccttccaccgcactgtgttcatgagaagccagacactgaggccagctcaaactcagggaaaggcagtgagactcacacctttgaagggaagggcaccaaggagccacattctacctgctttggccacgttgtctggcttctccagcctcagtctctttggccatgacaccataacgatgggaggggtgagttaatagacaccaaacagaactgctgtagcaactgccaaatgccttgcacagaggaggagtgtggggtgcccatgatattactctgcaagtgacattgccttctagggctttaatctcccagaaagccagagatggaatatctcagtgcttctgagcctttattttcagccctacccgcaacagcattctgcagcttgatctataatggggtgcaccacaccctctcagcctggtcagggatgggggccaaggactccctgtacctgtctcatctggagacgaaactcacctgggactaaccaaaaagaattagaagaaaaagcgaagtctcattacaaaaacacagaggattttagcccagtataactctagaagaaatggaatcctattaaggaaggaagtttggggcaaagcaccaggaaatccctcaaccggaagtgttgctagattgaggaagtgtcctaaaggaagtgggagacagctgtgggcactgtgtgcccagccccggccttcccagcagagtctgtgtgcatcgtgtcccaagtaaaaacaattcagttaccagaatggggtagttccttcacttgctaaaataaatgggtgtgtgggtgtgtgtgtgtgtgggtgtgtgtgtgtgtgtgtgtgtgtagtggc

SEQ ID NO: 129706 - DNA, 1031 bp, Homo sapiens
tctggctctctggttttccgtgttgttgggaacagtacgtcccaggctgtttgctttaaccagcgtgccttttatcactgcagagctacgaagtgaagagtgtcctcggaaaggaagtggggttgttaaattgttttgtccagtccgtaaccgcccacccgaccagctgcattggattggaggaaatcgagcttctgagtgcaggaggggcctctgcagaacactagcggttgccgcaggatctgtgaactttgcaatgtggctgcaagggtggtggtggtggtggtgatttggggtagttatttgttaactatggacacagtgaacgtagtttacgatcttgaaatgaaacttagatttttctggggaaatgttcagatacagttttgtgaactgtaaatcaaaatacctttttctacagtttatcttttattttctgcaaatttaggaacatatttactcgttttcacattgaatcttaagtttaagctcttcatttggtatttaggcaatatatgagaaaaaaattttttttgttcatttgtaattttaacaagttgaacattttaccatgattgaacatgtttttattacagtatttaacattcccccaaagaataccctgcaaagtgtaaacctttgtcccatactgtgatattactgttctgctacaataaatgtcaaacctaagcactttgcagttcactacttttgggaaaatgttctagggaactgtatcacaggtgaaactgttacccataaagtgtagctctctgaactggtgtgatcgtgtctctgctgaatggtggtggggatagctggctccaccacacacacctgttttaattaggctgggtaatgtgcacggagagcaaagatcacagactaaggagcagtcagtcggatatttgctttgctggcaaagatttaaaccaagaattaattatctttggacactataaagattttgttcccttccttatagcaatataatcatgacaggccatggttaactacatcagatacacgta

SEQ ID NO: 129707 - DNA, 1062 bp, Homo sapiens
tgccggaggccggccaggtcccgcgtgagctgctccacgcgctggtgcagcttctcgttctcagccgacagctccaccaacttctgctgcatctcctggttgcgccgcttggccttgtcgcggctcttgcgcacggcgatgttgttgcgctcgcgccgctgccggtactcggggctgccgcggtccgggcccctcttgccggcgctcttctcccgggcggggccgggcgcgggggtctgcctggggctgctgcgcggcggctccggcgacgtgggcggggtgggctgccctgcggccgccaagctcaccacggtctgtgcgcacgcggccacctgcgcgggcaacagcgagccgggcgcgtcgccgtcgccccagtcgggctcgcgcttgagcaggcggggagcggcagggcccgggcccaaggggcgcgcggggccgccgggaagaagctccaggggccccgcgccgcccgccttgtgattgctgttgaagaggtcggcgaagagctcgtcgtggcacagctccagggtgggcacggcggccatggagtcgatgtaggcgctgaagtcgatggcgctctcgtcgtcgtacatggcgggggcggcggcgcctggctcgcctagggcccctggctcggccccgcggcccggcttgcccgcccggcccggttcgtagaagggcgcaggctccgcaggccagggcgcgccgcgcgccgggccgtccaggctgaagagcgcggcgctcatggcggcgtcgggccgggctctgcgtccaagcgaggctgtcacctcgctgggcccagccccgccgccttttctagccccggctgacgtgcacgccccgccccgactccggcaccgcgggggcgccccggggccgcgggggaaggggcgggggcgccctgggagccccccggagccgccccgagccttcccggggcgcgccccctctcagttcctccccggggccccctccccggccctggggacccccagcccacgttgcaggagggtgcccgcgctgctgctccctccccggcccgggccggcctgcgctgcgctg

SEQ ID NO: 129708 - DNA, 1016 bp, Homo sapiens
ttctagtcaatgcatcattttttctacttaggatttgtccatgctattagaatagagtgctaacttccataatcagtcaaaatgagaaataactttttttttttttttgcgatggagtcttgctgtgtcacccaggctggagtgcagtgacgcagtctcggctcactgcaagctctgcctcccgagttcacgccattctcctgcctcagcctcccgagtagctgggactataggcgcccaccaccacacccggccaattttttgtatttttagtagagacggggcttcaccatgtaagccaggatggtctctgtctcctgacctcatgatctgctcgccttggcctcccaaagtgctgggattacaggcgtgagccactgtgcccggccgagaaataacattttttttaaagtcagttccctttaagtgaaaacttttcagtaaaaggttttatcatgttagattggctttttaaaaagtagatcaagaggcatgttttaaaatacaggcggttgtctaacaagctgttcctaagcaaggttctggtttgttttaggtcagtatgacggtaggggaaagccattgccagagtaccacgtgcgaatcgccgggtttgatgagcgggtaggtgtgagggtgtgtgacccagtccctgtcctgatgaacgttcttcagatgagaatgatctgtttgcctttagtatatgagacaacggcccatgttgatcacagatatatcaagtttagcatatttactgaattcctctttttttttttgagacggagtcttgccctgttgcctgggctggagtgcaatgggacggtctcggctcactgcaacctctgcctcccgggttcaaacgattctcctgcctcagcctcccgagtagctgggattacaggcgcacgccatcacgcccagctctgttttttgaatttttagtagagacagggtttcaccatgttggctaggctggtcttgaactcctgacctcatgatccatccacctccgcctc

SEQ ID NO: 129709 - DNA, 1040 bp, Homo sapiens
atagtatgaatgtggatcaagatggagaccccagtgacaggatggaagtgcaagagcaggaagaagatatcagctccctgatcaggagttgcaagttttccatgaaaatgaagatgatagacagtgcccggaagcaggtgggtactcgtgtctgtcctccctgctgtgtcacaggattttgctaaattagcttttctctaattttagcttttctttagagtctgaaccttaaaataattggtaggtgttattttttttctctctttataagtaaacttggccgggtgcagtggctcacacctgtaatctcagcattttgagaggccaaggcaggcggatcacttgagcccagaaattagagaccagcttgggcaacagaatgagagcctgtctcagagaaaaaggaaacttgaaggagcacttattcaaaactctccagaaagcctctagagtttattatattcctgttaatcatttcaaaatgattgttagctgttacttgaaaagcagataaacctaatgtcaagtttgatcgttaacaaaatgaatccttaccagttagttacaaattatttttaggtttactttgtaggaattatcatttaatactaggaccccttcttgatattaagtatacattgcttaaaaattgcatgtaatctatttaaatgtatataatctttaaacatactacagaagcttgctatgttaatgaccctctatcaattgctattgcaaggcaaaggatgatattctagtagaaataatacttcttttttgtagctttaaatgctcatttatagatttttctttggatgagtgtaatatcaagtaagaatttttatattgcaaataacagaaaatccaattagaggcaggcagagcaggaactggatgagagaaaagcagggtgtggccagaaggggcgatctgaactgaaggacttagtggtgagggagttggggtcatggggagaggacccagtgtagttaggaaactgtctggcatgatgaggggaaagacatgttccctgccattgt

SEQ ID NO: 129710 - DNA, 1368 bp, Homo sapiens
gcgcaatctggttcaagtgattctcctgcctcagcctcccgggtagctgggattacaggccctcggctaattttagtatttttagtagagacgaggtttaaccatgttggccaggctggtcttgaactcctgacgtcaggtgattcacctgcctcagtctcccaaagtgctgggattacagacgtgagccaacgctcctgaccaagagtagacttttctatttggggtagcggaatggaagtttggttgctttgtagagaagagcaggggttgatctttcctgattgtttgctgccactctttctttcctttttgcttttctgcgaatcttttcctgacagttgtttgtttgtaagtgaatgtcttgtataaagtttattaataacatttagtataggttagtgacatttagcatagaagcatattcattcattgttttcatttttatttaatgtgttgaagttgattagcactcttgaggaagtttatcaaaaaaagaattggcttctgtagtcagcagttttacattataggatgttaggattgttaaaacttggtggcaagtcgaggcagtgatagcctggtgatgtcagttttattgatttcattgagccaaaatgttattgaaaccttaaatttttttttaaaatttaaactatttgttaactgtctgtgatctaattattaaccattctgaggcatatttatagaataattgctacatttcataatttagagtactgttaaaaacttaaagtcacagcttgattgatttataacatggcatttgtaaatgccctttttttttttttttttttttaagaattattctagtattgatgtcctcttacaccaaagtagactcaccaaattgcagtctgtacaggctttaacagaaattcaggagttcatcagctttataagcaaacaaggtaatttttttcatcggtctttttttttcatttctaattgtggaagagttttagcatctaaattattttctgcttagtgaaagtgcatgtttcttaatgtatgggttggaaactccatcgaatttcctctacaaatacctattttcagatcattgaaataaatgtttaaaatggtcaggcagagttctaggcatcagggctgcaaagtgaaagaaaacatgttgcttaccttaatgaagcttttggagtagcggggtgactccagaggatacctgcccacaaggatggtggggcccaccctggcctgagagggtgcaggactcctggaggagggtcctgagcagtggggaagaggcaggggcttgcagacggaaagctgtggtgcccctgaggtgcacgctgagggctctgggtgccctggcttgaagggagggca

SEQ ID NO: 129711 - DNA, 1059 bp, Homo sapiens
gcctaggctagtctcaaactcctgggctcaggtgatccatgtgcgttagcctcccacagtggtgggatcacaggcgtgagccagcgtgcccagctgggtttttctattcatttagtactgtaggattccttttggtttttcttccattcagtgttactctgaatagcttctcttttctctctcctttccgtaaatctgaaaaggattgtttttagtgtgattgttacattcctcctttttacgtgttctcattggtattctttccaactttgtaaaataattttattaacttttctccactaggctctcaataaacaagactgggtagatggtgagcccacagaagccgagaaggatttttgggaacttgcatcccttgactgttacaaccaccttgctgagtggaaatcacttgaatactgttctacagccagtatagacagtgagaaccccccagacctaaataaaatctggagtgaaccattttatcaggtgggtaaaattattttaagtgattgaaataattattttagataggtgttttctacttaacaaaattgtttaaaacatttcaaaaacaggtagtacttgtgaagcactagggaattgcatgacctgagtccacctacaaaccccatagtattgttaaatctcttatcacttttagctaatcatcttttcaaagtgaatgcaatgcattttaaaataaatattaacattcctagtatgactacataggagcatatttcctgttgtctcttatattacaagaagtcgccccggatcactggctaaacacaggcctcccagctcctgtgacaagaggctctccgcttttctccacaccatacctatcctgactgtgcttgtaaattcctcagtttgtacgtaacatccaaatcatcttccagccaaaagtagttcccattttttgtagaacgtgttcctatatattttgtggttacaaaacaagctattttagatgaatttgttttaaaaattggaggtttactgtttcagacatcaaacatcatcgctttgactttaaatcttgacctg

SEQ ID NO: 129712 - DNA, 1156 bp, Homo sapiens
tgaagcaaacaacttttaagggcctaaactttaaacatttttttctaactgtattaagtacattctcatacttttgtgatatttttgcattccttgcagagcattgtgaacatagtttagctttttttttttttttttttttttttttttgagacagtcttgctctgtcgccagttggagtgcagtggcacaatcttggctcactgcaacctccacctcccgggttcaagcgattctcctgcctcagcctcccaagtagctgggattacaggcacctgccaccacgcccagctaatttttgtatttttagtagagatggggtttcaccgtgttagccaggatccgcccgccccggcctcccaaagtgctgggattgcagccatgagccaccacacccggccttagccttttttttgatatgtcatggccattgttctaaccatgttatagtgaacataatccagggacaatggaaccagtataggggtatgtaggtgatctctttcctgagtctatgcagaatgtagctctccctcttccctgactctggggccatgagctgctgctccatcacctacctacccacccacctttactgctgatttattacccctaacattctgtaatcagggcaataagagagctgcatctactagattttattgaattcagaattcataagctctaggagagaacctgtagggctcttttgatgtaaatgcaagaggcttagtacccagaagggaactgaacagcaggagaactaaggagggagcagtccttggctggctggtttaggaagaaataacatttgggttgagactgcaagatggaaagaaatttcctggaggaagggaacaaaccccataaacactttgagaatatcatggactgggaagcttgattgaaagggtcaagccagaattttgttaaggtaaagagatgaatgaatgctccaacaaattgagatggtccatagaacatggattaaacatggcatcagtagtcaggattattttttcttttgcttctgggttttttggagctagacaaggattccaaatggttcgcctgtagatattataatggattaatactggagaaccttatgtaatgacacatcttatacactgtgaacctttgatattttcagatt

SEQ ID NO: 129713 - DNA, 1050 bp, Homo sapiens
actttccttagaacctgtcgtgatttggaggttaaggctggtgtctcctggtggggtactaaacaggcatttggaatcatacgggttaggagtgttgcggtcacctgtccctggtcaggttgccacagtcccgagggaggctggtctgcaccaggtgttgaagcctccgaggcagctcctctctagttcagttagccagaggcaaagcactgccaggcgagttgggcgggggttcagaaggtggctgcgtgccctccctgggcctccctctggaggggcctggcccgttcagcgctcatgcctgctgaatccactgctgagcagttccagttgcagctgtggcccctgcactcctgctcccggtcgctgcctctgcggcacctgtaggttttgtctttgaggaaacccgaggtgaaaatgaaccagcagagccaagtgtctgggcggcggggagtaactgggcctgctttccctctccaggtgcggccggccggacggacctactacgactgcgcagacggtttatgagggaccaggagaagctcagtttgatgtatgccagaaaaggcgttgctgagcaaaaacgagagaaggtttgtatcttgtcaagaatttgatcagaacgatgcagtttctgtcacaggatacagacgaagtgaacaggcttcctgccagacactgcctccaatgtcacctgcaaaccaggttgcgggactgctccaaaccagcctcctggggctcccccacagggatgcagccctcatggcgctctggtgggggtccaggagtgcgcccagttctctccgcgggtggaagtgtggccggcctgggatcagccggctgatcccaggcctacctcaaggcccgcgccctggcaggacttcactggccctcgcttcagggaccaatgcggcgggagggcagctgggggctgggacccacggtgccccgaggacaggtggccaggagggccttcccgtggcgtggagactccgtagccgcggcgtccattccgcctagaaatgggtcattaggatgcatttgtaagaa

SEQ ID NO: 129714 - DNA, 1467 bp, Homo sapiens
cagtgagccgagatcgcgccactgcactccagcctgggccacagagcgagactccgtctcaaaaaaaaaaaaaaaaaaaaaagtcaggggttcttagcacctttcagtagataacaaagtgttattcctgtggtgggagcaagtggcgtgtttcttactttacaaatggggacactgcggtccaggggcactgaggcgcacgtacctggttttccttggggcataccctgggacctgacagagcctctgcccagggttggagttgagcacggaggcctagggtgccaccaggtgtgtcctggcaggtggtcctgccccgtgcacagagctgggtgatgctgagtgcctgacctctctgattgcatgtcacagatggaagaagctcatttgattggctgaccgggagcagcactgacccgctggtcgaccacaccagtccctcatctgactccttgctgtttgcccacaagaggagtgaaaggttacagagagcacccttgaagtcagtggggcctgattttgggaaaaaaaggctgggccttccaggggacgaggtggataacaaagtgaaaggtaagctgggttgctgagtgtgcttaaaatagcttccccactaaattactgcagagctcaggtctggggacatttctgactgtatccatgtttccttctcattcgtaatcaagccctttaaaattcagttaatgttgcctaggcactcaccatgctgaagaaattgttttctgggagttccagaagaatccttcagtaagttatactcgatccattgttgagtgatcttctggagcagtaagagtgggtgaggcatttataaaggggtgattgtaacaagaggtggaattagcaagcatggtctagggctagagggcttaatacaggtggagaatgaggagagcgtccaaaaagactgggtggaggaagagcatttgagaggagccttggagctgggggtgcaggaagggaaaggatgaaaaggacagggatggagaagtgtcagggtgggtaggctcagatcgattctgcagtccaggtgaagggacgcttcggggcatgctagagtaacggcaaagggtgctgtgaggacagtcttgtgggtgtgggggtgtatgtcgaacttcagctttaggaagcagccttgtaacgcaccgagcagaggaaggcacggggactgaatgcccttctctgaggtttgtgtggggcagaagtggagtgatggggactggaggcaggcaccaggacctggtcttggctaacagatgaccagaactagacgggtgccgagaggctggaagcagctttttgtgagaaagaagtgaggctctgggagggaacaagggcccagaggaaggacatgtgcagagaggaaagggcccatgacagaaccctgggggagcgccagcagggaagctcagctctgtggaagtaaacttagaagaacttagaagc

SEQ ID NO: 129715 - DNA, 1788 bp, Homo sapiens
tcaaatagttaatattatgtactcatcgttgaaaacttcccagagaatagagataagagaataaaatcacccagtttctcccctcccctctgtggcataaaaaatatgctacattttttgtaatattctcttccttcagtggatatgtttcataactcagactatatttttgatatagttgaaggtggtttccctctctgttaagcttcatgtgggtgaagagctgtgccttctccacaggacaccctgtacagcacattctttcccatttgccattgtctaagcaatatacttttttctctttgcttttcagattaattattcgaaatttctggagccatgaaactaggttaccttcaaataccttggaccggttgctggcactaaattccttatattctcctaagatagaagtgcactttttaagtttagcaacaaattttctgctcgaaatgaccagcatgagcccagattatccaaaccccatgttcgagcatcctctgtcagaatgcgaatttcaggtaatgtggtcttctctctcatagtagtgaatattataggcttttcctgttcatgaacatttttaatagctttgactggctctttgccttctcagaatacacattcctttctgaaaaggaaagggaaggctcgtgcctctgcttcagccacctggaggtccactggcctcaccctcttggcctccactagatttcccttgtcaggatcgccattgctttccctcccctcattcctcccaatccacagtggatgctgagcttgtcctgtctcgcagcagcctaaacagtgggatgatgggcaggttgcagggagctcctggggtagggcccctcctgtcccactcacaagctcaggatctgtcccagtggcacgtgtgtatgtggacaagctgggtcgcttgactcattgcatttgggttgtggtgctgagcatgatatcaaacctttttatgcaaacattaagaaagctgggttttctcactcgatagttaactagtttttctagttggcaaatcagttaaaacttttaaattagagaaggttcttcttcagctgcatatgaagttatggtacaaatatgctgatggtaccattagattttaaatagaaatatatcagtgttcctaaaaaaggagcattatttcatttgaaactttatttcatttgaaactttcttatgtacaggaatataccattgattctgattggcgtttccgaagtactgttctcactccgatgtttgtggagacccaggcctcccagggcactctccagacccgtacccaggaagggtccctctcagctcgctggccagtggcagggcagataagggccacccagcagcagcatgacttcacactgacacagactgcaggtaacagtgaccctgcccgctggccatgtatacagcaccctgacctctgtgggcagcttctgtcacaacagtgttgggcttttgtgagagaagtaagggataatagcaaaaagcgttaagaacccaaggaagatgtcattcaaaagagggggttcctataacagtcaaactcatggaaacagaaagtagagtgccaggtgccagggtctggggaggaggaatggggatttatagtttaatgggtacagaatttcagttttgcaagaggaaaagtgctgtggaggcagggtgcagtgactcattcctgttattccagctggggcaggaggatcagttgagcccaggagttccgcaccagcctgggcaacatggaaagactccatctctacaaaa

SEQ ID NO: 129716 - DNA, 2386 bp, Homo sapiens
ctttgccattattaggtttttctaaaaataaactttttatattgaagtaattttgcatttacagaaaagttgaaagatagtacacataatttccatatacaccctttacccaactttcccccttacataatcttggtacatttgtcaaaagtaagaaattaacattagaacattactatttaccaaactagactttacttccatttcaccaatttccttctaatatcctttttctatttcaggatccagtgtagggtagcacatgaagtaatttgtcttatatttgataatctagtccatgatcattttaagaatataagttttatataagtgtagcgttatctattataactaattttgaaacaaagaagaaaaagttgcctgtcatactttgaaagtgcaataataaaaatagctaaatttgtgtgtttttaaaatctctcccatagagatgatgaaagacaaaaagtatgtttggacataatttataagatgatgccaaagttaaaaccagtagaactccgagaacttctgaaccccgttgtggaattcgtttcccatccttctacaacatgtagggaacaaatgtataatattctcatgtggattcatgataattacaggtaagctatacattgactattttattttgttacttttttgagataaggtcttgctctgtcgacgaggctggagtacaggggcacaaacacaggtcactgcagtctcaacctcctcctgggctcagttgatccttccatctcagccttttgcgtagctgggtctatgggtgtgcaccaccatacctggctaattttgtttattttttgtggagacggggtttcaccttgttgcctgggcaacattaacattttagggatcatttgggtccccttagcaatctggaacataataacacatttttttttaccatatgattaataattaaaacatgtattttggtatatctaattgtatccttttaaaaactcatttcacatatgtgtgtgaaaaaatcagagtgaaaaagtgtggtgttgtgcttataaaacctattttcatagttgtccttttaagatcttgcaaagactaaggagatgaactctgccaggaccaccgggcactaccacaccaccacagctgagcgtcacaggaccgctgggcctcctgtgggcccatcctcctgttccactcagctcctgctgggagcaaggatgggttctcaaggcttgtgcacacacccatgagtggggcaagctgtgatttggagatctaaagtctaatgggaaaacaagccttttaaaattgaattctagatggtgttactgtagttgaacaaaagggccagaagagagcattaatgttgtgacattttgctgttttctcaagcagagatccagaaagtgagacagataatgactcccaggaaatatttaagttggcaaaagatgtgctgattcaaggattgatcgatgagaaccctggacttcagtacgtgaataactgggctgggacaattaaatgttaagggtattgctttcaaaggtagcatagagtatttttcaggagttttagaaatgtatttgcagtattagcattttctctgctttctgcatttcacaatatttagtaaaagagtattttaaagcacattatgaagagtaaggctttacaatcctgacaacttaaaaataacactcttgaaaaagtcatatggaccaaatgctgtatggtagggcagtgagttaaagtgtttcaaaatgaaaagaaagtctgtaatgacaattcttctgtttcccatttaacacacatagttgagatcatgctgtaagtattaatgttgaaaataaagtgtttgaaactttagaaatgagaggaaactgtaatattagttatatatgaaagtgtgaatgatgattgttaccctctaaaatgcctgtcctgagtaagtcagttatatgtgtttcttaccaaatactgattatataagaagaggggtaaactttttattattattatgttttttagagatgaggtcttgctctggcacccaggctggagtgcagtagtgtaactgtagctcactgtagcctctgactcctgggttcgtatgatcctcctccctcagcctcctgagtagctgggactacaggcataacgccaacaggcttggctgattttttattttttgtaaagatagggtcttgctatgttacccaagttaggcttcaatgcctggcctcaatcctcctgacttggtttgccaaagtgccgggattttaagtgtgagcactgcacccagcctcaatataagaagccatatactttttatatgtttctgtatattacttatttttccattctgctataattttaaattcattga

SEQ ID NO: 129717 - DNA, 1050 bp, Homo sapiens
gcacagtgatgtggactggctcaccgaggtgtaggaactcaaggatccagagcctaagggtgtgcgatggtcagtgtagaccagcagacatccccagcacctactgtcccatcatctaccttgtaggtgacaacattgagcacctttgttgggctcacttaaatactcaagataaactttgctttcaatgcttaacctacatttccacttttgtgtatttgaaaataaacttaatttttcagatactggaggagtctctgtgtgaactggttgcgaaacaattgaagcaacatcagaatactatggaggacaagtttattgtgtgcttgaacaaagtgaccaagagcttccctcctcttgcagacaggtatgggctgtccagggatcctttcggggcaggagggtcctcggccctcctctcaccagttcccttccccgccaggttcatgaatgctgtgttctttctgctgccaaaatttcatggagtgttgaaaacactctgtctggaggtggtactttgtcgtgtggagggaatgacagagctgtacttccagttaaagagcaaggacttcgttcaagtcatgagacataggtgagtgaacactagccctgctcttgggtcccactggctcataaagcgttaatttattaagacgtctccaactcaagaagaacctgtgggtttccatgatatacacatttgtgaagttggaatctctgaagaaaaggtgaaggcaccataagaataggatatctgctgaggtgggcctgctctctgctcccttggcctggcatcttggggagccacatcccagggcgtgtttttcatccataaatgaaggaggtggcctatggggttaccttggctctcttcagatttaaaatgtatgcttttgagttctgtacctattttgccaggtgagagcttctgttaatgtgtttaaattgttcatttattttcaaaattgcaacataacataaaagtatatgttaaaagagaaagctgctgatcacttacattatattatttccctgtccctgtactctttt

SEQ ID NO: 129718 - DNA, 2112 bp, Homo sapiens
cacaccctgggcacatggtctcagggtgccatactggggggactcagacagccgtggcctgagatcaagctgctggcagggttggttccttcgagagctatgagagagcctggtccaggctactcctagcatccggcagcctcaagcactatgtggtgtgtcacaggcattctccctgtgtcttcacctcatcttcccccttgtatctgtctctgtgtcctgatttcctcttttaataaggacaccagtcatatttgattagggcccacactaatgccttcactttaacgtgcttacctcgcttttggctttaggtccagtcatagtataaaattttagctgatggaagatacagtcttgtattaatattttggcaatttaagaccattctttgatgtttgacttttacatcctcttgtaggtctttcgcccttacgcgaagcactggcttagccccttgctgcagctggctgcttctgaaaacaatggaggagaaggaattcactacatggtggttgagatagtggccactattctttcatggacaggcttggccactccaacagtaaggattgatgcatcttttatgttaatatattatcctttgccaatagcctatagagcctatgacacataattcaggtccctctcactgactgtgctatggttttcagcatttgttgctacattgctggtgtgctcctaaaccaaatggcctcagcctgctttggttttgttttgtttcctttgcctttggtaattcgtctgaccttgcttttattatgaagctgtcaggtgtttgttttgttttgtttgctgcctttacttgccttagaaatgagattgcaaatttattaaaactatgtgtaaactgaatttcaaccaaccctgaatgggaggctctgaggactcctgccttgaagtccctggattttggcatttgtgccatcttctctactcccagagtattgactaataccagcaatggcaagattagggctaaagcagtagctgccagatgataacaccatgttatgttgaggcaaatgcagtacccaccagtgtagacatgtgtgtgtgtgttggtgctttgcctactcatttaaaactgtggacactgacagcatacaaacgttttcatgtgaggagatggtaagaacagtctgtattaaatataatatacacatgcggggctaggcatgatggctcacacctgtaatcccagcactttgggagaccaaggcaggcagatcacttaaggtcaggagtttgagaccagcctggccaacatggtgaaaccttatctgtactaaaaaaatgcaaaaattaactggacatggtgctgcatgtctataatcctagctattcgggaggctgaggcaggagaattgcttaaacccgggaggcggaggttgtggtgagctgaaatggcactactgtagctccagcctgggcgacagagtgagactacgttcccccagctccaccaccacccccccaccacaaaaaaatacgtggagctttctcacacgcttgtctctggatgtacctatctcatttgtttcacagttaaccaaatttagatttctttgtcttagtgtaatgaaatactttgttttctgcttaataaaatgaaaaaattaagaggggttcagtttaacaagggtccgttgaaagagattgatgtagctgtcagtggctcagctgaactcaagagagtggaactgccgggctcgaggtagctgaataaagcaacagcaagccagaaaggttgccgtgaagcttttactcactctggagtcatgggagtgagaggctaacactggagggagactccccttgttctgtttgcccctagagtggtgcactgctcagcagccagatggattagcacagacaagggccgtctcaccattgagaggccctgaacaggaggctctgcagttttatagggaagagctgagtcagaaagcactggatactgagtcggagtggggaaagcaccttcatgctgctcccctgccctgcaggcgacccctgtccagggcctcagataaagagtcctaggcatggaggctccagggaggaaggcagaggtgcatgcatggggca

SEQ ID NO: 129719 - DNA, 1155 bp, Homo sapiens
acctccgcctcttgggttcaagtgattcttgtgcctcagcctcccaagtagctgggatcacaggtgtgcgccaccaggcctggctaatgtttttatttttagtatatttcaccatagtggccaggctggtctcaaactcctgacttcaagtgatctgcctgcctcggcctcccaaagtgctggggttacaggtgtgagccaccacacccggcctagaacatttcttttaaagtataagattatcatatttggatgaattaacatttgtgtttgcatacatattatttaaattggctttttgtgctataatgactttattactcagtcatttttctattaaaataatataaaaatttttggtgatttttagggtcaagaattaataaatactgtcattttaagggttactaattttaaagtcctagaacaattagattttaaaccctactgaaaagtggccttaattcaagggacctttttactggataaaggggataattctttggaattttctgctgtgtgattaatcaagtttcccatttctccatagacagtcttggaattttctgccatgcgagggagaacaggagtcaactcctagttcttgttaagctcagtatgaagttcttctgtagttctgcaatgtgtagttgtaaactcctccttaggttattcaaaatgttctttctacacaaagcttgtacagtacatttttactaggttcattatttgtagaagaggaagcacataccgaatcagcaccatgtcccatttatttatgtgtccatagctggcgtcaaccaactagcctgggtaagagtcaaagctgaggtataggctgggtgcggtggctcacgcctgtaatcgcaacattttgggaggccaaggcaggtgaatctcctgagggcaggagtttgagaccagcctggccaacatggcaaaaccccgtctctatgaaaaatatgaaaagaattagccaggcatagtggcaggcgcctgtaatcccagctactctggaggctgaggcagggagaatcacttgaacccgggaggcggaggttgcagtgagcctactaagatcatgccactgctctccagcctgggtgacagagtgagactctgtctcaaaaaaaaaaaaaaaaaaaaaaaagctga

SEQ ID NO: 129720 - DNA, 1053 bp, Homo sapiens
atgctgcactcccctaataatagaaatacatatgtcacttgcaggtgtctctagaaactgtggaatttgggtagtaaggttttagctggacaagtattgtatgatttgcatgagccaactttctaaaagattattttctcaatagttaaaaaaaaaaagaacggaatagaacaacattctttttaaatagaggttttgtctatcccactttgtttccaaaaggaattagctagagaacgttttgtgactatgaagctgagtcatgttgacatgtggcctcttctcctctccttggtggtccttcacatggatgattgggagggcctctgaaggataatcccagaggaaccagagtctccaaaaaaatattctcatggctctttgaaccatgcagggctggccttaaatagtccctgctgtagctgaaatctgcagccagccctctgtgttcactccatcccaactttctttcttctgtagcagaaacccctttttcacccctttgtccgattaatgtaaacaattacatatttaaattgtctaaaaatactcacccttaatagactatcctcaaagcaacaacactggggtaggcagatggcttgagcccaggagtttgagaccatcctggacaacatagcgagaccctgtttctacaaaaaaatttaaaaaattagccaggtatggtggcacatgcttgtagtcccagctacacaagaggctgaggtgggaagatcgcttgagcccaggaagtcaaggctgtagtgagtcatgatcatgccactgcactccagcctgggcaacagagtgacaccctgtctttaaaaaacaacaaggctgggcagggtgacttattgcctgtaatcctagcactttgagaggccaaggcgggtgaattgcttgaggtcaggagttcgagaccagcctgaactacatggtgaaatgctgtctctactaaaaatacaaaaattagccaggtgtggtagaacgcacttgtaattccagatactcgggggtgctgaggccggagaattgcttgaacctaggaggtgg

SEQ ID NO: 129721 - DNA, 1012 bp, Homo sapiens
gataatttaacgagatcagagctcacctaatttactgttttgtcacatggccagcattgaggagctttgtgccgtcaacttgtatggccctgacgcgcaagtggacaggagcaggctggctgctgttgtgtctgcctgtaaacagcttcacagagctgggcttctgcataatatattaccgtctcaggtaactataacttattgtttttacatttattttagctttagtatgataattagtgtatttatttatattatttcttaaaagtcctttatgtattgagcatgctgaaatgggaattatagaaatacttgctcaagacatgtagatattatgtatctgtatatctatgatatatcaatataaatatgaaagcaaatgtaaaaatttataaatataaaatgaaagtaaaataaaggacatttaggtatttacagagcagctttctgaaaaactttaggaactgctgttgtgcctttgtggcaagacaacacaaatgaagaatctagcatagaaagcaaggttgagccagatacagtggctcatacttgtaatcccagcactttgggaggctcagataggaggattgcttgaggccagaagtttgagaccgacccaggcaacatggcaggaattcatctctacaaacaattaaaaaacaacaacaacaaaaaaaaacattgtccaggagtgggtgccgcggacccgtagtcccagctactcaggaggctgaggtgggaggattgcttgagcttggaagcctgagaatgcagtgagccacgattgtgtcactgcactccagcctgggcgacagagcaagaccctgtctcacaatagcaagaacaacaaaagcaaagttgaattaaaatttttctgaatattggaaggtagttgtcagtgctatctgaagtgggttttttatttaatgagaggagtgaagttgtttttttctaagaaatatctttttgctaggcatttcagtgttggcttccttttagtccacagatttgc

SEQ ID NO: 129722 - DNA, 1031 bp, Homo sapiens
ttgctgggctggccccaccctcaatttctgtgtacccctggggtagggccagataatttggatttataacaagtgcacaggtaatgttggaacagctgtccagggaccacactttgagaagcactgctttacaaggtatattgcaaaggaaacatgaaaatacttagtgctgttcttttaaggagaactttttaatttttccccacatgaaaaaatgaacatgagcagcatttaggacccatttcacctatgttattttgattgcatctaattataatacattaaaaataagtcgaatgccttttagtgagatttctacatatatctgtgtgataaagatgagtttatgatttctagagccttggtagctgaatgttgcatgttggagagggactaatgacagtatgctgtctctgtgcagaggatttccaccttccgcatcattgtgtttattggatctggtcaagtggcttttagctcattgtgggaggccccagacagaatgtcgacacaaatccattgaactcttttataaattcgttcctttattgccaggtatggtaatctgtatatctttaatttcaccacggtgctttattatcccatttaaaagaagtaaagaagaattgagtaattgggtatcattgcagttaacatggtattcagttaagattcagaatattaacagttgatgaggtaatgcagttctgtttcagcatgtgattaataagaaattgccagcatcctaagtctgaatgatctcaaatcatattaaaggaaagcagtgaacctgtgcttttcagtaattactaaaccattaaactgcttatggactgaaataatgacaagtttctcaggaataaatgtattgctcagttttgtccattaagtccaaacctaggtttgatagcttgggagtggggaagctgtgctcaggacagatcaagccctgccttcccccattgtgggctgtcacagccctgtgccatgtgtggagagtgcctcaggttagatgggtgtgctggttcctt

SEQ ID NO: 129723 - DNA, 1020 bp, Homo sapiens
atgcctccataggattttcctttatggagcagtacagtttctttggaacttcaaagggtcttattctctttgacttcaatatgcaaagtgtctcaaaagctgttatggggtaaaatcaacaatcaaaattcctctggaattcttaggatatagccattttcttttttttcagggaagggaaagattgttttgttataattaaagttttctctcccctcttcatggcttttcagtttattaatttgtttaaaagaaaatgttttcattatatcagaaggaaatagttattcaagcctagattctggatacactatggagattggttttactaatgtttatttttttcttgactagtgctataaattaatttttaacatactttagttatgctcagagatagaccaagggtattcagttgtcagtggttataaaaattagtacaatcaaggtctctttgttttgtttcaggatggaattgtggaccctgttgacagtactttaagagatttttgtggtcggtgtattcgagaattccttaaatggtccattaagcaaataacaccacagcagcaggagaagagtccagtaaacaccaaatcgcttttcaagcgactttatagccttgcgcttcaccccaatgctttcaagaggctgggagcatcacttgcctttaataatatctacagggaattcaggtttgtaagctacacaacagagaagagaaacttgtggttttgaaaggtgacttggagtttcactctgtgtatccgtgtgtcatatttcctgcatttagtaagtaattatgtgctggatgctgtgctgtcttctggaaattaaaaagtgaattaaaattcagtttgcactccagaagcttggaaactgctgagaaatgcatgtaaacactgtctcagccattttggaaatgcaacaaaagacacatatacaggggctttgggtgcacagaggaggagtagctgatccagggtgagcaagtttgctgtggcctcttgctagggttta

SEQ ID NO: 129724 - DNA, 1116 bp, Homo sapiens
actgtgcctggccaaaagtctacatttttgattagtaaaaattcctctgtatttttacttttgaaatttggtgttaaatataccagtgacttttggttatttagggagttagagcctgtatttggaaagtgtttcaaagagattttttttttaagtaaaaattttgttcattgactttcttctacaaaatactttaagtaactcttactgaatttggatattaaacatttgagactattaggcttgtttaaaagtaattttactttaaattaaatcgagtgatttctgatgttgtaattacatatctgaggcaaaagaaaagggaaagatgaatgaagtgcttcactttaatagaatgtagaacagctggcattagaaatgttttgatttgtgaataattctgacactaataaaaagaaaaaaagtgtttcattcttcttaaatcttttctaacagtcacgtcctcagatgagatgatgaagagctatgtggcctgggacagagagaagcggctgagctttgcagtgccctttagagagatgaaacctgtcattttcctggatgtgttcctgcctcgagtcacagaattagcgctcacagccagtgacagacaaactaaagtacttctatttttcatttcacccattatttagatcctattgctttaaaaatacatattgcttaggatatagagaacatgtttcagccattccaatattagtaattttgtattttctgtaatatagtaattagaaaactacttacttattagaagtcagtgtcattgataaatgtaagttaagtataaatcatcttaataggtaattgggctgggcatggtggctcatgcctgtaatcccagcactttgggaggccgaggcaggcagatcacttgaggtcaggagtttgagaccagcctggccaacatggtaaaacctgatctttactaaaaatacaaaaattaggtgtgctggcatgcgagtgtagtctcagctactcggtaggctgaggcaggagaatcgtttgaacctgggaggcagtggttgcagcaagccgagattacgccactggattccagcctgggagacagagcgagactccgtctcaaaaaaaaaa

SEQ ID NO: 129725 - DNA, 1097 bp, Homo sapiens
tccactgactattcttctgaatcaggtattactttgatggttgcaaaatggtgattttctacccccatcatttctttcatcctagttgatgttctactgcaagaaacaattttccccgttatttatttatctgtattagtaagatttgtggattcttattttttcagtgggtctaatcttttgccatcatgattggttttgaagcccacattgtcccagatttggcccgagtgtgatgcgtgggagccactcctgctccatgagatgattcatgctcttctcgaccctggagtcagacacttcccaaggagccatgttccttttggcagacagtgatgtttaaaagcaaccaccatttatattttttgttttagaaacttaatttttttaaatcataatttaggattttaatgtttctatttgacaatatagtttgttgcctctaatgtacattaaatgaatgaatgagtgctattttaaatttattttcgtttactattgatagatgagaccaagaataactgggaagtgtcagctctttctcgggctgcccagaaaggatttaataaagtggtgttaaagcatctgaagaagacaaagaacctttcatcagtaagaagtcctttgtattttctgtaccttacataatgcagagatcagattctaacacttgtgaaaagtaaaaatcttcatttaaaatgttagttgtttttgtatacaaagtagagtacaatataaaaataattttaatatattgaccaggcatggtggcgcacacctgtaatcccagcactttaggagggtgaggtgggtggatcgcttgagctcagcctgggcaacataggaagaccctgtctctattaaaaaatacaaaaaattagctgggtgtggtggcgcatgcctgtggccccagctacttgggaggctgaggtgggagaatcacctgtgcccaggaagttgaggctgtagtgagcaagatcacaccactgcactccagcctgggcaatgggagtggcctgacaaaaaaaattaatatatttttagctatgaaaatataaactatattaactgttttgtttatttttttggtcttgttt

SEQ ID NO: 129726 - DNA, 1016 bp, Homo sapiens
cttgtgcaacattttaatttgaatacacagttgtgtttggtaacacaaatttggtgacacaaacttagcgtgtttaaaactgatcttcatgcacttccaaaataccacatttttcatttatctttcttactactgttaataatttctctatttctctttttcttcacttgaaatctctaggtcacctattaaaattctatctctgtcaaggcattattgctagctccctcaagaagtgctgcccacctctggcattttcctatttgtcccattctctcatcacttcctgtgagtccttttggttaacgctttctgcaagtcctgcccttcttatcagaccataggtcttgagcacccatcttggtctttctcgctgttgcaatctttcttcgtagcatcaggccttgaccatgaagtcagttggaaagttatttgttgagtgattcgtgattgaatggtacaatgtttctttgctacaattactctttaagaatggagatgaggcgcctggtgtttggatgatcccaacttcagatccagcggctaacttgcatccagctaaacctaaagatttttcggctttcattaacctggtggaattttgcaggtatttggtaaaattctaattatttaagaatgaaaatgattgttagttattggctgtaatataggaaattccttatatagatgtaagaaatgaaataataggccgggttcggtggctcacgcctgtaatcccagcactttgggaggccgaggcaggtggatcacgaggtcaggagatcaagactatcctggctaacatggtgaaaccccatctctactaaagatacaaaaaattcgccgggcatagtgtcaggcgcctgtagtcccagctactcgggaggctgaggcaggagaatggcatgaacccgggaggtggagcttgcagtgagccgagactgcgccactgcactccagcctgagcaacggagcgagactccgtctcaaaaaataaataaataacaaataataaa

SEQ ID NO: 129727 - DNA, 1036 bp, Homo sapiens
catgggccgccgcacccggccagatactgtattttatatctgtatttcttcttaattaaaaagcttgtggctgggcacagtggctcccgcctgtaatcccagcactttgggaggctgaggtgggcagatcacctgaggtcgggagtttgagaccagcctgaccaacacggagaaaccctgtctctacttaatacaaaaaaaaaaaaaaaatagccaggcgtggtggcacatgcctgtaatcccagctactcgggaggctgaagcgggagaatcacttgaacctgggagttggaggttgtggtgagctgagatcacgccattgcactccagcctggacaagagcgaaacttcgtctcaaaaaaaaaagaagccttgttaaacttgtgtttataatcacatggcttaacatgacaccttaaatattattttgatcttgataagattgatgaagacttctgttttaccttttctaaagccgtgcaaggttataaacgcaaaagatgttgacttcatgtacgttgagctcattcagcgctgcaagcagatgttcctcacccagacagacactggtgacgaccgtgtttatcagatgccaagcttcctccagtctgttgcaagcgtcttgctgtaccttgacacagtaagtgaactaaactgagcacaattttaagtatttaatcttcatttcttcaaataatttgatggagtcatacaatacatttagtgtaggcactgttgggaacaacatgacagttttagttagtactttgtggcaatagaattattgtcatgaaactcgattttttgttatccagaacaggaaaaaaatatttgtttctccttccatctttctgaaagatttggaattgttgcttgggatagaattgcacctcaagacaatttttactctgagtgtgtgttttttttttaaggcaatcacagtaatacatgttaagcagcaggttagatgacaaaccatgtttttcttttaataagtatctaattcagttgtaattactttgaatatttgtattat

SEQ ID NO: 129728 - DNA, 1288 bp, Homo sapiens
ctttgaatacctgtattagttcttgcatttaggctcttgtctcttggtttggtaaataatgatctatttgcttctcagacgacattttccccttgcatcacttaatttaagctttatagtttgtagcttatttttttgaaaactgagatgctttgtctttctgattgttctgaactctatttattgatgacgtctgaagtcactggtcccctgacagctctctttcaccctgtgggtgacaggtgagattgttctgaactctgtttattgacgatgtctgaagtcactggtcccctgacagctctctttcaccctgtgggtgacaggtgagctctaaagactgctctttgcttcctcagagagccttaattcaaaacctgtttttggttttttttttttttttttttcagacttatgtgtatccttggtctcttagtcccttctctaggaaaaatgtatcacatagccttatttaagacacttttctgaacctgatagagactaagcaaaatggaagcaaagggtctttatgattaaaagcaattgcgtgtaactataacagtacattagtagcatctaaacagttctagtttttccatgtttgtatagattccattgctattaaatatttccaaaaaaataaatattatgtatttgcaggtttctaatatggtggcgaaaaatgcagaaatgcataaaaataaactgcagtactttatggagcagttttatggaatcatcagaaatgtggattcgaacaacaaggagttatctattgctatccgtggatatggactttttgcaggagtatgtctcattaacttactctattttgtcttggtttcacgtgattgtttaaaggaatctaattcattgcattttgaatagtgtctaatacttgtaacaatacagtagacccttgaataacatgggcgtgaactgcacaggctcacttacatgcagatgtttttctaccatacggatcaaaaatacagtgtgtgctggatgtgaaacttatatagagggctgaccttttgtatatgaggcttccacagggtgactgtgggacttgagtatgcatggatttaggtatactgaggaggcctggaaccaatccctcccgcatgtactgagggtcactgtattagtattgtttattaacagttaagatttcttcagtgtctgctgtgtactagaattctttacatgtggtatctcaaaatctcctaacccttaggagctcagtattactctgttttgcagattagcaaactgagatgcagagaaa

SEQ ID NO: 129729 - DNA, 1085 bp, Homo sapiens
aagcttttgcttaaactttgaatgaaagcaaatgtgataacatctgtgatgtttcacacacagttatttacagggaggctttcggtgacttagtaagctctggttgaaatgctgatactcaggttacatggttgaaagcactttattttagggtatctttcaggggatccaggctgtttgattctgactttgcctcaatgaatcctgattccacttctgacccttgttttgggatttgtcagccaagttatgggcctgttaattggtagtgttagagctctgacaggaatccctgggttactgtagtgtaatggtactagatcttcctgagcacagtgttgactttgacatatccctgcaggtttgttggttttctgttctgtgttatgtcgtctgattttaaatataatggcatttgcatttgcagctggcttgcgcctatttgccctgcatgcatctcagtttagcacctgccttctggacaactacgtgtctctatttgaagtcttgttaaagtggtgtgcccacacaaatgtagaattgaaaaaagctgcactttcagccctggaatcctttctgaaacaggtaccacaaattcaactgtcatttaacaatatttctttcacacacagaattaaattccctttgcatgcatgcatgtttgaaaataaatacaagttgatctgtagcttctgtagtatttaaagcagaaagatgttgatcagccagccatatgggaggcagccagactgaaagagagctagggagatgccagatttgattagggcctcagagcctagattgagacaagtgtaatggagcaaagacgtggtgaggtgatggccggaagggctgggaggtcagggctggagagtgggtggagggctgaggggagccccatctctcctggaagaggagggctagctgtctccaggggatagatgcttgtgtgtcaacttgaaaacaaggggtgcctctttgccattgtggattttccacctggataggaggtggttacagaatctgtacctgcgtatgtggaagcttgtctggtcggctgaggagaccgtgcttgtcattctgag

SEQ ID NO: 129730 - DNA, 1271 bp, Homo sapiens
gcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcgtgagtcccccgagccgggcccactacagcccccggcgccgccccgtctgccctctcgccgcagctggcagcgctgggtgggtgcgcgggacccgggcgctcagcctcgggctgggcgctgccgcttggtgcgcacagacacccacagcaggctgtggcctgggtgctgcttaattcgattgccatttgcctctgtttggtttggttcagtggtgagtcataatgccccaaggaaaagacaaatccaggaaggccggccctgaaagttaatggctgtcttttctgttttgtgtgacacaagctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcaggtgcgtgtctgaagatcttggttttgctgtgcttgatacacagctgatgctttatctgctcaggtttactggctttataacagttggcataacgcctaaagcatcccctctgcacgtgactgagcatgttcttaaccagaggagctgaacggagtgcagaaaatagtagttttagggcttagtgagcagaggaagcagcttctctggtgcttttttttaatagaacatttaagagtgctcagaatctcagccaccgcaggttgcaataaatattcagtttgctgttgcgattagatggtatagatcaacagacaacatgctgtaatttcaggtttgatatgccaccagaatttcctaattttgtttttatagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggtgagtatgcagtctcctgaaaccatcttatggcgggtatcatgtgggtaactctgttttcatgattctgtcatgtttttctgtgtaggcagcagcagaagatatagtggcaagtgagcagtctc

SEQ ID NO: 129731 - DNA, 1016 bp, Homo sapiens
gctactcgggaggctgaggcaggagaattacttgaatcccagaggcagaggttgcagtgagccaagatcatgctgttgcactccagcctgggcaacaagagtgaaactctgcctcaaaaattaaaaataaataaataaaaaacttactttggtatcacttcattatagaaggaaaataaagtgtgaggtcaaaatctttttcccttctaatagaaagcaaagaatatgccagtatacatcaagaaggcactttcgtataaattatgaaatttaacccaattgaaaatatgcagaaatagatagttcagcatacctaaatttgaaaacagcacgtgcatgattctgtagggtaatactttggggacatgacatgttgtctttttatactttgctaatctgacatgcctttattatatttaacactgagatatgaatacaaatacatcttcatatttgtttttacaggaagttattccaacttttgacatggctgtcaatgaaatcttctttgaccgttaccctgactcaatcttagaacatcagattcaagtaagaccattcaacgcattgaagactaagaatatgagaaacctgaatccagaaggtaatgtatttttcataggattacttttgttgaaggaaaatgccttacatgaaaatagccttgttttcattgagaaattatgaaagaagtaattggcggtggtagtcaaggtgacggattataaattgacaataatatagattcagttatcctatatacttatgaaccccctatactttttaaatttaattgaagtttctgatataagagatgtgactattggccgggcacagtggctcacgcctataatcccagcacttcaggaggccgaggcaggcggatcacctgaggtcaggagtttgagaccagcctggccaacatggcaaaactcctttactaaaaatagaaaaattaccagggcatggtggcacacgcctgtagtcccggctactctcgggaggctgaggcagga

SEQ ID NO: 129732 - DNA, 1054 bp, Homo sapiens
aaggggttctcctgtgtggataataatgactttaaagtatagaggactttttctctaccaggtgctcttactaggcttgaagtacattggcacgttcagtccttggctctgggataggtgctgataccaccccattctataggggacacaaaatgtacacagaaaggctagggtcaggactcagtccaggctgtctggcttttttcctgacacagcagggtgtcatacaggaggccaggtgagtgaggcaggaggcagggagcagggtaggcagacaagaagggaacgagggatgcctgctggacaggggccctgaggaagaagggccagaggttcgctgggcttgagagtctcctgaagacatagcctgcagatgactggacacagaaaggtcgccctaggcagagtcttgggcacctagctcctgtctgtgatcccagctattcctggacctccacacctcaggtcaggtgtgctgacctctcttctcccctcacagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatggtgcgcagccaccctggccccccaggctatgctttgcctgtctgtatcctcaaaaggccaactataacttgtccctcggaccctgagcctcacttcccgaatggcatccatccctctctggtcttgtgggtttcgttagtggcctatgggctaaatatgcagagcacgcaaagcccctgcttcagggcactgtccctgtgctgttgccagtggcactgtctgttgttagagacactgtattttcatggcctaaaatgcttcaaacgtttgagatgagaatacttggttaaatgtcattctgctttttccattggtaaaggattgaggaattttt

SEQ ID NO: 129733 - DNA, 1163 bp, Homo sapiens
attgagctagaagcacagcagctccatttcaccctcagggtgactgtgcccgtgggcatgctcacgtagctacagttgccctggagcactgctgactagtgggcccaggtgaacacgtcctcgggtctatcatttgcagaaacctgggttctttctcttttgttttgttttgttttgttttgtttcattttgttttgttttgtttttgagacggagttttgctctcgtcacccaggctggagtccaatggcaccatcttggctcaccgcaacctccgcctcccaggttcaagccattctcctgcctcagcctcccgagtagctgggattacaggcatgtgccaccacgcccggctaatttttgtatttttagtagagacagggttctccttgttgattagggtggtctcgaactcccaacctcaggtgatccgcctgcctcagcctcccaaagtgctaggattacagacatgagccaccttggttctttcgagcttgtccgtttcctgctgctatttccctgcttgctcatagcaagcgggagctttgcaatgtgggcctgagtcctgggcttgggagggtcatttaagagacggtggagctcaccctttccagggccagcccgacgtggtgcctcgctctgaagtgcacctgttgcctacgctggttgctgagccactcggaggaagatatgggaaggtaaaagtgcatctcctggttgtgccctcaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaaggtaacagtggattttaaactaggggttgggatttacaattctttgggatcaaatagtataaacatccactccgccactcgagccatccgccataaaggacagagttgtggcctgttagagcaagtgctggcaacctgacttgccattggttgagaagaatcatagcattgtcta

SEQ ID NO: 129734 - DNA, 1155 bp, Homo sapiens
atctctggtctaaacttaggtttctaaacagaagaggccacacagtgtcagaatagggacttgcatggccaccattctggtgtaatgataggtgctgatgaactggtcagtgataacttaaagcatatcaagcactttcacgagcctttttataccttcctgtgatttcttaattgtagttctttataagagagaaaagtacctctaaagtttaaactacatctcagttaactgtgcagaaaatgaatgtttagacatgtctctgattatttagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggtgagtcgccttctccaccgtgaacatggacgtgtttaaaatatgtggacccttgaaagacagggtctgtggaactgtgctgtgctaccttggttctaacttggggagattgataagtgctttccacatcatatttcagctaaatctcaacatgtcttctacagggtgtcacgttttgtctttattgctgtactagccttgaatttgtcctaaagctcttgcaaggtgcctgcttcctgagaaagatgtggttatagcacacattcatctaaactcagtccttggcatgaatctgaggacagggcttatccaggtgaactgctgaagtcagtaaaggcaacatggctcaggcaatagaaactcagtggagggaatatgggtttagtaggtggccgggcgaagacggtgcttgttaattgccagcgtcagggagaggcttctaactgcactctttgctctgataggctgggatcatctgtcagctcaatgcgcgcacctctgtcctggcagcagca

SEQ ID NO: 129735 - DNA, 1065 bp, Homo sapiens
attgactgcacatctgtggtgctcaagcagtctttagtacgtcgtttgtaggtgtattggtgtctcaactaggaaaacagtttttttgttgttgttttgggtttttttgtttgtttttttgagacagagtctccctctgtcggccaggctggagtgcagtgacgcgaacttggctcaccgcaaccttcgccttccaggttcaagcgattctcctgcttcagcctcccaagtagctgggattacaggcaggcaccaccactcctggctaattgttgcatttttagtagagacaaggtttcaccgtgttggccaggctggtctcaaactaccaacctcaggtgatccacctgcctcggcctcacaaggtgctggaaaaacagtatttttactttgttttcttaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggtaaccctgctgaaaaaaggcttactgtgcctgtagcccacagcattaatgtaactgaccaatcatctcctttaaaatattaattattttgttacgaataacatactgttctcttccttgttttgagacagagcctggctctcttgcccaggctggagtgcagtggcttgatctcggcttactgcagcctgtggcctgtgcttctgggttcaagcgattctcctgcttcagcctccctattagctgggattacaggtgcccacaaccactccggctaatttttgtatttttagtagagacagagtttcaccgtgttggccaggctggtcttgaaatcctgacctcaagtgatgcgccagcctctgcctcccaaagtgttaggattgcaggcgcaagccaccatgctgggcctaagaataataaacttttcttttttttttttttgtgagacggag

SEQ ID NO: 129736 - DNA, 3834 bp, Homo sapiens
gccaccctctccaagaattcttcccaagcatctcccagttggaatatgttcacccaccactgcacgctgcacgttgatgtcttcacctgcgatttctgtggtctgtctgtgtagtctctaccacttgatgagctccggggcccaggaccatatctgagttccgtttacttaatggaagcctaagtgttcaaaattcacccacaaaactaaagttgtcaccaaggaggtttgcttttgcttttgtttttctacctacaataggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacgggttcgttattttcagtgaacagaaaagcttttgaaaattatttcaatatgcatgtagtttatatgtcagatttaagctaacagttaaatcatttgaaacagaagttcttaaccttttttggattaggacccctttgagaatctgatgaaagttgccctttaatcttatcttgataaaaatattgattaacacacacagttttgtgtatagtttttttttgttttttttttttatactttaagttttagggtacatgtgcacaacgtgcagtttagttacatatgtacgcatgtgccatgttggtgtgctgtacccagtaactcgtcatttaacattacgtgtatctccaaatgctatccctcccccctccccccaccccacaacaggccctggtgtgtgatgttccccttcctgtgtccgtgtgttctcattgttcaattccagttttgtgtatagttttaaggagattctgtctccttgactgtctgggaagttttgttaacccattttagagaagttgtttgtttcttagcagcagctgcttgctgcacagatgtgtagactgttaaggaaagcagcagctagtggcttacagaaatttccaaataattaaaaactcattcccttcaaatgtactcagcccctgtcgccttatctttctaggtgatactactaaaggaatatttttgagaatttgaagcatttcatttcataatagcaaaaatgttttcattgatttctttttaaatcagggatgagtgccacctctcgtaaacggaaagaagaattagctgaagcattgaaaaagcttattttatctaagggcaaaacaccagctctaaaataccagcaactttttgaagatattcggggacaatctgacatagtaagtgtttatatgtattttttgtttgatagagctttctctttttccttaatattgcttttgggtttttttcctttatttattaaataataaatatagagaagaatgaagaaaaggaagatgaaccataagccatcatcaagaaataatcacaattaaaatttttggctgggtgcagtagctcacgcctgtaatctcatttgggacgctgaggtgggcagatcacttgcagccaggagtttgaaaccagcctgaccaatatggtgaaaccctgtctctattaaaaatacaaaaattagctggatgtggtgataagcacctgaaatcctagctactcaggaggcttaggcaggagaattgcttgaacctgggaggcggaggttgcagtaagctgagatcccaccattgctctccagcctgggcaccagagcggaactccatctcaaaaaaaaaaaaaaagaaaaaattgttatgcccctttcatagttgttataagtttgctttaggtatgaaatatttgggtgtccttttgtaaataagtaaggtagttgtttagtgaaaagaactatgcagtctttcagtgctggtccactttccatcgctgtgttgtgactgagagggcagagttgatagttacaacgtggactatacagatgccaagtctaccacatggaccatctggctactccactcctgatttagagcataaggcatgtgtacagccaccaaaaagagaaagattctgggtggtactttaacattataattattgtgtttctaacaggtaaaggagggacttgacgtgtacaatatttattttctttctcttccccacaggcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaatcatatgagttgggccttttttataacttggaatcaacattttttaataaagtatccatagaaaatgatagatctggccgggcgcggtggctcacacctgtaatcccagcactttgggaggccgagatggctggatcatgaggtca

SEQ ID NO: 129737 - DNA, 1022 bp, Homo sapiens
atgaattttcaaatctatatgtactgaaatggaaggctttgaatatatgttgtaattgttgctttagagtaatacctcaggatacattctgcatacattttaattaagtggtgtcttttacatctttattacatataggtgtcataggttttaagatctttagcagttctagtgttggggtagtatacatacttgggtcagctagctagtaaggcaaggattgttttaaaagtggaattttagtgttatgactttactgtgcttgctgaaatctaatctgtgctcgttaacggggccatatctttataacagttgtgcttaggacctcttatagatttttgaaaatttagtaataaaataatgcattttaatttaatacttttcattttccttttgtgggttgcattattaaacacaattttttcataacactatacatgagtgtatgttaatattttgaaaagaccaaaggttagatgatattaatggcaaatactttttgttaatcacttttagttgttttggaagttgaatataaattataaagattactgataaattattagcatattgtacatagggagtctgtattttttttttttttttgagatggagtctcgctgcattgcccaggctggagtgcagtggcatgatcttggctcactgcaccctcctcacctcaggtgatccacccgcctcagcctcccaaagtgctggattacaggggtgagccaccgttcccatctactagttttttttttttttttttttgagacgcagtcttgctctgtcacccaggctggagtgcagtggcgcgatctcggctcactgcaacctccgcctcccgggctcaagcgattctcctgcctcagtctcctgagtagctgggacaacaggcgcgtgccaccatgcccagctaattttttgtatatttagtagagacggggtttcaccatattggccaggatggtcttgatctcttgacctcgtgatccggcctcccaaattgctgggattacagg

SEQ ID NO: 129738 - DNA, 1039 bp, Homo sapiens
accatgttatccaggatggtctcaatctcctgacctcatgatccacccgccttggcctcccaaagtgctgggattgcaggtgtgagtaaattttgtttttataaattacatttttttctgctatatttcatcaattctaaaacacattgaaatatccgaagtggatatatgtgttgtagtttaattggtagagtgtttaaattttttaaaattatggtatcatgtagttggttatgccatcttagatttgatcaaagacagtatttaaaaaaactgttaagatgcccacattgaggtgaatatataatagatttcaaatactggattctacaaacatactgacgtgttctcatttgttaactgaatactaagcaattgtgatcaatttaaacttaaatgtattctattgaaatatatttttaatctcatacaattttttgaaatattttagaggctaaagttgaaaattggtttatctggtaaaccttcatttcagcaaaagaatattaccttctgattttttttggtgaattatataaatatagtttttagtattaaatctatttgtataaattcacagtgtctgaatgatggatgtatttcaaatttaaagttcagaaaaagtgtagctgggcatggggctcacacctataatctcagtactttgggaggctgaggcaggaggaccccttgagcctgggagtttgagaccagcctgggcagcctagcaagaccttgtctctactaaaaatattttaaaaattagctgcgtgtggcggtgcatgcctgcagtcccagctactctggaggctgacgtggaaggatctcttgagcctaggaatttgaggctgtagtgagccatggcgacagagtccctgtctcaaaacaaacacgcagacacacatgcacacacaccccagcatatgctttgatgtcaataattgtgtattattgacattattgacattattaatgtcaacaaatagtgttcttgagagtggggttgtaactgatgtttttgaaacagccagtgggggtt

SEQ ID NO: 129739 - DNA, 1035 bp, Homo sapiens
gttataaattatattttttctattaatacttattgttaaagttagcatttaattttatactattgatattaaaataagcaattatgataacttctaaaatagttcctttttattttgtttacatttattgatgcttcccacgtgcaggatataatgctcgattacgtagaggattggggggaggaaggttgatatggtcattgccatcaaagttttgcagtttagtaagggagaaaaaatcagtacaaatgacagattctaaatatgacagagcaagttcactacgggactttagaatatgtttcttctagctggaataattgaggaaggctgaacagtggaggaagttgcctttggaatgatccctaaaggactgactggtaggatttcagaaggtggtgatggggatggagaacattccagatagagaggagaaaaggtgaggaaatggagggggtatgtggggagagcagtcattttgacgtaacatgttacctcttgtgtgaacctgagggtttctaaattggtttgcattgagtgcatgttgctatttgccctctgacacttcacatgccatagaaatgctgtaggtctcagcttcttcatctataaaaagtctatgattcttacatttttttctagtatggttggcaactggcccattgtactttgtctttcttgggtttatgaagttttatttttactcaaagtcttttagtctttttttctagcttgggatttttttttttttttacattgcattccttacttaatggtcccatccactgcactccctgcagtgaatctttgaaatttgtctctctaatgtttttggcttgttggaaagagcacacatttgaagggttttttaagtctttggttttgtatactggttgctaccttatgatgagagcattttaactgttttgctcttgggtagagtttagagttcctcctgatgatgatgatgatgatgatgatgatgattattgagacaacatcttgttcagccacccaggctggagtgcagtggtg

SEQ ID NO: 129740 - DNA, 1050 bp, Homo sapiens
aattttagtggatctcaaacttgtcttaaatcaacaaccttctactcatgttaatgtcttgattaaatatcacaatgcaaaatacacattaagtaaaagaattccagctggtaaacatgacctggacatttgtaagaatatatttaatatatgtacacccattatgttttcaggtaacaggaggaaaaatgcagcacaattttttttctcttgaaaggcactgtcatttaaacataaacctggagtactcgaaatagaattcaggtttacaagatgaaagcgtgtggagaagtgtcagatggcagtggaagcatgtgtgtttctaaaaagtaaaaatctcaagaaaacagaaatggcatgctttacccatcttacttagtgaaagagagctgcagttgaaattgtttaaaaagtagcaggtacaatgaatattgtcacagatgtgttaatttttgaagcaatgtgggtgctgactactagtagtatcaaaaatatgttcaggattgttttgatacctgtatttataataaaaaatgttggggggagttgatgaattcctgttaaaagctgttcttgtgtgttacatgtaacagacatggtaaatatttgtttacagtctttgtttaacaaaccatgcatttaagtttaagtgaagtcaacaaaaaggaaataggtgtatggatatgtgattttgagattaaagttagtcttaaaatgtaaataaaatgtgaaacgtgtcctcagagactgtgccatttctattatgttgatgtatatgtacagtaccttgccagggaagcaaaaattggaattattgtagcttttcatgtatacacacttttatttaccctattttgtgtacttcttgtgaattataatttgcagactatttcagaaaagaaattatctagtttaatttcttctttggacaaggagtcctaggtattatattttgagtttgatttcaccagaaataataatattaaaaagatctttgcattctggcagttcttttaggattataggttgcaaattatccaaatatatatc

SEQ ID NO: 129741 - DNA, 1944 bp, Homo sapiens
tgaaactgtagtctaatggtaactgatgatctgaatccgtctctctgataacctcctttccattttgaaaatgtgtcttattatacatggaagctagtaactacgtgaatgctgttggcaggatgagggtctgggtacctcagtctcttgtcctgtttccttcccccaaatccaccattgtgaagttgccaaccccctgccgccttcccctgccaagtacatgttgtcagagtcagccctataatgttcatttcccctcttgtttgtgggattatggatctctgcagaaatctgcatgccaattaacccatttctaaagcagaatccattttgcatgtcacaatcaagatgtacttggcaatctaagacacactgggagactgtaagaggaattaatatagaaaagctcttaattataataacatttggaagaaatttttcctttgttttgtaaagtggctaaggttgtaggagtgtgtggtatttattaccttttaaatgaactgtaaatttgccttagaaatttgtttaaaaggctagcaagtgagacccttgaggatgatcatatactaataaagattaccaaaagaaacttcttgtcctgttaggtcagtgttatgatttaatggttttaattacttaaccaattttaagaattgacaatttttaaaaatatttttttctaccattctaaagtaatgtcttttgttgtgggtttatgtgtaactacaggattttggaacataaacattttgaaggatagtcaatggtatttagtcttggatataaaaatagagaaaatttatagctttatgttattaaaataatttatcacacagagtgatttgaggttttcgcagagtagatttgtttgactcatggtttattagtctggattacttaagaacaatatgttgattttaatgttaattcccactaaatatataatattgataaatacatgtgaaattaatattgtttggaaaatgtagaggacacagctgggaattatgaatgcttttttcttaataggtttggtgtgtgtggctttgaatggttctgctgatgcatcatggaaagacagcagggaactgtagcctgccatcaaaactgtatcaactcttttaatgagcatgtgactgtattaggtacattttgaagaatataagtactgatgataaagtctagtatgcataataggattttggaggcatttcaggaattttccttttatagtatgctttttaggcatctgtatgtgtaatatcatagtatcatttattgctgggatggatcgaaaagcactgcttttacttttctgataagtatcaaaatgattttccagtaccaacttgactggcttttaattattgtcacacacacacaaaattcaactcctcaaggtttgggaaaattgtgtatttttttgtatacaagataaaagtgtcataaaaaggaatggatgaattgttgataggaacattagcagttaatttttacctgatactgagtttactgtaaaataggaaatgcataggaaggaatacctcctaaataatatgccttatagaatgatgaaatcttaccatagttcatactgaaaatgttgtttatttaaaagtattgtggagtgttgaaaataaagatacacaataagtattttctgaagagaaaattaatgaaggtatttaatgatataggaaataagtgacaagttaaagtccattttgtttcaataaaggagttgtgcaaactcaaggagtgagttacatgattgaaaaaaaccattggatatgaggaggttgctatggtgtttatatccttaataggatcttttcatctaaaaaattcctaagaatctgctccatctcatgtttaaaattaaattttttttttttttttttttttttttttagagacagggtcttgcactatcacccaggc

SEQ ID NO: 129742 - DNA, 1132 bp, Homo sapiens
cacttctctctccaggttgtggatatttactctctgctctccaccccactgctgggcagtctgttattccctgtcatcaaatagctacttaactagaaatggcatctctcagtgtcaccaccattccctccacacatctgtctttctcagcatagtctcaacttcaccctgtttcacaaccatttgccatcatgcttcccctcagtgttattatacaagagatgaacggacggtgcattgcaggctgagaagtgaggaccagcatccccatagctgcctgggttgcagggctgcagacacacagagaccgcaagaggaggggataccattaaatattttcaaggagatagataaggtcgtacaattattgtttttcatatcaatgaacactctgaggtttgccaaggttgtgagtttccaactaatcaaaacctccctgaatattaaaatacacacaatgtaacaatatggaattgtatttggatagcttaaagtctggtacaaagtagatgctcaataaatatggaatgcaaggatgaatttccactccagtgtctgattacagtcttctgttattgtcatctgaggtatgataccctaaagaagaagtgaaccatccctgaaaagaggacactttacctttggcatccccatagcaaactgacacacctagcaagcaataggtactcaatgagtgctcaatgatttgaatcaaggcctctcttaccttttttgcatgtctgcctaaagtaaataccatattccatgccattttgcgctcagtataaaaccatcagcatggagaaccctctgcaggaagtaactattctgtaaataaacaccctttctccactttgaatccaaattttctaaatttttgaacctacagtggcttgaatactattgctcatttcttgtttgatgacaagataatgtcggaggtttcatgataactcctatacgcaaaggactagggaaaagtcactctccattacactttggagaatacataaaactcagtggcttttaaattaatcatttacatctaagagaaaatatcgtggaaaaaagagtagaaaaaagataagcaatttccttatatattatgccaataaagcattttttaagaact

SEQ ID NO: 129743 - DNA, 1101 bp, Homo sapiens
catgtagaaaactaaataatggagaaaaaagtgaaaggataaaaagaaaagtaggaagaatgagttgaatgagcccaaaaagctggtgccatggggtctgtatttttgtcagagatggagcagacactgagcgctgcaacttccagcaaccagcacagcaaggaaaagctctccaggcgtgactgccatggaaacacccttgcacagaggactcccatgtattcagccaggtgttgggagagcctggacttcagatcacatccctcacacacaggaaggtttctctaccatggccctcagcacacccacccctccccagacccacagagtaggggaatttctggaaggaagaggaatccccccacctcacagggagcgactatcctcacatcagaggttcactccctgatgagctcactcaggagctctgcagtcctgcctttttttcctctggtgcagagactaattacagggttattggtcctcccatttgatgtaccagtggatcagaaaacaagacaaacaaaacaaaacataagccagctgagtgctcagaattatctcacacaacctcttcctgcaatcctagagaaggcaatgcctttaacacacttggtgtccataagccatgccatgagtaactgaatgaaggaaggaaggttccgacattctcccttcacactcttcgccccagcatgtgctttctgaaacactcactctcagattgaaccccagccagtgggtgaaaatgatagctatttgcatggaaacttgtgggggctttgatttcattaatcctatattatattgtagcttagtaagctatagatcttattaaagacaaccagagacttctggctatgtagcatattcccttgcaagctgcatttgtgaaatacagtttacaaattatcaaaaacaatccatttggaaaattttcagctgccattttgtttaaaaatggagcactcaaactaaaattaaatctaaattcaacccaaacatcttttaacagagtactcatgctccacccaaatcaatcaactttttaagttgccatggagcagagataaaatatgaaatactgggcaagcaagttac

SEQ ID NO: 129744 - DNA, 1047 bp, Homo sapiens
gtttaaaaataatgttgaggctctccttcctcaatggggacggcgaaggcactggcttggctgcactgtctgacttcagagcacctatagctccgtgcagctgtcagcctatgtgtgcattaagtacagtaactccgtaggtgccagggtggaaatgaaacattttaccagtgtgtatgccctcctaaatgggtctatcttcttcctaagaaaatcacgtgtgtgttgctaaatatctttccagtgtgtgtatacttgcgtgtggatttatttttaattatttttgccttaatcttctctccctcccttttctttcccagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggtaagagaaaaaccataggcaggaatgttactctgagatacaatgaagccctgggctggctgttggatttgcatgaagttgtgacatagtgcttttaatgatggacagtcattgatagctacttcctgactactcaaaaagttgttagggcacaaagtgctccatttcttgctaacaacct

SEQ ID NO: 129745 - DNA, 1234 bp, Homo sapiens
agctgctgtttagatgatgcttttactatgcaggagagagtttttgttaaggatatatttgaagattggcttttccatattgtccttcattctttgaccatggcaaagtgtacagtagattttcatgatcattgcatatttcttgtcattgaaatgtatcttttatgtttttaaatgcattcattttacacttgtgagtttatcattgactttaagaggtagaaatgaaaaatgaaaattaaagctaaagcctttttatctattaatgcagatatattagaataagaatattttgggtttgtgtttattttttaatgaatttatgtttacttgatatggaaaattacgctttataggtggaaaagtagcaaataaagattaagtaaaagtaagtgaaaatgatggggaatatagtattggaattttatagctagttaaaacagtaagtatcatctaatttgggtgtttattttgcagatgagaaaacagacctagaaccgtggcatgttttgcctgaaacatacagtgagttagagacagggcctaagatagcttctagcatcagatcaatcccaagaatccatcagcaacctcagaccaacccaagaagataatttaaatctatactgcttattggtcaatatatttggttctagtattaataaagaaaaatgttattaaaatagcatacatagtagtaaaataaaatacaaaaagtgtgttgatttatagctgtttgagatgataaaagtgaagcaaagcctgttaaatcattggaagacttggaaaattattttaaataaacaattacatgtaattaagcatttttctcccatggcctgacttttatgtttgtcttcttctttttaaatttaggcaatctcagtacacctatggatatgctcaattatggcatacaattgtctttatttggacatctcactgtcttttgactattgccacttctgaagagtatggaagttttttaaaatttatttttataaaataggtagggaaatttataaaatattcatgaaatataagaaataatttagtgtacatgtaggtacatgtgtgtgtacccattaggttcaactaatagctttacagtctcctgtgtgccccttcccatccacatcttaatccctcccttctcaggaggagggattttgtgtttatcataatctgcctttttgttctcaatcacctgcctgcatctctaaacaatgtattt

SEQ ID NO: 129746 - DNA, 1288 bp, Homo sapiens
aaaggtagagttttcatattttctgtattttctaaaatatgctaagaaacacattttgttctatgaaaaaaataaacaatagataatgttttattgttaatattttctttcttgcgttttatgtttgtttttagctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttaccttacttttgttgcaatcactgttgttgggttgctgtatatatattccgggcaatatatgagtgcaataacaatacaagatattgaataatttagctttaaaaaatcccacaaattttatgaaattttacagccctgctacttttgcttttgaatctcttgccaaaagacatgggtaaaatatctgcctctctcatagagattttaagagcacagcaagtgaattattaaaacaaagtctatacttaatacaactctttatatggaccctttacattttcagtatttaaaaaaatgaggttatcttaactctatagaattttaaaagtatatttag

SEQ ID NO: 129747 - DNA, 1199 bp, Homo sapiens
ggcttagttctgggtgctttcttctactcttggtctttgcatgtcacgatgggctgatgacatgagattagcatctccagccccgaccttgcccctgagctccagagtcataatcttatggtggcttatggtgggaaaggcagcacacactctgcagtcaaaacctgcattcagtacgtaatctcctagcattcagttattacttgtaaaacattgaaaatggtgacgagtataacattgtagttattattatctctgaaatctccactttggataaatgatagacaattcacatctaacacaaagtaagtacactttaaaattttcttctcaacctgttctcccctgtatctttgtcatgtcagtcactgatatcagcatctgcccagttgctcaggccaaaaccttagatgttttccttgattatttttttttccctccctcatcccctacagccaatccatttccatcctatcttcaaaatatattatacctgaaatttgtccatctctcccatctatactgccaccctccgtcagagtgtgttcatatttctagtggattaccaaaatattccagctgatctcgtgctcccaacttcatctgcactagtcttccttcggctccttggacatgctaagctcatttaccttttaggttccctctgcccgcaagatgtttacatggctgttatatcatctagatcttagctaggacaggatcttctcagggagacctttatgaccacccaatagaaagcaaccagggccaggcacggtggctcacgcctgtaatcccagcactttgggaggccaaggtgggcggatcacgaggtcaggagattgagaccatcctgactaacatggtgaaaccccatctgtactaaaaatacaaaaaattacactggtgtggtggcacatgcctgtagtcccagctacttgggaggctgaggcaggagaatcgcttgaacccgggaggtggaggttgcagtagctgagatcacgccactgcactccagcctggtgacagagtgaaactccgtctcaaaaaaaaaaaaaaacaaaaccagaaccccactttctatcatatcattggcgttttgatttttttcttgtattccttatttttcttctttataattgatttttgtttagcaactcctccctgattatgcaagttgcataagtgcagggagtgca

SEQ ID NO: 129748 - DNA, 2167 bp, Homo sapiens
ctcctagtctctttgtaattacatttatttgtgaaatatcaagttgggggtcgaattagaatctatattccattaatatcatggaagagcatgaagtcaacatgtagtcaaaatatggtcttattactataatgccttaaccaaattactgcacctgtctcagacatgtattttgaaaggcaatggcatgtatagattgtagtgcttctcctagacactgtcagaccacagatctaacattgcagactcacttggccatatttgagtatcccatttgcgttaaaacatctgtattaacagcaaatatttccattccttttatatcttatagtaaatatttaaatggaattaatttggtcacatttacatttaagtgattgtgtagctctaactggcagttgttcccttaaaacaaagttttgactgtaaggtgaccacattgttgggattaagttgttcactttctttcttttttttctctaaatagttaacacagattatgcgaactggacagaacacttgggaaagtaaaaatatccttgctgtttcatttgctccacttgtgcaaccaagtaagaatgataatggcaaaccagattctgtgggactccgtaagtagctcttcatattttctgattgaattatgacttatggtgtttggcttttatgcttgggatttaagactatgtaattatgaagaattaaatacttatgcagtaagatatttggtggatttattcaactttttttttttttttggagacagtcttgttctgttgcccaggctcgagtgcagtggtgccatgtcggctcacagcaacgtctgcctcctgggttcaagcgattcttgtgcctcagacacccaagtaggtgggattacaggtgtgcaccgccacgcctggctaatttttgtatttttagaagagacgctgtttcaccatgttggccaggctggcctcaaacacctgacctcgagtgatccacccatctcagcctcccaaagtgctgggattataggcgtgagccacccgcactgggcctcaatttttttttttttggtaaaataaagccctcaccttgtaccagacactgttagctaccttcatggaaacataagaagaaggggcaggtcaaaccaaaaccaaatttattaattatagtttgtgatgtggtggcaagttactggttgtgggaagggcatctactgtaggtatggtggtaaggaagaactttctgccaaggcaacatctaaattatgaccagagtgatataaaagaacttgccacatcaagatttagtggcagcattttttcatacagagagacaataaatacaaaaggctttaggctgaagagaactttggtcattcccagatcaggcataaggtccagagtggtggaagctcattggctgcctgtggagggtggattatcataggaaaaaaaggcaggcaggccagtcaggtggcttttcttacacccacaggagagtggatgttggtgtggatagtgttgtctaaaggcagaagaatagctgactcgggagtgtgggtagagggaaaagaagaattcattttcccttgaggctagctgagtgctggcattatttactgttgccaggaagactggaagtggcataatttggaaataggcatagaaaggtctgacattttcctttcaccgtgtttgagttgtctgttaccatacagacaaatgtcaggtggcacgaacctgcttcatgagcaagttataaatggagacccctcaacatgaacatggcattttaggctagggttagatagaaatggatgagatcatttagcggagagtggagataaagaggagatattggagttggacctgaggtccaccaatttagcgataaaatggtggaaaatggattagcgaaggaggggccaacaaaggtggtgggggcaaactagggtcaggtccccagggtgttgaaaaccaagaaagaaaagtttcaaggagggagtgatgaacctaatggggcaaatgagagcttgaaatggagaggagaggtggtattaattggtttgacttagatcatagtttttttaaccatgaggtaaaattctttaccaaaaaggaacctcttgacttagtttgccttttaaatgaacttattgcataggaatttgggttta

SEQ ID NO: 129749 - DNA, 1047 bp, Homo sapiens
tctttgtcccattcagtgatgttcctcagccaaaatttattagaaactcttcctaaccttactggttgcaggggtatgtggtcaggacactcgtatctttttttgataaagctctcccactttgaccttcagcaaaaatgtcaaactgagatgaattctacacaaacccttctcatttctgctggcccctcaccttttttggaaaggacaatgcaaagtgaagccttttctcatttattgatccttatgattctcattgttatgttattttggggggtgtcacaatattgaggttgtgatggacttttcattatatttacttctgaagacctaagtgaggtttcagtgtgggcaaaaatgttaatgttttgaaaacacatgtccgtcctatgtcattgataatataacaatacatttgatgagtgctaaacttaataaatattatatttaaataaagtttataatcattttatccttataattaatttgggtaacgtcattatttcaaaggactggattatggtaaattttttagatctaatgttttgcttaattgaattaaaatgtttgtttttcaatgcagatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcaggtaacttccactctccttttctttagtggcctaggaagcaagcaaatttgtttaaggttaagaaattttattcagtgaaaggtatattgtaacttttaaagaaaaaattacttttcaccagatttatcttatttgtttagaaaaaacttgaaacatcttaattatttaaacaaaggagatagagaaaagatctctctactatgactggaggtaacttgggctttcaactcagctcagctactccctgtgcctggtgttcagcaagctgcttcctcctttgttttgcttaccc

SEQ ID NO: 129750 - DNA, 1304 bp, Homo sapiens
tatattttaatatgcaaatataaagaattagatattttacattgttctaaaaagtctctgaaaacccatgcgcattacagatgatctaaacttgaattagccacattttaagggtttacttgtcacagtggttggtggctttcatcttgatagtgcagctctagattgtcctgtctcatctttcagatcccagcttgccatttctcagggagcccttctctgatccccatgcctgtcagtttccctttaagagcatttatcacagttgtaatttatatttcaattagtaggattgttcgatgtttgtctcttccattagatatagacacgagtgtctcccattgtattctcagtcattgcacaaagctagtgctcaataaatagtatttgactgaaggaagtgtgcaattagtggtataaggtaacttgcccagtgtcacacatttaattttagaatcacacactaaattatttctaatttattttgctgtgatgaacatgtataaaatactactaattaatgaaaagtggttttaattgtaagttgtcattacctgtaatggtgatttccttggcagtagttctgtaagctaccacatatttttaactagtaggaagcttttaaaactgtaagcatattttttagttgatttaacatgtttgataaagtggtttaataattcaaaaatttttaattatttaaattccctagtcacattcatcctgaaaattatgaggttgaaataaattattataaaattaaagcatttaaaatgaatttctgtaaaatttttagatagaccatactgaaatagtccaacttattattaaagaatgcttactgtgaatttgataagatgattaaaccatgtgatctacagtatctaattacttaaaagccaaaaattatattttggccatattttaaacaatccgagattatggcatagttttgaatataaaagagaaattaaatatgattctctaacctaggtaaattcacattttgtgtgtgctgtgcaagtagaaaggatgagatgctattaaagaattgagtaagatttcattgcaaagctgatatttcaactatatcttgaagggatatcaggcatttattaagggtagaaggagaggggaaggatattttaagttaagggaacagcacatacacagatacaggatttcaaaacactgtgtgatggttcctgtaaggaattagaagcaagtaattcagtctgcctgcagagtagtacgttcaggctggggcagagacaggaaaggagtctagtagaaagacttgatgg

SEQ ID NO: 129751 - DNA, 2700 bp, Homo sapiens
tttcatggcttcaaacacatttttaggagaagaaattgttgaaatacaatttcagcaataaaaggctcacctttatatgacttacctgtcacatttcctgtaaactgtttggagattgtttttgttactatgaatttctctgatgctttctttaatgaacagtaactgtatttacttgaaacacattgcttggaataatgcttgaattattctgagatgactttgattcatttgaaatggaaaacacttgaaaatgtaaaggtttgtttttcaaaaaattgtaattaaatagcttaattattgattgcaagagtccttgaatggtatcagtgtatctggagatcaagagtttaacatttcccttggttttcttcacaatggaaaagtctgaagttttattttgtcttaataaagcagtcatggctcttaaaactcaaaatgtgtattttgacaaagtatttcaagaaaaagaagttttttgattcatttggcaggttgttttggatgaggtgtgagaacaaggtaggattcttttccacgtccttgaaatttctctattccactggaataattgtctaaaatttcaataacagcatcctgtggcacgtgataaactaggtgtgcaaattgtcagccccacttcaacagtgtattgaaggggaatgttgttttttctactctcagtcagctcctagacctagactatccgtctaagagggaagctacagggcaaggctaggtcaccctgatctcctagcagcttatcaaaagaattatatgggcaagttggcaaggtccctgctgtgaacgaaatcatctgtccatctcaagatgaagatattccaacatgcacctataaagaaaaccactgctaaggtaagtgattagaatcctggtgttattttgggcaagtcttcatgttctaaaccgagatatctgtgtgctctatatttttttcataaatgattttcagggtacattttattaagagtatgtcaattacttttccttatctgcctaagagagtctgagaatattcattggattttcaggtttaaatcaataaatgattataagcttagaatgaatgattttgtggttattatacacatttcaggactgttgatttttttttccttctgtatacatataacatttttggtagtgtaatttaggagtgtgggtcatctctatcttggaaattttgttttgaacattttttttttcaaagaataaaaatgattgctactttttattttacttacaaacataaaattttaatgaactcctaaatcaagtataacaattagggaaggaacacgccaaccattcttttacgagtaattataaacacatattaagtatcattttagtagactttttgccatttttttccttctcagatttcatttattgtgtcgttgatataaaaaggtagatttcagattttctctttcaccatttttaacctatgtgtgtaattttataaatagtgtagtattattttgtgataaactgagaactttcgttgaatttattgttcagtcttagagattatacagaaattgtatttgtagtttaaaatatgtcctttacctctataggtttatggaaacttaggtaacatacagttttcagaagatagtcaaggcctaaggaggaaaaatgtttatttttttctctactttggaagaatcaataggagttgtaatttactgtgttcgataacatggtagccaccatctgtgtcttgaatcagtcatctagttattcacatatataaatatatatataaatatcagtaaacatttacctgaattcttttttttctttgagacagggtcttgctgtgtcgcacaggctggagtgcagtggccatggtcatagctcaccgtagtttacagcttgtgggctcaagcgatcttcccaccttggcctttggagtagctgggactataggcgcgtgctaccgtgcctaactgatttaaaaaaaaaatttgtagagacagggtcttgccacattacccagactggtctagaactcctgggctcaagtgatcctcctgccttggcctccgaaaatgctgggattacaggagtgaagaaccatacctggcctacctgaaaaattgtaatcatagacttttggaaaaaatattaactgaaattttggccactctataacctgattggtatgaatttgtttacatgaaatgctgtataaaagtaagttatgggccgggtgtggtggctcacgcctgtaattctagcattttgggaggcccaggcaggtagattgccggagttcaggagttcagaaccagcctgggcaacatctctactagtacagccccatctctactaaaatacaaaaaattagctgattgtggtggtccacctctgtagtcccagctactcgggaggctgaggcacaagaattgcttgaacccgagaggtggaggttgcagtgagctaagatcgcaccactgcactccagcctgggcaacaaagcaagaccccttctcaaaataaaaataaataaatagatagataagtcatgatattagtatcagaatacaaaacgtctaagattcttaacagtgtgcccagtcagaaaaacctaagttcatattataagtactttattggaaagttaatccataatcgctttacagattgaaaaaaagtgagaatatgcag

SEQ ID NO: 129752 - DNA, 5634 bp, Homo sapiens
ctgtgttagcccatggttttaggtattttgaattaccaattttttagcaaatgataaaataatagcaagtaacttaaacttcacttagaaatactattcttttggcagttttgtcctgccagataagctactctcttgggagaactctgtaggtttcaaccttatccctggtagtagtttttgatagaaaactcaggcgaacttttttttttcccctttttttacattaaagcaatgtacgtggatttccattcaacttttaagtctgaggctaggaagtatttgcatatttcaagccatctttaaatactcctgtgatgtataaatgagcagaacttaaaaaagagctctgtaagggcatattattaatattttttataaaaatgctgctacgattgcaggtccttttggaataaatcatgggattgagcttcattcagatgtggtggaatatgccaaggaaaaactggagagcttcatcaaaaatagtgatagctttgataagtaagtattcatatctatagttttggtttaaaatcacttaatagatacatgcaacatgtctattcttgaacactattattgatcctgactggctcaattgaatgcagcaaaaatcagtgcaccataaaatgagaaaaagttaagattattctgtggtataacttttactatatgtaattctatagtaaattataaataatgtgattttttgctactacaactttattagtaatgttgaattcattaaacattcagctatcttttctggagatacagtgtaataatgctgtgattgcaatatttgtctggaactggttttttaccttttggatagtaatttagtagttctgtcctcttcaggacatgagaggtggtaccagtcagtatacaaaggactttaacatattcagctactttgtaatatatccagaagaaatgatcatagaaatacattgatatatcttgtgataggattgttaataagaaattggtttataaaaccattgttttgaactcacaatataactcctcttagaagaaacattgcacgggctttggtccttgggctggcaggaaaagtccatttggtgtgtaatcctaaaattctgcattgctatagagcaagagcacttacgctgaaatccatgagctctttgaaattgtgtaaaatttggagagcttttacatctctcatttcactgtgtatctgattttcaaagagaaaaagtgttaaaaaggatagaaaacacaagcttagaacagtcactttaaagaacaaagttttaggcaaaaacactgagaatttcaactcggcttgttgggagttggccctcatttatatccagcccttggctatgaccatcaacaacttgagggagggggctacatcagaactgagggcttttctctagaaagatctagattgaaggacaccaccagagagaagaagctaaaaaaccttgtgaatatcttcagaggaatgtttattttccccctcctgcctttgcccttcctccccttcctgcctttggccttcctccccttcctcttgtacttttgtttcattcccctttgcaatcccagtttgtatttatcgtctggcaagtggcatttgattggttgaagaacagaaacctgatgtaatggagcaaaatcctcagtacttaacagtgaaggcaaggtcttgtgtctacctaggtgtgattgtaactgttaaaaattgcaggcaggcatggggcagttgggaaatgctcaggtttttttttactgtagttcaatgaatttaagcaagccacttgaattttctgcattaatttactgagcaccatcctgtatcttatttatgcttgtctttataaacaacacgtaatgcacattttgattcgtttttcaaggcttactgtgttggttcatatcctagttccaagaaaagcacgtttggcagaaataaaagtttttactccaaattatttgataagaaatttggattcaattttagcatctttttgtgtctttattgtttctctctgtcttaaggattatagtggcatggtaagtgcttaagatgcagtcatgaatgtatttttatacaattagaactatagaattttgttcattttatttaattgctattaagtatttgttttgatcttgaaacttcatgtacacagaagggctttttgagtacatttgaatttagaaaatataaaagtattagtgaaagcaaatttttaaggtctattttaagctctgttatatgttagttattaatagatttcacctattaatacatgaagacacagataattccattttgggtcattaattgagcagaacagactcaaggaagactcttgaatcagtgaagcaactctgtgcaagtgtctgtggagctcaagcttattgctggcaagagggtatagtcctgggaaacaggaaaatatgttgtgatttgaagtgtttctatgttgatgtaatttaaataatcacaacacaaataagtttgaagaccacttatataagtatctcaatttttaaaaattctcaaattgtttttttttttgttattgtaaaatactcaaatttccctggcttatgtttctttagttttattttcattactgtgttacccaggtttgttattcataatatgatgaatcgtaaaatacagtgatatgactggtataaatgtttctctgtaatttttaatggccttgttttagttattatatgtagttgtttctaaagtgtttgttacagcttatttttgaaacagattcttacattcatgaactagtcttgaagaagacagttctgaaaattttattatcctaatcttttcagtgtactaaaacattactcttatgtattgcagattataaagtagcttatatacaaggagtagtaggtactagggaaatgtttcattttgcataatgaaacattttgcataatgagtggctggattcaatggtttttttttttgttccttttgtacagtttggtttcaatgacaaattataaaaatgatattgttcttacatgtgttttgattattttcagtttgtcttgatgtttgtggataatagttaaacttattttcaagtttaaaatattttacaaacttgctatgcaaagtggttttaaaaatctcatttctaagcagttttatttaattatgtatggttcatcaaaatatatgttaacaaaatataagataactgaggaaaattaattgccatttgtatattccttagtaccagattatcgttgattatgtgtaatggagagagaataaatagctgaaacctaatattcttccagttttttttatgctgccggtttggatcttttttaatcagtccccttttcaaaagtattaccatgtcatgatttgaattgcatttttaaagttttcttatatacatatatttaagatcatagtaaactcccaaatacagtagagggggtaaaatccatatgctaatctgcattagaatatataaagttagatgacctttttaagaatacaaatataggctgggtgtggtggctgacactataatcatagcactttgggaggccaaggcgggcagattgcttgagtccaggagtttgagaccagtctgggcaaagatggcaaaaccctgtctctacaaaaaaaaaaaaaattagaaaaattagctgggtatggttccacatacctgtattcccaactacttgggaggctgaggtgggaggatgcagaggttgcagtaagccaagattgcactattgcactccagcctgagcaacagagtgagaccctttctccaaataaaatacaaacatgtttttatgttgtatagagcttgattcctgtgttttgaaagtagtattctttctttaaaaaaaagtattgtaagtacttttaaactttgtatgtcttagtcttatatcatcaaatgaaataatgtggagagtacatagcactagatttactgtactggagatgggagggaagggggaagtttcatgtctgatgtattccgttgatacatatggtattttaaaattcactgaaattctcttataaaaatgatgtgatttcaagggtcctctgaaacattggcaagtttttcccacaaatcccagttagtaaatcttttaggcttgctaagctagatggtctctgttgccaccacctgactctgcctttgcagtataaaactggatgcaaatgccatgaaaatgaacgggcttgagggtgttccagtaacattttatttacaaaaacactctgtttacgagctgtagtctggacttggcctactgtctgtaaacagtttgctgactcctattgtacttttatacattctctcctaaacatcctgtttttagctagacaagtaaaggcctttagatatctggcttttgagaggaaaggaggatattgggaaagtcaaattatgagtcagtatttgctcatgtacagttaaaaaaattatctccagctttattagaagagtatgttaaaggagcctgaagtataaactttttaccatgtaaatactttcaaaatgaattattagtatagcatttatttatagccacacatatgtaatgcatatacatgtatgtatttgatttggctccctggaatgcatgctttggagagggccattttctcgtaaagcattaattaggccaatagatcctatattcgtccccttttaggtgacttatagctgtgactttgaaagtatgacagtgtcagtagccaaatgagtataatgtagtttgaatcattggagattttcattccatatgaatggaagaccattgtctctgtatagtttgccatataaatgagtcatgatatgagtaatgaaaacaataatgagatgataaaaaataatagcacctaatatgcatttgtctgttcattagtgttaaccattctaaatgttttatccacagttctagagacaatattaattggtgttcacatttcccagatgagaaaactgagggttagaaaaagaggctgtaacctgagcctgggagtcttcttacttagttctgtttggctcttatgatgtaaacgttgatttattctaatatttctttccagcaagttactgccatcaatgaattacagcctagcaacttgtataggaaagtttcctagataggaaagttgaaggagtacttttattttcataatttacttttttcacattagaattaaggaatgctgttaatgcacttaattcactatagcatttatattaaagagcataccttgttcattaatgagacttgcctatggcatgaatttttattggggtcagggatgggtcggggaggcaattcattactcatatttggttgaggtataagttttatatgtagagttagacttttgtattttagaagatttagttgacatggtcatatctactatcctaattttattttaaattatgtgttcatttttcacatatgatttgcatttgaaaattagatgcttctatattctgtcatcttttattcacttcatctttatgagaattacacttatttaaaggagttttcctatatataattcattatatattcaatattattccaaaatatttctcaaatatg

SEQ ID NO: 129753 - DNA, 1220 bp, Homo sapiens
atgacaattgactgcgtgttactttgagaaaagtactaaacctttctgaatttgtttccttaagtgtaaaatttgtgaatctctatctccctgtgtaggagctggcacctacagaattgtctttgtttttctatgacaaagtcttccctaggctgagttggatattggactgaatgcgtcaggttagagccagaggttgactggagttggcagggctgcttggtctgctggagttcttggtctcgtctggaacctgccttcacattctctctgggtttggctcttgcagggtcagtccatctaccctcctacacccttgccaaaaattgtttccttggatttcacatctctgtgtgttacgtttataaatactttgtccttttttgggaatgaacaactttggctttatcctgtagtgaagggtgaatctttcgtctttcttcaagtaacatccacatgcaaaggattcatagatttctgcctccaaggtccggcagctgagctctggacactcttgatcttccaagctgcactccaatctgggttcttaaacatgtggtgcctgcatcctgtttcttctccagtgtacaaaagattccagaagtgaggcctgtccccaacaattcttttcctgccctcttccacacgtgacaaaaagtttaacaaattctcttctttctcctctgtttcctttcttagtgaagagtacttttttcttctaaattacataatgcagaaacttgagtaccagtctctcctctttaattttattttctggagtaggtaacataatcacagggctgaaaattcaaaagtatcaaaaggcatactttgaaatattttccttctcttcctctcctatattttacctcgttgcctccccactttgacgataactttatagagctctgaggacactgtgatttttgcaaatacataccgctttatagggatgatagttggcttggagtcagaagcaaatttaggaataaaaggaaaatgtttgttgaattttgacagatttctatcaagcagctaaaattaataagaaattaattttgaatggaatgtacttaataacatttacttctgtggtatgcatcattccctaccatcagataatatagatttaacataatttttggtcaggcactattttaaaaatcaagacatgaaaaatatttttatgctttgtggatatcatttgtttcagtcttcgt

SEQ ID NO: 129754 - DNA, 1014 bp, Homo sapiens
catttgagttactagtttttgaccaaatgcataatgccattatgagcatttaggtacaaatctttgtgtggatatacattttcatttctgttaggtagattcttaaagagtagaattgctgacctgtatggtaaatttatgtttttaagagaccaacaaagtgttttccagagtggctgcaccattttccattcccaccaacattatatgaggttctagtttattcacatcctcactaatacttgttacttcattttttaaaaagccgtgttagtggatataaagtagtatttcattgtggttttaatttgctcttccttaatgactaatgataatggaacagctattcatgtgcttatgggccattagtatatttttttggtgacatgactagtcaaatcttttcctgttttttaattgagttgttgattgttgagttgttagtattctttatatattttggatataagtctttatcacaaatataattttcaaatgttttttcatgctcttttaagtgcctcttaaagaatgttctttattagcttactttaggccaaaagattagggagatccagggtggtcagttcccccgtccctcaactctcattcttcttggtaagataaaacacattctgggccaggcgcggtggctcagtctgtagtccgagcactttgggaggccaaggcgggtggatcacaaggtcaggagattgagaccatcctggctaacacggtgaaaccccatctctactaataatacacacacatcaaaaaattagccaggcatggtggcaggcgcctgtagttgcagctactcgggaggctgagggcaggagaatggtgtgaacccgggaggcggagcttgcagtgagccatgccactgcactccagcctgggcgacagggcgagactctgtctcaaaaacaaaacaaaaaacacattctgcaggtatcaaggtttctgtataagatatactctgttttatgcatcaaacagaacctgagttttttc

SEQ ID NO: 129755 - DNA, 1079 bp, Homo sapiens
aagttaccttttgtggttactatatgaattaaataaaataatatagttaagaaggagtttaacactatgctggagcagaatatttccatgagaaatggtagttaattataatgacatacatttaataaacaagttattttgcttttgagcattaatttaaacctgtttatttttgttcttcccttccaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtaattttatttttgtaaaattctattttaaaaaataagccattttgtattatggtttatgatttataggagttgtaactttgtgtacagtatgtttgaatgtgtatacacagtgtaggtatcttccttacttagatgtgaaaacacaaagtagtagtaatcttttttcattccgagtccttacctcaacctacagtagctctggaaactaactgttctctgttagtcattgtctgtacttaaagtcaagcgctggtgggcaggaaactcaggagtaatatttaatctatttcagatagagtgttctgtcttctggcatataaagtttgatggttatctaagagcattgtgccaggtttttgttaagagagacaggagaatgtgggatatataagatgtggcactgttagggtaaagcaagagattggagaaaaatagagaagaaagaagtatatgttcattaagctttcagcatatttaatgagtgt

SEQ ID NO: 129756 - DNA, 1027 bp, Homo sapiens
gtcctgaacaatatatacagtataataccagtcatatgtttaaaaaaacgaagtatatagttccttaaaagttaataatgacagtggttctttgaatgctagcattatgaaaattttaattttactttattttcatgttttctgcaaaggcacattatcatcaaatcagtgagtataataaaaaggtaatttataattcagtttccacattcagcaataatgtatgtggtaagagctgtatctgtgaaactctttggtgtggtttaagttattatttatgtaataatcttctctttctgtatctttatttttctgccctagactgtcttattaaatgtatttttattccttaggaaattttccatatggctttattatacttcatctgtgctctctctataacccctttaattttacctttacttgccaattttgttcaaataatacttgtaacacagtttgtaaagataccgcaaaccttgatgccaaagcatagcagtccctggcttcacctgttttcacccccagcctcacattccagaaggaacttaacacatatagccattttgtagggtatttaatgtacacattgctaactaagatgctgcttttcctttttattcattacttttggacagatttactttctgtcatcatagataaggttttagctcccatgcccctcttttcctcttctctctcactcagtgtggttaaacgagtattaaaactaaataaggaattatgtttatagtattttgactatgtaaactgtgtcattctcccacacccccccacaccaagtaatacagttctctttatagttttggtttttccttaaaatcctatttaatctttagcaaagaataattgtatatttatggggtgcgatgtgatgtttcaatatatgtttacagtgtggaatgattaaatcaggccagttaaaaaatttgcctctcaaagctatcattttgtatggtgaaaacatctacaatttacagtttcagcaataattgtttcagcaatc

SEQ ID NO: 129757 - DNA, 1049 bp, Homo sapiens
agagcacagtgctaggtatatagtaggcacataggaaattgctgctatatgttatcactacttaaacaaaatttaagatttgtattcatcattgaatatagagtaaagtagatgctctttgcagcttttggcaagtgagtagtgaaccttagtttagccatttattttctttaataattctttatttatatttcatcatatctctttatcagccccatcactgagaagaattttttcactgtatagttgcctctgcacttaaagcaggcttggtccatgaatcccatgacaagagctttgaggacatgaggagcattctttgttcaaacatactgtgttttcctttggatcactggtgagtaagcttccctctagagctgggtgagcttagtcctcagttttgcagagaaaggagcagcaaggagcagttgactgcttccctctgggtgctaggaggaaaggaaagtgagtcagcattcattttgttctcctcccaccttgcaacatctgtctgccattggtctgcttcctacctcctttaacttgtcagtgcttaatcctccagaaggcatccttaaactgcctaagagacaccataatattgtatggggcctttgacagttctttcctaaatagatttaagtcacaattctaaattttggaataatagcaagaaacgtttggaacactttgcagatagtttcaggtgtgtatatgtgagtgtaccctttattttctctgcagcccttacctaacacacagcagagagaaaaataccaaggaatgaaattgtgttttatgagtaaacatgatgacttccttctcaaacagacataactctgtaactgcttaagttgttgaaccttttattctgttcttacacttgatctttttctatatttacctttttcgtctttctctcaaattccttattttggttttattgttcagtgcaggacttgaacactcctaaaattgtttcttctttgtggaaaagaaaatggcaggagtgaggcagtaaaaattgtgactgaagtaacagaaatgcc

SEQ ID NO: 129758 - DNA, 1032 bp, Homo sapiens
gtttagctgttggttatgggagccacaggtgtgctggtggatggatcagtcggtgcttctctgtcactgctactgcgtaagtagtgcagaggttttgttctgattatgtatcattatatctttgtagtccatatttaaaatactgggccttgagtagaaggaactatttagaaatgtcatagctcaaaaagcaaatgcaaaacagtctttgttttagaaggatggtttatccctgttactcctgtaagtctcggtattctaaattttcatgttttcattgtagtgtcttggcggctagagcggattttaaattttctggtcagtcttcatactcaactggataagaacaaattttggaacatgcaaaggcagtcactctaattttagtttcaaggaaaagcctagcagtgatatatactgatttaccaggcattgtaaatcccattgtgaaagaattattttaaatacatctaaaccgtttttaataggcttgacttttccctgtaaatagagtaatttgaacctttattcttttatgaaccagagaaattagaaatagatgtaggcatttctacaatgatctatataaatatctgtgaatataaccattcatgcagttgatttggctttaaagaaaagggaggtaatcaccatggacttaaagtagtttaattacctcattatttatgacaaaaaggctttatataagcttttttttttttttttgttaaggacttgttcagttatcactgtttagttatcactggttttattgtatctaggcagcacaataaaattaattcacttcacactaatatatatttttgtgtgtacacacacacacacacacacacacacacgtatatccttacatatggccatttgtggtgcacagctcaggagacactattaacatagaatctaatataaatgacattccctttactgcttcaggaaaactgacactttatgtgggaatagtgcttcctggcattgtgtagtcagcatgagaccctgttaaatttgatactt

SEQ ID NO: 129759 - DNA, 1022 bp, Homo sapiens
ttagaatatggtaagattttttcagctgttgaagtggggaaggattgtgaatcaaacactatgtgtatgtgtattctcaaaaattaatgagaggtattgctgatgggaagacatagcatattttccagtttaacctgaaaatcctttttggaacattatgcacgggtagccagaaataactcaactttatgtcttgatacaagacatgcatcaggtatgatttctagagcttaaaatattcttggagtttaaaaactaatttgcataaaacactcttctgtgttttctactgagcactcttcagtaacttgcaggctcttaaaaacctttaatgataatcatgttatcaattgatgaagtcagttcagtttataatctaaagttataatgagcattgaaagagctgtagaatgtgaaatgctgtgaaggtctgtcttggtgactttcacaaactggcatctccaactctcccttcttggggcctttgtttgtttttctctctcacttcctgaagtatagatagatgttgcctgtaggtgttaccttaggtttagttcttttcctttttagagtttgttctcttctttggcaatcccacacagatccgtggtttcaactgctcattcccctcaccctctttgctcaggcttccacttgtgtatcatcagccttattttcattcccaagcttcagatttgccaatgttgttctccctgatcaacttagtagctgtcattttgtaatcttgaatcagtagattcagaattaaactttttttgcaagcctgattcttcttgcttgtttatattaatgacctttgcattttcttagtcatctagactcaaaatcaaaaggtcatccttggttcttctctctctccttttcttagaattttttttttttttgtcatcttactgcattgtggttcctgatttcttctatctttcttcagttcttccagcagccatatacacagcaagagacattaatctctaggtttgtcattcattgtgaatactgct

SEQ ID NO: 129760 - DNA, 1855 bp, Homo sapiens
gtaacgccgccgccagtgggggctcggggtcgtggggtgtgcgagtcccgcgtgctagggccgggcgggcgactgggatgcgcttggaggccagagggccagggggacggcagccgaagagtcgggggcagggggacttaagggcgggcaggtcgggggccaggaaactgaggcgctgcggggcaggttgggggaaggacgggccgggggcggaggacttgggaggtcggggagtcgaaaggggcccagcgaagcctggaggtcgggagccggggtccctggggccggggaggtcgggggcccgagggaggccggggcgccgcgtcctcggcccgtcctcggctcgtcctcggctctgacctgggcttggggaccagagtcccgaggctggcgtcttgagatgcccgcgggccccttagggccgttttggatccgcccagtgacttctgttttggttttggaggcagagaatccagtctacgtagactcggggaagtctcgggggctgggaggggactgagaggttatagcaggcgccaaggcctctttttgtgtttttgagcgtctactaccgttccggggaagtgcagtgcccgcgttttgcttggggaatttcagacaccggcatggggaggacccacgggcagaacccgagggagtaattttgcaaatccaagattttttggaacttctataattttgttttcgtgtgtcctctttttagaatcgagaaaccagagatatatttttaacattacaaatcagaagaatttgctacggaggaaaaaagtatgcttttagcagtgtttttcccctatttatttttttaattacaaaagtactgcttgctccttgagaaaaacatgaagcagccaaacaatgaggaaacctgccctctctcgcgcccttccccccatatttctccttcttactacccagggtagccagtctccaagtgtggtgggtagttattcaggattttttttttctgtgcatttaatgagtgtgctttagaaacaagattgggatcatatatagtacagtatatcgttttattagccaacaatgcatcatggatattcctccattttattacacacctcattattttaaaaaacattattactatgtattagagaatccaatctacgtaggcttggggaagccttttcttcattgttaaacatggtcgccaagttttcaataatcagtagctttgaaaagggctacaagccaatattttgaaacaatgtggcaaaactttcagaatgtctgcggccagacgacattactttcgtattaagcagattaatatgtttacgtattgcttaatggtagtttacatgaggctagatgactccataaaacataaagttgctgaattagtttactttttggttttttttatttcatttttttctaagtaaattttaattccatatggtcagttgaacacttgtaatttctttaacatgaagtagctaatatgtgaaggaaaggtaaggtaggaaagatagaaagctagtggccctagcctgagacaagaaaaaaaaagcaacagggattaaatattttggtaagtaagctatagggagtaaactggaagtggaggggtgatactacactgcctactattaagtaagacagaaagctaggaaattcccattgcatactgtatttctgtgtgcagaagagctggaggctttgttgatttaatcactagcttgtatttattaaaaatgtactgtgttcatcttggtgctagcttccagggaaagaacaactgaggaagataatcacgaacaacgtctggttctaaacatgcatagcctgaaattttaagccaaattgtgta

SEQ ID NO: 129761 - DNA, 1115 bp, Homo sapiens
aaaatttcaaaatctctgacagtaaatatatggacaataataagaaaataggatttgctttcaagagacttaaattggaaccaagaaagtagaacctttgccacagtatgttacattttcatttttaaaacatttcatgaatcataccccatcatctccatgtacaaatgtgccacagaaaagaatatttgcaagtgtattttctaagtcctagctgctaagtacatgtagataaatttaaataattattctcttgttccagaccaattttaacactgttttaacaagagagaaaatgagaaaagaaaacataataaatgatcttagtgataagttgaaaagtacaatgcagcaacaagaacgggataaaggtttgtactgttttgtactattttttttaattttttaaagtggaaaagatacattcatgcaaagtggtttttttaattacatgatacttttttaaatttgggtgtccttcagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacagtaagtatggctgttttcaactgtttttaaggctgttgcaattccatgagttataaagctctgaagagaggaaatatttttagcattactggttgtccacagcccatgtatctgaaagttgtgctattttaattctttaaactgtaagtgtgagaaaacattactgaatgaattattttggggtactctcatactatacaaagtatgtgcaccagaattatcccatactgccaagataaggatcatggcagtagtattgagccattcttatttacagggaatgttgacattttggggtccattacctataaaggggttattgtagtaatgaatatattcattttggtgaggaaaagcagggaagggttttttattattattattattattt

SEQ ID NO: 129762 - DNA, 4589 bp, Homo sapiens
ttttttttttttttttttttttcttgagacggagtctcgctctctcgcccaggctggagtgcaatggtgtgatactggctcactgcaaccttcacctcccatgttccagcagttctcctgcctcagcctcctgagtagctgggattacaggagcccaccaccatgccctgctaatttttgtatttttagtagagatgtggtttcaccatgttggccaggctggtctcgaactcctgacctcatgatccacccgcctaggcctcccaaagtgcttggattataggtgtgatccaccacgcccggccctaagtttttactttactgattatgacacaaacttcttaaaatacttctggtattaatttaaaaaggaatgataaggctcttgttatttttgacatattaaaatatttggtagcagttatctactagttcattaaaaaatcagaagtctaattgcattgcattctgtttcagggttcccttactttgtgactttgaacctctacaccagcatgtacttgctctacataatttggtaaaagcagcacaaagtttggatgaaatgtcacagaccattacagatctactgagtgaacaaaaggcaaattcaattctttcaaacagttttcgtcattagtgtaaaatgtttgtgttcctgcagctctttaagcctttctttctgttttccaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaaggtaagaattaagtttagtctgtaattataaaattaaaatatcagtgattcgtttgtgtgtaatcacagtaccttgatttactcatttaccttgggtaaatgtagcaactagggtattttcatgaagtaaaaacttactttttagtcagtgtttcttgcaaacagaaataacagactaaatccatgagtggcttttaaaaaatgaatcagcagtttggattttcagagaaattttttgttgaaagtttgaaatgttttaaagagctctttgtttttccttttttaattcataagtttctctcttgatttatttgcagtttttttctaaactcttcagtagaaaattacttatattctctttaaatttagtatatatattaaagactaaaattttgttctgtatattgtttactaaaggctaaatcataggaacatgtagagtgttccttattgttattttcttaatacagtttcagttatttcctctgtgcttgaaagatgtttttaaactgcaggtttgatactgtggttgtggattggtggtgtttttacatgtttattattgttactgtctgatattactgccttttgatcacagaagatggtttttagtatttttacttttaatctgggtttaattgggttttgtgacccagtaaacagtttctagaacataattaatatgtcaattcattctatcatgaattctccaagtgaatacatatatatttcaacctgtgtcttgccttatcacttttatacaatctcttgtgattgtctgctctataatactcatatattggtatactgttaaacctccccttttggcttaaaattagaagctctttaggtattctgggggagggggcattagagggtttaatagaggaattagggtttgcatgtatgtttaaaagctggatgagagaaggttaacagagtcactgccaaaggccaggagagcttgtcaaagagaatcagagatggacagtacttaaagcagtaaaaacagattatattcagacactattgcagtatggaaaatagacctcattatagaactaggctcaattctgaatacagcatgaacaagttgagatttatagctaaggagggtaggggtcagtggatggaaaattactaagaggaaacataaggaataaggggaattttggttaaattgatctaacaggattcttactgaaggcaggccagggcaataaaataccaagggtggggacgataatttgttcagatattgatggagagatactctctaaactgagttagcaagacacttgatacagctggacagcgtaggcccaagaagaatagatgtcaaggtcgaagcctagaggagcctgattgaagtttagttcaggagagcccttttcaagctcaaagtgaaataagaggaaaacagaggctgaagcacccatgaaagctgatggttctccatggctcactgggaagctgctacaagattcaagaatctcttcaaagcaccagtctgactcaatctgcatcacaaaatggatagttctcagttacttgccaggaagctactgtgaaactgcatctggctacagccacctctggagaataaacctgtgctgcttttctgccttccaaaaccttgcacatcttcttttcattggcaaactggaagctatacctgggattttgggaaatgttggatctctgtattgcagtgcatatgagatcataaaagaggagcaagggcaaagcctatggaatactagacagtccagcactttataccccatttaaaactcagcatttagacagataaatgtcttttgcccatattgagcttccaaataaagacacttaaaataggaaacagcagttggattgaagacaccacctgaagaaattcattaaaatccattgtttgtctccatgtcttctggacaggacacatacttaatgttgaataagaacatggtagaaacctccctcccctgtgtcgtga

SEQ ID NO: 129763 - DNA, 1051 bp, Homo sapiens
atgtactgcttagctgttgttgaggttgtaagaagaaaaatgttcataaaacactacagggaggtatgcaagttgaattctattttaactgtatatgaactttaacgaattggtgtatgtttatgtttaacataagctttcctcttctagtgggctggtgctttagtcaaagatggaaagagattatatgaagcagaaaaatcaaaaagggaatcctttgggaaattatttagtaagtgttcattaataattttaattacttttgtaaaggataaaagtttttataagcttggattttctgtagcatacttcatgtatatgctgttaattgccattgatatctaggaaatattccttttaaagtgtatagaattgaatccattgttaaattttaaacttgaagtactgtcaacttttaatttaccttttcaaaaaccagagataattttttgccttaaataaagctctaaaataaccatattgttaatttctttatacagggaagtcttttttaagaaatcgtctgtttaggggactggactcctggcccccttccttttgtgtatgtatttattttctaaccatgactaaattccatatgttttaaaaccttttttccagaagtagagacatttatcagaaacttgcagaaattgttgtggtttaaaaaaaatcaaaataaaagtgtttttggctttaaaagccagttagcataaagctttaagattgatatttgtattcataattttttataaagaatcttcataacacaggaagataccttatactgcactgttaggattggtagaaatagattcacttggtttttttgttttcttgtctcttcctttttttctttccacccttccctcttctttcttccactgctcttctccctccctcctcctttacagcctccacctcctccttgcccttctatatttcttttcacaccacccccctttatattttgacaaatcagaataataaagcctcagttagacttcactggaattaaacgttagtttgatatgtttctaaaccattgtta

SEQ ID NO: 129764 - DNA, 1632 bp, Homo sapiens
ttaggaacaagcatagtaagtcaataatagaaggtttcatggttgctacccaaatgtagatgttagtaaacagtcagaaacacagtttgagaatctgtgagactgatcagtgattgaagtagacttgggagttatctccagaaaagttatacttaatgctgaaatcatattgagaacagtaaaaatgggctaaggacaaaatccttctgaatcatctgttttagaaagattagacagagcaaaaggagccagaaaaggatgctgtgaaggaaccagtagaagtaacttcccagagcctttaaggttgggaaaaggttatctgccatgctaactgttgaagagcctcaagtgaagcaaggtcattggtagtttttggctgagcagtttttatggaaaacgcagacagaaaggctgccaggtaaaatatttttttaagggaccaggagcattatcggaaaattttataggttccatgaatttcagcaaatgtgtagaattagagccagggaacaggagagatggaagagtgagaaagcataattgagcaagccgattcgttgaggagatagaaatagagaataaggaagttttatcttctatctccaggagggagataaatttgccgaagaagtttatatgttttaaagagaagttgcattgataagagaattaatgatattatgctgacattgaaaatacctttttctgagagatattgacaagtgattaaattgtagcactgattgaaatgtgtgattcttgaaaatgtattcctaattatgtattctagtgtaaattcagtgttgtcaaggatatttatcctgtacttgaccttcttatgaaagtataacttagagttcccatgcttttgcttttttatatcttttatcacttattttctctcaagctgtatgtcagaatagcatgaaatacattttaaactatttgctgaaaattgtattcgtatgtgtttccttgtcatttagcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcaggtacctattttagacttttctcaggaaaaggaatttatagtttttttgtacacatgttttatatgcagtatcaatttggtgtgcaccatattttcactttttccttgaatatttttaatgtattaatattgtttccttgtaataaaacagaaaagcatgttcttaatgattgagtttcctatagataaaccatgaaactgctacttgaagctgggggcagaaatcaacattttttgatatgttgaaagcagatgatcatatcagttattgtgctaaaaatttcaatgcttcctactaccccccataggacgaaggataagaaatgaaattttttaagaataggagaatacgaaatcttgaagaatttactaatacttctaatagtaatacctaggttttagatctgatttaatgccataatcctagaactgttgaaaaagtggattttaaaccaaaggaaggtgatggaatggct

SEQ ID NO: 129765 - DNA, 1120 bp, Homo sapiens
accacactcggctaatttttgtacgtttagtagaactgggttttgccgtgttggccaggctggtctcaaactcctgacctcaaatgatttgctgccctccacctcccaaagtgctggcattacaggtgtgagccaccacgcccagccctagagtgatattttaatgggttaacgatagcctctctctgctaaactagacttttagtgaatagctagctcatagactagtttatgtatgtataatgttatggagaggtggtgagatttgtgtgtataataatatgtgatttcattcaaacatgctaattcctaattagagcagtctcatagttttactgacagatcttttgtattttaagtttaggaactgcagtttcagtaatggccaagattccactgttggagtgcctaaccagacatagttacagagaatgtttgggaagactggattctttacctgaacatgaagactcagaaaaagctgagatgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcagggtaagtaacgttaatttgatgtttgttttgtcattttactactttatattatttatcctaaatattttatgtactgagagaatgggtattaccttttagtagaaataaatgagtcttggagtgaaacttttaacataggttgaatcaatttaattcataattttatttatgaattgattgtaaatttgtgaaggttatttgagattaataggaaaaatttctagtgcaataagaataatttacatacagtaaactacacaggtcttgagtggttcatgcaagaaataaccaccacacaaattaagataatgaaaatttcattgcccagaaa

SEQ ID NO: 129766 - DNA, 1739 bp, Homo sapiens
taccccataaagaccatcttacttatttactttggtaactagataacttacagtagcttttttacagtttgcctggacaacttaaaaataatcattttacatccattctttcaggtgccttcccgttccaccttatgacattttctgtattatcagtcttcttaaagcttctatttgattacattcttcatgttaaagagttcttgaggaggtcttttctgagtaaagtccaattcctccttccttaccttagtatcttctgggtctttgatcatctggccctctttctctcgctttttcctccagaccatttgttcttaaccaatagtgcttcatatttcctgtctttgccacttcgtgttccactcttttgaagtacttctttccctatctttgttcatattcttttcatacctttatacttaagttaaatgccttcagttaactttgacttctcatttcctgtctcttttgtgacttttatatctgtctcataccagttaacaaaggtagaatgatctgtcttatttccttgccaactaaaatattttataacagtggacttctttatatatctccatatataaagcaatctacattgctgccttgtaatttatccttaataaatatttttgtacttcattgtttggaactgaatgtcagatgtctattttctgaaggtattttcactgcttaaatattttctagaatctcatttagggttactaaatctgttatagttatactaatctagaagtagatgacgtattttagctttgccttcaccaaaaattgtttttaacatgaatgtcttgagataataccagaggacagtgacatttgagatggcagatgttgatcattagtcaaataattgaaagccctactcctttgtttttcagaggtagcgtcttatggattcttcttttgactgtctcttaggatacctgctcggaaacacctcacttatgtttaggctgtcttttacagaagagaacagagataaactaaaacagtcctttgaaatactttgttaaatgtgctctacaacgcatccacacgtacatgtttgtaaacatatgcaaacttctgcaaacaaaccattgccttcttttactttcttttgtattctttttcaatataggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcagtatgtttgccattaaaatggataatatttgtttaaaatgcctttgaaatttatcagtaggtttaattactgcaaatttgtttcttataggccatatatttattgtaactgaggtttattctttgagccttttctgatagtgatttgtaggttatagtttttaatttaaaaaatgataattctctttacatgtatgagtctcccacatttctttctcttgggttgttttacttgtaataaggctccaaatacttttgaaatcatttataaaaccaagaatctttgcttatgtcttgtccactaaacaaaaggcaagatgtgaaaaataacatctaacagaaataggcacattatcaaacactggacaatggaggaaaattttaagttctttg

SEQ ID NO: 129767 - DNA, 1036 bp, Homo sapiens
attggaattattataaatagtgtgtgaaataataatctttgttgtaaaaattgaattatggattttttttccagaattagttttcattaaacttgattttacacttacatgaatgattttttggaagatagggataggaaggaatcttcacatgtgttagacttaatgtagtttctaaaacgtgtggagattttaacaaaaattatgtagcctgaggattttaatagacctgataaccagtttgagcatattcttttgctgttatttacctaagatcagccagttgttatggaatcctgttcattaaataggaagcttatatttttattactgtttttggggaaggttttagagtgaaattcattaacctctaaggtgtttttacatagtactacttggaaaataaagtcattgggcaaatataaacaactgatttattttatttcattttttgaagtgtggcagaccttaagcatgccattcaaagcaaatacaagattgctattcaacaccaggtgctggtggtcaatggaggagaatgcatggctgcagatcgaagagtgtgtacctacagtgctgggacggtaggtattcaagagtcctttcacacaagaatgcaacatctttacatcacattgggaactcagtgttcaaaagtaaggtttatttgcttcatatattgaaggcaatgtgcacgctcagtatttataacattttattttggttatttctccttttttaaaaaatataggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggtaagatataaacaattattttaactgattgtttctaaaagcattcggatctaaatagcacagtagtctaaattgcataggaagtatgcaaaaagtttgacaaataaactttaa

SEQ ID NO: 129768 - DNA, 1041 bp, Homo sapiens
cttgagggtggggatttcactggagtatgaatacagtaggtggatgtggtacagataattgctgctgtcttagaggctgtctgctgcaggtgccatttttattcctatttacaaaagaggaagccaaaacagttgtccaagatcatataattgcaagtaatggaccccaaaccaaacccaagctttctaactccactgcctggatacttctttaccataatattttaaggaatgaggaattgttgtggaaatggccgttttgaggaatttattggtgacttttgtttgatgccatggattgatgtgggttgaagtcatgtggttgttattatagtgaatgtgcaagtagaagggcctgagtagagattattcttagacggtagttttaaaaggaagaaaggaacaatagccatatgttgtttcgtactgaattgtttctctttataaccagaaatttttcttttccagttttctgagtttaaccagtaatgccattcagttgccaatctcaagcaaagcaaacataagccagttttaatctactttttaagaaaagtggtagtccttttcacagtgcctgacggtaagtcacagtttctacctgtatagcagagtttaatctattgcctttaaaataatgattctggaaatcttaattttaaaaccttatttgctttttccttctctaataattctctaaggcttatgtggaaagagcataagtaaaggtacctactactttctgggaatttatttatagttatcgttcaccagtttcattaatcttatggatcttttcctccatttgttgaaagtaaaatgctagaccatgaaatctgtcccctttttatgtcattattttaagttttttttctttctctttttcttttgagatagggcctttctctgttgcccaggctggagtgcagtggcacaatcgtagctcactgcagtcttgaactccttggctcaagccatcctcctgcctcagcctcccaagttgctaggaccacaggcatgcgccaccaagtgtgtctaatt

SEQ ID NO: 129769 - DNA, 1008 bp, Homo sapiens
tctgctcactataatattacccttcttttaatttttacaaaatcttggtttaaaaactaaatcattgttttaaatttgcattccgttaataatgaatgaggctgagcatcttttaatattattggctatttatattctttctataaattgcttattcatagcagttgtcaccttccaaattttaaaatttgatgtgtaggaactcttttctaggtgtcggtagttaataacagctaatgtctattgagagcttattctgtgtcaggcactgtcctaattactttaaatgtattccacatataattgtcccaggaactccatttagtggtcactaggacacgagaggttaagtaatttgccaaaatagctaggaagtggcagaccagggatttaaactcaggcaatatgatgcgtgcttttaaccatcatgctaatctgtctttgatgctgagaataataattgttaaaatttattaagtaatttttatgcattgccttatttaagcttcatgattacccagtaagttctattactatttttattgataaggaaaccaagactcggagataattccccagtaagtgaaaagattggaatttcactgagatctgccagctccaaagctgtcctcttaaccaccctgctatctcctttttttcttgtctcgatgcattttctcaggaaccttaagactggcattaaaaagggggaaacgtgaaaaggaaaaccaaagctaatatcaggggaagatttctttgcttaaaataccagctggatgtgttaagccctgtgtatttcctggctgcctggcaagggctgagtgagtgagggacggcatggaggagtggtgttcagtgtggattctgggagagtgtacagtgagatccaggtgtggcctgctgggtgtgataaacaccgaccagctattgaccaggtgttgggctgggcattagattttctttcgattatgtttatttatgaaagtaacagtctttttcatgtaaaaa

SEQ ID NO: 129770 - DNA, 1790 bp, Homo sapiens
tgcttagcattgaatttgtgtgtgtgtgtgtgtgtgtgtgtgtgtgtttctcacattgcaaataggaataatgtgaggagaaaaattttcaagtatagcccatttgaagagaggaagataactgaggtctttttttttcctttctgagacagagtctcacccaggctggagtgcagtggtgcaatctcagctcactgcaacctccgcctcctgggttcaaataattctgcctcagcctcctgagtagctaggattacaagtgtgcgtcactacccccagctaatttttgtatttttagtagagatggggtttcaccatgttggccaggctggtcttgaactcctgacctcgtaatccacctgcctcggcctcccaaagtgctgggattataggcatgagccaccttgcctggccgataactgaggtcttaaaaaaacccagcacattttaatctatatagtttgctgacttttttattgttgttaaaaagcctattatatacataatacaacactgtttatttgtatacctatgtaagatagaaaaatttacattatattgtgctatatattgttagcctcacaagaaagtctgaaggttaacattaacttcctaaatattggagctataagtgggcctttgctgggggtaattgcctctactgcccaaagtaatttatagatgcagtgctattcccattaaactaccattggcattcttttttattttaatataatttgatatgaagaattattaactaagtacacatttgccctttttgtatttttttgggaaattttttggtattgttatgtttttttgatagagatggggttttgccatgttgctcaggctagcctcaaattcctggctcaagagatccgcccaccctggcctcccaaaatgctaggattagcagcttgagccaccatgcccaaccactaattttgtttaaagtggaaaaaaaaaaatgactcttgagtgtcagaaaggtagtgagtgcagataccacccataaggtggggtgggtgatgtaaaataggtgggcaatggtaagagactggaatcattaaaatttgcatgcttggaggaggggctgagtacagctgaaatttagacatttgaggaggaggttttgcccagctgatattggtgtctctgaactccgaggaaaagcctcatggatttggaacccaggactctggggaggggagccagttggctagtgctgacatctttgaggaaatgtgatgaggcttgttctgctagagctggaaaaactgcaaactgaatttggctgctgctgtgggaaagaactgctgctgccgggttgaaggagtgttactggggtaatgctctcaggatcaggaagccaacaggaggaagtctgttcttccttccttgaagtcagcctctagctcctgttcttggcatagcctaacatggagccaactggtagaacagaaatgtggttttcagggtctcagccacagcatcacaaagccaagtgcagaaggcttggcttaataactggaacagacagcaaaggaaaccagggactagggtgtttacagtataaagtgacatgattttatagcagtttatgtactgatatcaatattaattaaaaagcaagttttacataacatccaaaaatagagaagacaaggcaaaagccatgcatgagaacattaaaaacaattagtgaactgaactatatacaaatcatacaaatgaagaaatgacacagataaaagcctttcagtaagttacagtaagtttagattgta

SEQ ID NO: 129771 - DNA, 1014 bp, Homo sapiens
agaacagctattcgcagaagtaacccattctaagaaattgcatacaaatactgactgaaaagacctagaatatttgggtcccttcacaggtatatcctacactggagatacagggtaagagtccaatgcttgctttaaatcctcacccaccaagcaacttactgttgataacctaaactcctctgtagattttctaacagagaaacaatgccttgctaaatgaaaagaatatttggtttaaaagcagttagatctctcatgaacaaataaattgattttctgatggtaaaacaagatttccattgttttggaggttttcaggtgcttgtctgtataagcctgaacaggcagctcctcaaagtttctatacctgcaaattaggatcccacaaagattgggctaaattatatggcattagaaagaaaggcttatattcactctttcctgggtaagaacttttcttgttgatttttgcctacattcatcatcaattattttctaaaattttttatattctgagtacctggaatctgtcttgttaagcattaggttcttaagaggccttaacctcttataaaagaacagatcaagcaaggaaaggggctcagtttgatagttactaacttctaaaaagcttagcatagtcaattgttaaacagatatgaaaaaaataaaatatttcttttagatgattacatatttctttgaaaatgtcaaggagagatgcttgtaaatgttattttacattaaaaggaaagggcactcaccaatttaccccatctgcttccacccaagcaaagcggtactcattgacccggagcatcagctgcaaacacccggccacgcactgcacatactgcgaactctgcacaagaagaagtgttgagtttttaaatgggaagcatttaaagtcatgcgatcagacacacatttctaaatgaaaagtcagattacctactggaattaccatctgagcatccaaaattccctaatctcttttcaaaagttaatcct

SEQ ID NO: 129772 - DNA, 1003 bp, Homo sapiens
tgtgttaagtagtcttgacttgtgtagatttaattcaggagacaaaatcttgttcatttctaagaggtagagattaaagcaaacatgaggattaacttttgaaaagagattagggaattttggatgctcagatggtaattccagtaggtaatctgacttttcatttagaaatgtgtgtctgatcgcatgactttaaatgcttcccatttaaaaactcaacacttcttcttgtgcagagttcgcagtatgtgcagtgcgtggccgggtgtttgcagctgatgctccgggtcaatgagtaccgctttgcttgggtggaagcagatggggtaaattggtgagtgccctttccttttaatgtaaaataacatttacaagcatctctccttgacattttcaaagaaatatgtaatcatctaaaagaaatattttatttttttcatatctgtttaacaattgactatgctaagctttttagaagttagtaactatcaaactgagcccctttccttgcttgatctgttcttttataagaggttaaggcctcttaagaacctaatgcttaacaagacagattccaggtactcagaatataaaaaattttagaaaataattgatgatgaatgtaggcaaaaatcaacaagaaaagttcttacccaggaaagagtgaatataagcctttctttctaatgccatataatttagcccaatctttgtgggatcctaatttgcaggtatagaaactttgaggagctgcctgttcaggcttatacagacaagcacctgaaaacctccaaaacaatggaaatcttgttttaccatcagaaaatcaatttatttgttcatgagagatctaactgcttttaaaccaaatattcttttcatttagcaaggcattgtttctctgttagaaaatctacagaggagtttaggttatcaacagtaagttgcttggtgggtgaggatttaaagcaagcattggactcttaccctgtatctccagtgt

SEQ ID NO: 129773 - DNA, 1172 bp, Homo sapiens
tatcttcatttagatattttatgactgttgactagaggatctcttttaatcagccaacttcaagagaattcttggggtatatatgtattttaattcctgaatattgataataatagtatattttacaattgtttagtgttttgtagaaattgatttcagtgtcatgacagtttttttttatttttcccagtggtagagatattatttttcttttcctttgctaacgagaaaacaattttcgagattaagtgatttgcccaacattatgtgacaaaacttctgattcttgttctagtttttactctgtccttctccctctctattcctcttttactttcttttctctatttcttttttaaaattatgtcataacttacataaaggaaaatgcacagatgttaaatgttcagcgagataaatgtatacctcataattcctcctactgccttcacctcaactcgcacaaaggttatcattattatgacatctattaccatagagtagtgttgtctgatcttgaactccatttaatggaatcatacagtataaattcttatgtgtctgagctctcttgcttaatattgtgtctatgaaattcattcattgcatttagcagtaattctttttcattgcaatgtagtatttcattatatgaatattactcattctcttattgatggatatttgggttgcttctagttttttgactcttgtgaataattttgctgtgaacattcttgtacatatcttttggcagatgtatacctttatgtctgcagcacctaattttagaatagaattgctgattaatgggatgtatgtaaatttagttttagtggatcttgcctgttttttcagtttgtgtgcccttcaacaaagcatgaaaattccatttgtttcagttctttactgacacttgatattgtcctgtgttttctaagtgtctatattgaagcaaaaatcacacatacacacatatacaatcaccttttagttttaaaagaaaaagaaaagtttaatagtcatgaaacatattaattacttttagaactttgatcagcatcttttcatttcacttaaaactgctttctgggacttattttagtcaattgtatgtttgaaaagttcatctttgtggttcactgataccaatgtgctgtgcattttcacca

SEQ ID NO: 129774 - DNA, 1680 bp, Homo sapiens
tttacagtacgcataggcaagagaacgattcatgagagagcccacatgtttccgtgtcctgttctctgtgatttgtgttgcagaagcagtctggaatgagtagttgctagatgaatgctgtgtcactagtagtgacttaagttgccaggtccttcttgcttgtttcatcttgcctcttgatttagtggagcaatccatgtccagtagaaatttctgtgatggtagaaatgctcacgatagctgtactgtccattgtggcagcccctaaccatatgtggttctggagcccttggaagtgttgccggtgtgagtgaggaagtaaattttcaattttatttagttttaaaaagagccttattgaaatatatttcacatgctataaaatgcatcattttgccattcagtgatttttaataaatttacagaattgtgcaaccattaccacagtctaacttcataacatttcaacatctcagaaaaacaaaccaaccaaccctgtacacattaacagtcttccccattcctgttcttgcctccaagccctggcaaccactaacctactttctgtcttgggatttgcctcttttggacattacatataactgaaatcatacatggtcttctgtgactggcttccttcacttagcataatgttttcaagattcatccgtgttttagtgtgcagtaacagtattttagattgagaggaaaaaggacttagttttttttttttctaagtagagatgggggtttcgccatgttggccaggctggtctcgaacgcctgacctcaggtaatctgcccacctcggcctcccaaagtgctgggattacagacgtgagccaccacacttggcctaggacttagtttttttttggcttttgaccagattccttaaattgttttctctggcagttctaatattcttgttaatgagagactagtttgtttttaatttaatgctgtgctgatgtaatacttgtcaccccttcagaagaggtggaagacttctttgctttagttctttactgctttgattataagtccatcaaaagtgctgattaagtagcagaaatcagtgggccacatcagttattcacatactgcaggcctgttattaaattgtagtctgctgtagctggtgagttgtgaagtttgtggggacctggagtaactcacaggcaattacagacagtccctgccctacgatggtccaacttatgatttttcaactttacagttgtgtgaaaagcatatacatttggtagaaatagtacatgaagtatccatatgaccattatgattttcactttcagcacagtattcagtaaattacacgagctgttcaacacttgattataaaatgggctttgtattgatttttggaaggattgcctggagatatattctgaaatgcaaaagaaaattaactggtaaagtatttaaatttaagactttcttttacatgtcattttcaaagtatagcactgataacaataataagctaacctaatactatgtatttatcagttatgttctcggaagttgcatacaaagcaataatttataaagaaaatcacttttttttagttatgctgacaattttttttctgtaataaagattcccactagtcatgtaattgaattactggattaagcacattagattgaaagcagtac

SEQ ID NO: 129775 - DNA, 1052 bp, Homo sapiens
agttatctgattaaactgtctaatatctgtctaatcaaaaggtgaacaaaagcgtcaaacatttgaaagaaattcagttacttttatttatttatttattttttgagacacagtctagctctatcccccaggctggagtgcagtggcacaatctcagctcactgcaacctctgcctcccaggttcaattaattctcctgcctcagcctcccgagtagctgggactacaagcgcccgccaccacacccagctaatttttgtatttttagtagagatgaggtttcaccaagttggccagaatggtgtcgatctcttgacctcgtgatccgcctgccttggcctcccaaagtgctgggattacaggcatgagccaccacgccaggccttctttccacatttttgtagagccaaaaggctctacataaatacataaataatctacataattaagattaattatggctccccaagttcctttcttggctaaagttacgttttccatttgggaatggctgaactttgctgtgctctaggaatagctcaggaactggaagtaagtttggacaagttaacgatgttcatgatgagagccagttgatagaaagttagggaaaacggagacagaaacagaagtgtgtctagcttcctttgttgaaagtatcactaggaaactaggaagtatctttagagggtagtttctgtaacctgcctgcaatagacccaagtgaagctctgtaggagccatttaatatccatattggttgctggtactcccataatctgaatgaatgtcacgggtatgtatgttccaagaccatagatggcagcaaaatccattttgaagctgggcttctcttggagcatgggttgaagtgtttgatgactcatatgttaggccagaaaatggctattagccttctgaagtggaatcagaacaaggtatagaactagatacgcgatcctggggccatggtgggctgaggaaatggtaggtaagaagcctcgtttctcaatcagaagcagatgtttacattgagaatctttattttgctt

SEQ ID NO: 129776 - DNA, 1794 bp, Homo sapiens
tagccgggcgtggtggtgcacacctgtagttccagctactcagcaggctgaggcagaaggatcacctgagcctgaggaggttgaggctgtagtgagctgtgatcgtgccactgcactccaccctgagtgacagtatgagactcttgtctcaaaaaacaaaaaaaaccccacaaaaacaaaacttcattctgggtaatgttagctttcaggtatagtggtaataaggctctgtagctgaattcataaaatgaaaattggtagggaagaatggatgccgtggcgtgctactagctttttgggcacttctaccttaaacttttcctcctaggaataacagatacattgtgcctctcaggtgactgtcacttctggaatgattgactatgcttgtaatgatgtgcaacaactgggaggaatatttctctcatcactagtggaagtaaatatttcaatgtctagaatagttttcattagaattgaactttttatagataaatgctcttcaagtattttctgcatctttttagtgcactcttttttatcacagagtgtttggctttaagttgtggactttaaattgtgcagtgcctctgctttgcgggtccttctgctgcaggggaactcttcagggtacccaggcttagcctggccttgcttcttagtctggctactgcttctgcttggctctcattgcactgtccctcttgctgtgggcaggcacttcttcatagccttctatcatgattaaaattcagactcttcgttttaaaaagtaacaattatttgtgatattacttgctactttgctcaattgtcatgcgatagtgctacatctagagtgtctcttttttctctgtcacaagtgtttttctctctcacaaaaagtaccacaatttcatgattctaatagaaataaactttcaaaagtccaagttagctgcaagtttagatgttttgttctttgaccttatagtggcctttgaagcctttttgggtagtttggagcgttgcacttgggttgtggggactcatgcctgtacttcatagatagtagttattgaatgatacaaagttaacatttcctttcagaaattcattattgcttttctcttgcactttcagcctctgactttctttaaattttctttggtcatttctatatgacatttgagattttgattgtcattataattcattagctttgctgtggataaccaagtcacatattgtaccttcctgacatcaggcacctatttttgaaagctttgctacagaatatagtgtggatagttcaatttaaggcagtcattttactggaaaaacaattcagtaagtaaatcttaagacttggaaatttgcactagctttacccatgaaatttacctggagcttagtagtcagtttattattgttccatttttagctacttactgattaatatattatctggaagaatgtaacgatatttagaacattttatgtcatccccttgctttttatttagtaggattaggaataaaattataggggaaaaattattacatagaattaggggaaaagtttgcttagctcccttttgtaagctgatacattaggataaaatcaaaacaaaactaaataatgagttatttatttcgtaatagaaactgcgtggtagcggtgttgctgttgaaacaggaacagtctcttcaagtgatgtaagtatattccttcactggcctaaacatccccaaaataaattattttgagtcatatacacttaaaattttgaaggtgtttactagttccccaact

SEQ ID NO: 129777 - DNA, 1008 bp, Homo sapiens
taataaacaaactggtcctgggtgccaccaggggcatttcaaactgcaaacagcatgttctagatcattattagctaacctgcttgtccttgtctggccaagtccctcccgtgcttccagctgcctctgggtgagcctggagctacctggtccagctgcgaaaggggtgagcctggagctacctggtccagctgtgaaaggacactgtcccacacggtggctcgttctcacaatttcacagtttcagggtgggattagttaggcctaacgaacctactggtcatgttggttgcttgcaggcctttctagctctatgtcttcgtggaggaagatagcctgcaggtgtaatgccttggaaaatgacaagttttctgttttgtcttcatgtttcctcagaacagggcaaaagataggacatgaatgatggctctgtggagtgttagtttcaggcttacagggttgaagtgtaggtatgaagaggtttggtgggattgatactcagaagaggagagaactgaaggtggacaggggaggaggattctggagatgaaaaggtagaagggaatgagattttgatgtgagggtgacctagaggaggaatgggaccaggagaaacaatattattaggttgttagattacaaatgaatgtctatttgaaattttttgaaagttgccatttagatttcaggtgactttattattttaatagattttagtttgaggcataagaaagacactgtattttgcttagatttactttttgtcttgttgcctgccttttttaggggagcctaattgccatttgtatttggatggagatattttagagtttcttgatcaaaatcttttttatgttaatagcatcaattttaactggtttggggctcggttttaaaaagcgtttttacaagagccaccattttattgagtttgtgagatatttcaaaaacaagctatttaaaacatgtaagaaacatgcttgtgaaagtgagatttaaaatttctaa

SEQ ID NO: 129778 - DNA, 1672 bp, Homo sapiens
tattgactcaaattctctgcttttcctaccatactggtggcttaaaggagctgacttgaatgaatcctgaagtgcccagagtcttacagggggctagcaggtctgttctgctgacacatcttttagacaaggaagggtctgtatttagagattaggatgggggtttgctatattgtatgattgagtccctgaggagtggagaagttgggaaggttgagctgtgtttcttctacctccagagatagtcttatcattttcaaattcagcagcatcaccaccggggaaagtgacagtgggatatcatcttcactggggatgacagggaagatgacaggaacatgatgctgaatttgaaaatggtaagactatctctggaggtagaagacagtggaaatgattgggagggagggaagatgggactctcgattgaatctctcacaggaaggagtttggaaatcaaaagcaagatttcagtgattgagtgctggggaggagccttgaagggcgaagagccagtgatgaagcgacccctggaagagatggaggaaaataggagagtgtggggtcaggatggagagttattttccagagaggaggaaaatcagttttgttttttttttttctgtctggagggaaagaatgtactagagaaaaatggtcgtagaaattcatataaagtggctttggacttgataaattagatagccatgtgaattgtttggcttgagagggggaataagggtgagacactgggtaatgctgagaggtgacattttactgagtgcctaccatttgccacatgctactaaccaccttatgtgaatttaattttatcctcagtacagccccttagaggcaatgcgattattgttcgcattttgcagataaattaactcaggttccagggagttcacactgtcttatttgtggagaaactaagcattgaatccaggtctgtctgatgccagggcccttgcgtcagcccttgtggtttgctgccaaggagagaagagaaggactgaaaattcctctatcgcttgcttacatattcaactcttactgaacaaaacatcttattcttactttctaggggacagatgatttctgctgaagattgtgagtttattcagaggtttgaaatgaaacgaagccctgaagagaagcaagagatgcttcaaactgaaggcagccaggtgatgaataaacattatataatgaacacttccccgtgtcatccaaaagtttagaaaaatcttagtgattataagtgacttccagttttcttgctaatttggaaagaacgttatattgagcatgtttaccttcatccttttctgtatttctgaatattttcttagaatatacacctggaagacaaatttctggaaaagaagttactgtttcagagtatgttaagttttaaaagttgcttaacttttctttttttaagagaattttttccacttggtattcttactagtaatgtttgaaatacctaatataattgaaaatgtttgaatttgctaagttaaaagggatatcactttgatgacatgggattacattattttcctgttgatttattaagtatttatatgtcctttgaaatttttttggcggtggcattctttttattttaatatataaggttttgttactttttgataaacag

SEQ ID NO: 129779 - DNA, 1544 bp, Homo sapiens
ctgtccctgaaggaactaaaactctagtagggaagtcagatgtattaatagatcattttaattcactatttttttttttttttgagacagagtctcactctgttgcccaggctggagtacagtggggcagtcttggctcactgcatcctccgcctcccgggttcaagcagttctccttcctcagcctcccgagtagctgggattacaggcacctgacaccttgcccgcctaatttttttgtatttttagtagagacagggtttcaacatgttggccaggctggtctcgaactcctgacctcgtgatctgcccctcttggcctcccaaagtgctgggattacaggcgtgagccaccgtgcccggctctaattcagtatgttaactgtggcaatagaaagatgcacagggtctggcaggtgcacataaaaaagacaagtaattctaccccttggaaattttcctgaaggggctggtccctgaactgagtttttgaggatgatgggtatttagccatgtggcaagtaggagcagccttgggaatagaacagataatgtgagcaaaggcagggaagcaaaaacagcacactgggtgggagtcatacatgttttggaggcaggcaatgcagagagctgaggctagagaggcagccaggggccgatcgtgaagatgctgtgtgtgggtgtgtggttggaaggagtttggacttgatcctatcagtcagtgcttttcaagctgatttttaagctgtgaagcccatgattgatatgaagttagcatgtaaaacagatgaaaatgatagaatggaggtgggagtgtgtgtcccagagccctctttttgagaccattcaccattttccaaggagctgtaggtgttggaaaccaatgaatcttgtagccgggagttagaagaccatatctgcctcttgattgaattgttctactagcagcatgaagggtgagtttgtaggtgataagtctagaggtagagagaagctatagcagtaaccaaggtattggaatagatagaattggttagattgagagagtcttagtgattgatttggtgtgtgggggtgaaagagaagtcttggatgacttctggattcctactttaaggaactgggttattgtggggccactgactgaaggacaggaggaggggagacttgctgatgttttctctgttcatcagtgtttgtgtaattgtttaaattccctgtgaaattaggattctgagctctgtttcctaatttctttagtccagagtgcatttagactagaggacagggagttttatgtttataaagcctggatctgtttatagcctacatagaataatattgttgatcataaagcactggtggactggccagagctccgcctaacgttggcatttggaatgtttgtagttacatggagcttttaaaattgctttatttctgttcttcgttacccatggtctatgacatgttgtgttttcccgttttcctatatatctgtcttttgttctgatgtccatctcacaaatttcttttgtaaaacc

SEQ ID NO: 129780 - DNA, 1028 bp, Homo sapiens
taatttgagtaattttcgaaaggacttagaatttttaatgtgccacttcaaaatgatgcttagtaaatgtttataaaactagccttatccgtactattcatattcttattgtttctctatgagaaaagttaaccacaattgtataaatttacaatttttcccatatttatacctattctatttaatcatgatttctgatttcagtatattaggtgattgctttaaaaatcttactgcagtgttagtgccaataatgaaaaaaatttttctagaaaagcaaaagcctaaagaactcttttatggagcagtggacaatatttgaaatataatgatactttcagacttaggacatttaatatttgagttgaatgcctggggagattaaagtgatcacgatattcataatcataatattaatagttgtaaaaaaaagaaacacctcgtattctgtttttaccttgcatcaaaattgaagatttgttgaaagacattcaagattacgaagtttagatgaccaaaatggatatccgaggtgctgtggatgctgctgtccccaccaatattattgctgccaaggctgcagaagttcgtgcaaacaaagtcaactggcaatcctatcttcagtaagtaccaatttgctgtgaatcatggacagtcatatgcttttgcatcagactttttcatggtcatgcttctatgagagaaatacagggaaaatactgaaaaatgtggaagaaacacttcctcttcagaataattagctgtcttagggagttaagtgtagtggggtggaaacagcttggcgccctagtggggaagcagagcggcttatggtgcttttgaccttctctggctgcctggggaagtacttttggaataagtgggaaacataggaggaatgtccttgggctaacggagggaggaaggggatgaggggcaaaacctgctagactggtctgatatgccctggcaatcagcatgggggcaggtggcctttttagagtggtgcatacaactaataagaagca

SEQ ID NO: 129781 - DNA, 1051 bp, Homo sapiens
ttaatatatagaaatagttagattctactctaaagctgagatgaaaatagtaaacctggaggcggagtagcaggactctcctgacctgggccaggaggacagcactgatgtgtgtgtccccaaggccttggacttatctcagtctcacctgtcatctcactcttattatctcagcctttagttccttactttgatgacagccagcttcagtgacagccggctttgctctctgacctccgtattctgaggactgctctccttaccatttgtgggcagatttaagtcaaagcataagagtgaggggatctagttatgcaacaacctgaaatttatcaaattctcactagagctaagtttttgccaaacacataagttgccttcggccccttgagtgactggttaggcagtgctgttcttttggcaaaatgaaatacttattaacaaaaacaccagaacatcataaccagaccacatagaataaatttggcttaaaggatgaaagagtactaagaagtataaaaaggataaaattatgcaaaatctagtaaagcgaaaaactcacccgagcatgttaaacaaatgtcataaactaaacaaaaggctttatttcttttctttatcttctagtgatctgtgttcaaaatcataaaggcatttatgaaaagtataaatactaacttaggtagataaaacatttgttaaaatctatcaagtctggtctgataattaggaggctacatatagcttatattttcttaattgaaacaggtcccctatgtgccattttacccaatacgttagtatggaggtttttgtcctgggtctctgtgtccaactgccttgttttgtcttactgaaaggttataaatgctatggttccctgcgaagagtccaaagcgcataaccactgaacatttcaagtctgaaatttcttcaattttagatctgtttgttcaacatatctactatttgacacttcacaccaagggggagggagatctaaaattcagtagatattttggtgcaaactgtagaaaactaaaacctcgag

SEQ ID NO: 129782 - DNA, 1035 bp, Homo sapiens
acctttgtaagcatcttactggctgtgtaatatttcatcagatggatatacttttactttatgtcattacttccctgttggatatttgtttttagtgttgtgctgttataaaattatactctttaaacatcctttgtatttttgtgtttttaattgccatcttagaaatagattagatatcaagtttctaggttacagacaatgctgcctaacttttagaaaggttgttggagttatatttgtcagactgagatattctcaatttttacatcttcttaatttgtaagagaatattgacatatgtttaaatttattcatttctgtgcttcttactgatgaaattgtttttgagatccttattcgaaataacttactgatgaatttttaaaatatttattagctatttataaaaaatataaggtgtgactttagaggattttcccacttatctgggatatattaaacaggaaagacaaagaaggacttaggaaaatgaagtttggaagtgcgtgctctgttgacattatttagcttatttgaacttgtttcagacttctattcattttattgtggtaccattatatttattaaatatatatctttatgtataacattatttgggttgggttttttaatagtactgcaaaaagtacatttaatttaattttgctgcaggtacaaacccgtagtgctgatgaaccaatgacaacatttgttgtctgtaatgaatgtggaaatcgatggaaggtatggactctcttggattcatattatatactcacttaaaatagaaagatttcttctggtcttttcataggtctgcctagatatctaaatatatacagatatgctcacactatacagtactcttgtactccctgactacttgtaatggaatataccatcttgttaccctactagaaataaagagtattaacttgactttaccacctttatttgttttggtgcaggaaatggggagtgaatcttaactgttcaattattatatcactgtcctatttatactatattcat

SEQ ID NO: 129783 - DNA, 1057 bp, Homo sapiens
aatttaagttgtgcaaaagggcatggaaagcacacacatataaatgtgaagacttctcagttagggggacctcagagcacacacagtcacctgagctcattatcccagaggaagcgtgttcttgctaagcaccgggaaagggctccaggagaggggtactgtgtgtgagtaggggcagggagcatctaggtggctgtgtaacatgagattgtcctggttgaggaaatggccttattaggaagggagctgttccagggttcagctttggcagtggcctcttctgcagagaagaagagcctgctgaggtagctcctgctgagctgggggaggagaggaaccctcacggccatgctgaatggtctcttctcagagaccctgtgggaactgtgtgaccagagagactttaggatccttagtagaattcggatttgggcaagtaaagcttgaataagttcaagctccttttcaaacatgtgctttctcatgttgagtacttgagttactttttgaaaccctgttgacttgcatactgctggcactaaacatttaggaaataaaacatgactaggccgggcgcggtggctcacgcctataatcccagcactttgagaggccgagacgggtggatcacctgaggtcaggagtttgagaccagcctggccaacatggtgaaaccccgtctctactaaaaatacaaaaattagccgggcatggtggcaggcgcttataatcgcagcagctactcgggaggctgaggtaggagaactgcttgaacccgggaggtggaggttgcagtgagctgaggtccagcctgggtgacagagtgagactccttctacccaccttcaaaacaaacaactactttacagtgtaaaagtaatatcactattattcgccaattacagctcaaggaattagatatagtaccttgtttttaacatactctaaattggaaacagttgtcgtgaattgcttagaaatttcaggtttgtttttttttttaagatggagtgtccctctgtcgcccaggctggagtgtagtgacctgatctcagct

SEQ ID NO: 129784 - DNA, 1061 bp, Homo sapiens
ttatatatgggagcttaatttaatttgaaagtatccagtcttaacatgtaacatttggatttaaagttttatatacaggaatatttgttattttatacgaattcatcctttttcttttctctcattctgcaccatggctagtttgacctgattttctccttactctgccctttctactttgatttcctgactgtctcttttattttttctgcctagtttatttccttctatcctcttgcatatttgtatagcagtcttctgagtgtgtctgtatatgtgattggcagattaactaaatgatttctttgcattgaagcctgagtcacaggagactagacagttctttctgtaactttctctactctgctggagcagccagaatttatggagttacgaaaaatgaattgcctgctagatcagttacttcctgtgcctgagggatcaggaatcatcagtgcaggagcactgtgggtatcaggtgaagcccagaaaagaagtctagcgggcagtgaagtgatcagattctaacgaactaaactgaacggtttctttatgtcaggcaaatggggtttaagaaataggaatgcagtttaattacctggtattagaattttcttttaatctgttacaataatttgacaattctttatgcctatttttagatgactacattgcaattggagctgatgaggaagaattaggatctcaaattgaagaagatatcctttgtgtgtatattcataattgttttttttaataagtaatatttattgaacatatgcaaatgccaggcacggttttacatgcagtagtccttccaatgaattaggtgctctcatcccattttacagagagaaaacagaagcagaagaggattggtcattgttctagatcacacagcctgacactgacagggctgggattccattgtagggaatttggctccaagcccatgaccttgaccaccacgctagactttttccttcatgttgaagctgaatgaactagaaacagcgaagtttaaaaggacctggctctttggaaactgaaacatataaatc

SEQ ID NO: 129785 - DNA, 1328 bp, Homo sapiens
tctcaactttgaagggttgttagaaagattgatgaatgtggatgctctaagcataattctaggcacgtaattatcacaggttaaattttacctgtattttgtgaagtgcattttaatgtctctgattatatgctggttcctggcaaaataaagccttttaaacctggataggtggtagtttttgtttggatatcctcataataatttgcagctggtgctctatgaagtaatccatgtagaggaatgtatagaaacaaagaaatgcatgtattagtcatgattgcttcagcctgacttatatacaacattatatattttatcctcgtttatcttcacttctcccttgtggaaagattgattgcatttttctagttaaccagacttattacagtagtgaattttatgcttctagatcttgatgataagaacattaatgagtctagtgtttgatctgaagatgtatgtatcttaatataatttgctattataaggatccaaaaattgaagttttgaaattctaaaatagaaacaggaatctgggaaagaaaagaatgtaggtgaaatactaatttgtttaaaataaaattggtatacataatttttttgttattgccttgcagtccacaagaatcggaatgtcagttaatgctattcgcaagcagagtacagatgaggaagttacatctttggcaaagtctctcatcaaatcctggaaaaaattattaggtatcattgatcttcccttacatatatttatgatgttgtgatttattcaaatagttaatggttacattttatggttagttaatggttacatttttttcttagtgaatctagatatactgaaagcagtgcctcgtaataaaggcgaggggagttaatttgatctttagggtttttttgccttttaggccagtcaaatttggctttcttaacttttgacacaactggataaactctttcagtaagaagaattttctcttaaaggaaaggttgtggataccttttgaaatggtttttgaaattttttgacttacagaaaacttgcaaggatgattaaaagaatgccgtatcctttatccatatcatcaatttttaatatttgccatatttgttttatcatattctctctttttctttctctatttgcacacacacaaattatttttttcggaaccatttgaaagtaggttgaatatatcatgctcttttaccctttaaatacttgcgtgtatttccttactacaatcttatttttttatggaatcatagtataagaaatataggaaatttaacattggtatagtattttatggtttatgttcagg

SEQ ID NO: 129786 - DNA, 1120 bp, Homo sapiens
agtcccttttcacatgaatagtttgcaaatattttctcctgttcagcagattgtctctttaccctgttgtttcctttgctgtgcagaagcttttttttttttttttttttttttgagacacagtttcactctgtggcccaggatggagtgcagtggtacgacgtgcgacctcagccttctggattcaagcaattctcttgccttagcctccccagtagctgggattacgggcgcctgccgccatgcccagctaatttttgtatttttagtagagacggggtttcaccatgttggccaggctggtctcaaactcctgacctcgggtgatccaccatccttggcctcctgaagtgctgggattacaggcatgagtgtattttaatgttccatcaagaatgaaatataaaaataaaactttgataaaagtcaaagtgttaaaaaggaaacttaatatagccaataacatgaatatcgttattttctggttgatgttttttattatccacaagtgctttctttgatatttctattatattaattcagaatttagggaaaggtggtgggggtgtgtgaacatgattgagaaaaaaagtcacgtttattttcattaatggctaactgaaattgaatatttctttcagttgtgaaaacactaaaccacagttgtattaccagtatttacgactaaaactaaaataattcacaaatgttttaacttcagtttacttacattgtaaaagtattgaaattgctcattattgttgctgttctaccttatgctaggtcttaatgttttaataaggaagggcttggcacagtggctcgtgcctgtaatcccaacaccttgggagatcgaggctagaggattgcttgagcccagcagttcaagaccagcctgggcaacatagcaagactctgtcttgataaaaaagaaaaaaatacacacacacaaattggggagcatgaacattactatcttacatttaaaaatattttgtaattttatattatataattggtttgcttcataatcctatgtattttatttaatccatttttaacggattctgagaagggctccataagcttcaccagactgctagaaggatccatggtgcaa

SEQ ID NO: 129787 - DNA, 1538 bp, Homo sapiens
tttgggcacttcagcaaccagacattaacatttcttttttttgttttgttttttgtttttttgagacggagtctcgctctgtcgcccaggctggagtgcagtggcgcgatctcggctcactgcaacctccacttcctgggttcaagcagctctctgcctcagtctcctgagtagctgggattacaggcacccgccaccacgcccagctaatttttgtatttttagtagagacagggtttcactatcttggttagggtggtcttgaactcctgacctcgtgatccatccacctcggcctcccaaagtgttgggattacaggtgtgagccactgcgcccggccttaacatttctgtagtcagttgtaatagtcacattacgtggcatagagcacaaatagctttacatgtgttgtggttaggtttagctgccaaatgagtttacctatgagaaatctagaaatcttttgcttttcaaaggtttttggtctggaaatttgcagataagggatcgaagacttcatttactcacaacaatgtcatacctgtagaaatgcttgtttaataatacgttttaagtcagtgttagatttcttttccaacaactttaatgttttactgtttctagatgactaaataggaagaatttatagaattttaagattaggagagatctttaaacagcaaataattaaacattacttataataacgtgtcataatttctgttgaacttaaatttttatttatgaggtattgggttgaattgaaatgatgtaactctttgttaccagaataaaagctaatggttttattctggaaggccaagcctaatgtctgtcacctttaaatgaaaaattacatgactagaagcctttacttgattttatatctaagaaataaagtgatactatgagagtctttgctcgctttttcctttggcgtgttgaatgagggacgtgctgtggttctttctgtttttttggggggatagcgtgtatttcattgatttgtagggtgcctgttttcatacttaaacattttagaaagcaggataggtacacatatcattggccagatggccattgtaatgttctttcacaggcagaatgctaaacctagcatcagaacttgtggaatgagtgtcattggcttggaaggaaatctgagagaggatttctttctctttgaatcctgaggaaccaaatgactgtgaagagcattggaggtgaaaagcagctgtgcacactactacaaagccagccctagagctcacggcattagcttttttgtggattcttctatgaaatgctttgtcacttgtgttcttaaacagctctttgtggggtaaaaacagatactgttgaatctgagtcaaaaagttctgaatgtgaagtacttttagtaacagccaattttgttttacttatatgtatgtttttacatatgtaaaaggtgacgtggtaaaaacttcaactctaaaataattctttcaataagcaaaagtagaaagaagttataatgccaggcatggtggctcac

SEQ ID NO: 129788 - DNA, 1015 bp, Homo sapiens
ctgtcatatatgtacaccatattcttaactataaatccctattactccctcctttttacatctccttgaggagagggatgttcgtatcctacatggtcttgagtatactgagcacatagtacaagtatcatggtttataaaatcacttgttttctattaccagataggagcaccaacaatgtaataaaatagtgtgatagctgtagtttatctttcagccagtagtgtgaactaaatttggctctggaaattaaagaagagtctttctttctcttgcatcatctgtaggagatgctacaatctcatagacttggacatgtattcttttcttttctttttttttaaatagaggtgggatctcattctgttatccaggctggtctcgaacccctgggctcaagtgatcctcctgccttaggcctcccagagtgctgggattacaggctgagccattgtgcctggcctaggcttgacatttagagctaggtgatgcttggggaaggctaaaatacagcttcttgtttggtgatactagtcatctgaattcacaaaggagtgctgccactggcgcactgctggggaaagggcagcagtataagggtcaggcgactagttcatgaccttactacccgtcagtatgaccttgggcaagtcacttttcttttctgggtttaagtttcttttttttgtgtgtagttaagggtttgaaatagatgattaaagatttctgtttgttttaaaattccctgatgtcagaaagggtttcagtcttgctcactgctgtatccccagtacagtagagcttggtacatttgacattactggagtagatcttaccttttctagttagtaatcatagaaccttgtgcaagtttcttgacatatttcctcatctgtaaaatggagataatacctgcttctatagggtttatggtgaaggtggaattaaatctatgtgaagtatttaacaatgccaagcacatagcagcactcaaagtttgttgtcaccgaatta

SEQ ID NO: 129789 - DNA, 2657 bp, Homo sapiens
gttgtatgtaattctttatgaaagacacagcatagttaatgctatggatttagcgcataattcagtttgaagaatggtagaagctctgctttgtcactcatacttagttgtcagtaattgttcacttactgagacttctcagtgtaggcaccatcgcttctaaacttccctgccccccagtgtcttatattgttccagtataggaagatgcagaactagatactggatgggagctgtcatttcagtgtacaataatcatgataggaaatgtcctgaaatttctgttggagcctcatttctcttttgtcttatttaattgtagtaaaaatgtgatttcgcctttatgcataccatagatttgattagtggcattttagtgggaatttaatttctgacttacataactacctacctattaaattactttattccaaacaggaaatgatggatgtcaagcaattcattgataaactcctacctccaattgattgacgtcactaagaggccttgtgtagaagtacaccagcatcattgtagtagagtgtaaaccttttcccatgcccagtcttcaaatttctaatgttttgcagtgttaaaatgttttgcaaatacatgccaataacacagatcaaataatatctcctcatgagaaatttatgatcttttaagtttctatacatgtattcttataagacgacccaggatctactatattagaatagatgaagcaggtagcttcttttttctcaaatgtaattcagcaaaataatacagtactgccaccagattttttattacatcatttgaaaattagcagtatgcttaatgaaaatttgttcaggtataaatgagcagttaagatataaacaatttatgcatgctgtgacttagtctatggatttattccaaaattgcttagtcaccatgcagtgtctgtatttttatatatgtgttcatatatacataatgattataatacataataagaatgaggtggtattacattattcctaataatagggataatgctgtttattgtcaagaaaaagtaaaatcgttctcttcaattaatggcccttttattttgggaccaggcttttattttccctgatattatttctatttaatactcttttctctcaagaaaaaaaaaaaagtttgttttttctttattgtccttcatagcaggccaagtattgcctctctgcaatagacagctactgtcaatacatgctgtaatttgacattctgggtcacagatataaggtatttaaaatctatttatgctttatagagaaaccagacattaaaacttcatgcactacttatttcgaattactgtaccttatccaaatttacacctagctattaggatcttcaacccaggtaacaggaataattctgtggtttcatttttctgtaaacaactgaaagaataattagatcatattctagtatgttctgaaatatctttaagactgatcttaaaaactaacttctaagatgatttcatcttctcatagtatagagtttactttgtacacgtttgaaaccaactactgtagaagatgaggaatctattgtaattttttgctttattttcatctgccagtggacttatttgaaattttcactttagtcaaattattttttgtattagtttttgatgcagacataaaaatagcaatcattttaaattgtcaaaatttccagattactggtaaaaattatttgaaaacaaacttatgggtaataaaggctagtcagaaccctataccataaagtgtagttaccatacagattaatatgtagcaaaaatgtatgcttgatatttctcaactgtgttaatttttctgctgtattccagctgaccaaaacaatattaagaatgcatctttataaatgggtgctaattgataatggaaataatttagtaatggactatacaggatgttaataatgaagccatatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgacttttctgtgactttgagtattttaatatttggaatgttaacatttggaatgaatgtctataatgcaatggaggaaaataacaatgtacttaaaagaatatatattcagagagagaaattttgatgatggtgtggttgacttagaatggaaccaggcataagaaataatctcatgttattcagttttaattggctaaaaaaaaatttcccaaatttggttttcaatgtttctacctatttaagaagttttatttggtgtttatcttttgtctttttcttaactctttttaaattttattttattttattttatttttgagacagagtcccattctgtcacccaggctggggtgcagtggtgcgatctcggctcactgcaacctctgcctcccaggttcaagtgattctcctgcctcagcctcctaagtagctgggattacaggagcccaccaccatgcccagctaatttttgtatttt

SEQ ID NO: 129790 - DNA, 1050 bp, Homo sapiens
agcaagactctgtctttgggggaaaaaaaaaaaaaaagatagctgaataaaacagcaactcaaaatactaaaacaaccaaccaaacaaacaaaaaaaagctgaaaatataaagatggattaaaatataatctgcttggctgggtgcagtggctcacgcctgtaatcccagcactttcggaggccaaggcaggtggatcacaaggtcaggagattgagaccatcctgggtaacacagtgaaaccctgtctctactaaaaaatacaaaaaaattagctgggcgtggtggcacgtgcctgtaatcccagctacttgggaggctgaggcaggagaattgcttgaacctgggaggcagaggttgcagtgagctgagatcacgccactgcactccagcctgggcaacagagcaagactccgtctcaaaaaaactaaacgaaacaaaaaaatgtatatataatctgcttcaaggaactcattcactgggaagatatatattataatatgaggcaaggtgatcatacatcctatagaagtcaaagggatgtggtgagtatatggatgaaggaattttatttttttggccaaatgtaacttctaatatgttatatatatgcatatttatgtacaattttaaatgcctggcatagtgtcctatacttttacaaaaataaaactatttcttcttttgctttttgcagggtcctatcggtggtgctaatagagatatttctattctccagtgccacggggattgtgaccctttggttcccctgatgtttggttctcttacggtggaaaaactaaaaacattggtgaatccagccaatgtgacctttaaaacctatgaaggtatgatgcacagttcgtgtcaacaggtaggtgtctagaagcagtgatcagcgccatatttgtaacttttttcatgtgatattttcaagaaaagtaacatttgaatgcttggggatttaaatgagttaattcatattgagtcataagttagcagtcattagatgagtgtgtattcaacttaattcaacaaatatttactgatt

SEQ ID NO: 129791 - DNA, 1982 bp, Homo sapiens
agccaagatcgcaccactatactccagcctgggcaacagagctgagactctgtctcaaaaataataataataatgatccagaataacaagttcatgtgggagtctgtatatttgatattcattcattacagtatatagaaaccaactcaatacctcaagcaaggagtaagcaatgagtctgtggcatcctatcaaggaaactgaggaggaaaatgaggcaaggcctcaggaagtagctagaaattgaaaagcagttgggccttgctcaccatctctcatctcttgtttctttgcttgtctgtttcatttacctttccataaacaattggccatcttggcttttgcagcctatagcttttccagctcttgaatttacatgttacaggtgtagccacacagagagtgactggtggtcatcgaatcccatttccacagtgccaggagaaaacatcactgcctgggatgtgaaaggctctcgtgtactcatgtgttgcagtaacccatgggcatggtcagagtgatggggcttctggatgctggcaggagtacagcttccagaatgtgggatgttgtgagctgggtaggcagatactctgaaggtgtctgctaaatagttattattatcttaaattctcatttagaaagtaataccaatttaagggccaggcacggtggctcacacctgtaatcccaacactttgggaggctgaggcgcgtggatcacctgaggtcgggagtttgagaccagcctaaccaacatggagaaaccccgtctctaccaaaaatacaaaattagccgggtgtggtggtgcatgcctgtaatcccagctactcgggaggctgaggcaggagaatcgcttgaactcaggaggcggaggttgtggtgagccaagattgcaccattactctccagcctgggcaacaagagtgaaactccatctcaaaaaaaaaaaaaaaagtaataccaatttaagagcagattggattttatgcctaaaattctgcaaaggagaaaatataaattcagaatattcgtaaggcatgttgtaagtgcagcagtttcccatggtacaaactatgtctcgtcggaaaggaagtctgtatgttctctggtgtagagaaccgcatcctttaggacacggtggggtgtgtttgtatttccgatatttgcctgatttgatttgacaccagccaccaagtttgatttttttatggatatcattagtaacaagatattccctaaattgctgtgggcaagcatgtgtgttccattgactttccctgcttgtcttttcagggaggagctttatctttatatactgcccttaccacacagcagaaactggcaggtgtcactgcactcagttgctggcttccacttcgggcttcctttccacaggtaacttggttgatgcactcaacatgagattactgagctaaaggtagctagtagatattgttggagataaagtcatcttatttttttttattaataaactttattttttggagaagttctaaattcacagcaaaactgagcagaaggtacagagttactatctacctcctgtccccacacatgcacagcctccccaccatcagcatccccacctccacagccatgtttttgctgcagtcagtaatgctgcactgacacatcaccatcaccaagtcctccacttacagcactcatccttttttaaaaataattttcttagacttttgtgatgtattactaggccttatttctgtacgctatactgtctgtattgtggagtacatagaatggaattagaaagaaaccttattgtcacaaatcttatattagaaggatttgatacattttaggatatatatgaaaattaggactttttttaacatatagaaatcatacttatttttagaccaggtgcggtggctcatgcctgtaatcccagcactttgggaggctgaggcgggtggattacctcaggtcaggagtt

SEQ ID NO: 129792 - DNA, 1178 bp, Homo sapiens
tagacactttaattagatgtgatttgcaaacatttttcccactatgtaagttgtcttttcattttcttcatagtgtcctttgaaacacaacagttaattttgatgatttctaatttatctatttttttcttgtcggttgtgcttttgatgttatatctaagaaattgccagatctgaggtcacaaagatgtatgtgtgttttcttctagttttatagttttatctcttacatttaggtatttggtcagtgtttacatatggtatgaggtagcagtccaacttctttgtattacatgtggatatccacttgtcccagctacttttgttaaaaagactattccttccctgttgatttgtttcagaaataagtttgacagtaaatgtgaggttttatttctggattttcggttgatttatatgtctgtctgtactctagtactagtctttctgaatgttacttggtaggaatttttgagattaagaagtgtgagtcctctaattttgttctttttcaagatttttgttgttgttgttattctgggtctcttgagtttccatacaaattttagatcgggttctaatatgtgcaaagtcaggtggtattctgttaaagattgcattgactccatagatcaatttgagagtactgccgtctttaaaatattatatctcccagtccatgaaagtgggatatccttccatttatatagattttcttgtatttcttaatatgttttatagttttcagaaaaaagtctttaacatagctatttacacatatacacatgtgcatatacacaaaactcctatataatatcctggttatagttaatgttatgtaagtattgcagttaatactgttgttactaatctttttatatgtctttaacactttgggggaagtgggttgaaatagaaaaatagttaatagaaaagtatttaacagggggctgggcatggtggctcacgcctgtaattccagcactttgggaggctgaggcagacggatcatgaggtcaggagatcaagaccatcctggctaacacagtaaaaccccgtctctactaaaaatacaaaaaaaaaatttagctggtgtggtggcgggcgcctactcgggaggctgaggcaggagaatggtgtgagcccgggaggtggggcttgcagtgagccgagatcgc

SEQ ID NO: 129793 - DNA, 1027 bp, Homo sapiens
aatgttttattgtattaataacaattctaaaattcatgttaaatttaaatttttggccaggcacagtggcttacgcctgtaatcccaacactttgggaggccaaggcaggcggatcacttgaggtcaggagtttgagaccagtctggccaacatggtgaaaccttgtctctactaaaaataaaaaaattagttgggtatggtggcacaggcctgtagtcccagctactcgagaggctgaggcaggagaatcacttttactcaggaggcggaggttgcagtgaaccgagatcaccccactgcactccagcctgggcaacagagagaggctccatctcaagaaacgtaataaataaataaatatatttacattttttattctgtttctatagtcaccatcaatttacatatttctcaatatacttcgtaagtgtaaacataaaggaatacggctgtcatctgccttggccagccatgatataggtcaagcttttattatatgtagtaatgttttgaggaacataattgaagctttattttattttggactctaataaataggtggaagattgttattactattttttgagacagagtcttgctttgttgcccaggctggagtgcagtggcatagtacgctcgtggctcagtacaactcccacctcagtctcccgagtagcttggactacaggtacgtgccaccacacttggctactttttgtagagacagggttttgccattgttgcccaggctggtcttgaactcctaaggtcaagtgatccacccacctcagcctcccaaagtggtgggattacaggtgtgagccaccacgcccagcctgaagattattttataagtgtgattttttttaagtggctgtgtagtcccaaaactataattagctgaaataatactgtaatgtttaaaacttatttagttatccctgaggtcatcagcacaaatcctgaaatagaaaatatagtaacgatatacttagaaattgaaatagaaatagaaaaagcttacag

SEQ ID NO: 129794 - DNA, 1131 bp, Homo sapiens
tggttgcccctcgcgcggggtgggcgttgcgggcgcgtggcggcctgcggacgaggacgctcctcccggcccgggtggggtgcgaatggtccgcgcggccgggtccgcggggggcgggggcagccggggggtcacagccggcgcgagggccagtccccagctcctccctgcattgcggaggaagtgtggccccgggacccccgcgggccggcctagggcacggcgtcagcctctgcagcgtgtttctgcctggtgtgtgggtgagggaaacctaagtccgccaggaaatcgccttattgtcacctcgcactcttatcctcaatgaaagaagtttgaagattgagtgtcctacaaggtcagacgtactgttttttagaaaactcgtgtatgaaaagtcaaacttatttttgcctccggaagcttgcttttgcagtggaaaaattctacaggatatgtgagatgttcctgatttcacttgaaagagataaactgtttttcttagaatgtgatcatttgcactcaatgtctaactgggacctctcagtgctaccccccccccattcattatctcaggaaataaagggagaagttgatcagaatttttgccatttaaaagaggtcgataaagattaagtcgccgaagatagtgttgtgtaattctctcgtaggtttcgttccgttttccaccttaagcaaagctagtgtgtaacaatcctgtgtgggcttatttaggcattgcttattaattttcctcttctcttataggtgattttcctgcatggattgggagatactgggtaggtaccattattattaatagtaacagtaatgaaactgggtcatgcaacttttgtttacgcgttcaaaggtttaatgtttaagggcgctaaaatggtattttaagattgccagttaatgtatcttacagtgcggtgattttatgttttgaaaaccctcagaattttccccttatcatcgtgagtttattgattttttaactctggtttctggaacatattaaaatttcaaattcctcattagttgctttgggtattggataccagagatccgtggaatgttagtagggacggtgtgcaattgagagctttccagagcagttaaaatttcaga

SEQ ID NO: 129795 - DNA, 1050 bp, Homo sapiens
acattttctagtgttgactattctaggaaaaattggaggttttttttttttcagcttagaggctataataaagtcaatagtgaatgcaaagtgaaatttctattgtctttttttccctagtgaggccaacttctccaaagctcagattttgtcagattttctgttcttccacctgctccagcctgcatattcccctgtttaacctcctgctggcctcttgcttacttagggataaggaagattagtttttaatctatgtttgacagcataatgttgtggttaagaatacagatactgtgactaaactccctggattagaatacttgctttgtgaccttgggcaatgcaacctctgtgcgttggtatttccatctatgaagtcggtatttccgtctatgaaagtcggtatttccgatctatgaaagttggtatttccatttatgaagtcggtatttccatctatgaagtcggtatttccatctatgaagtcgggatagcaataatcctatcataaggttgttatgaggattaagcagcctactattaatgaagtcaggaatgaatgcttagtaggtgtacataaaatggaaatgtagtcagtcttacttacacggattgaaaattagtaaaacaaggtagcctaaataaaatgttaaaaaaaaagtgataggacctcaaagcagagatatttaaaataggaattatagtcgtcccttaggattggttccatgaccgcctcctctcactacaatccagatgatcaagtctctaagatggcctagtatttgcatataacctgccacatcctcccatatactttaaatcatctctagattacttataacatgtaatattaggttggtgcacaagtaattgtggcttttgccattgaaagtaatgtaaatactatataaatagttgttatactgtatttaaaaaagaattgttttcttattgttgtattgattttttttttttttttgagatggagtcttgctctgtctcccagactggagtgcagtggtgtgatctcagctcactgcagcctct

SEQ ID NO: 129796 - DNA, 1052 bp, Homo sapiens
tcattttagtaaaattggttttccagatacaggtatggttgctcatgcctgtaatcccagcactttgggaggcccaggtgggtggatcacctgaggtcaagagttccagaccagcctgaccaacatggtcaaaccccgtctctactaaaaatacaaaatgatccgggcgtggcggcatgtgcctctaatcccagctacttgggaggctgaggcaggagaattgcttgaacccatgaggcagaggttgcagtgagccgagatggtgccattgtactccagtctgggcaacaagagtgaaactgcgtctcaaaaaaaaaataataaaaattaataatcaagagaaactctgtaacatctctatggtacagagttacatctctatgttagagttacatctctaggtatgtctatgagctaatatttgcatctcactttttaaatttaaattttcttttagacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagagaaactgagtctgtgtgggttctgtctcaaagatacaaactccctgatagtctatggaaggaaaatgacaactatttta

SEQ ID NO: 129797 - DNA, 1032 bp, Homo sapiens
gcccatatgtttattttattttattttactttattttgagatggagtctcgctctgtcgcccaggctggagtgcagtggcacaatctcagcttactgcaagctctgcctcccaggttcacgccattctcctgcctcagcctcccgagtagctgtgactacaggcacccgccaccacgcccggctaattttttgtatttttagtagagacggggtttcaccatgttagccaggatggtcttgatctcctgacctcgtgatctgcctgccttggccttccaaagtgctgggattacaggtgtgaaccaccacgcccggcccctaaaaagcccatatgttttcttaaaatcattttcaggtaagctttttccatgggttttcgtgatgatataacatactcagaacccataggcaagttcattttaaaaaaagatgacctcttacaaatggttctatttctttctctggctatttggtgtcaagatgacaagtggctgggaggtgtggggtctgtgtaggaagtctcccacatggccacactgagaatgtttattgtagaaagggaacttttgccctgtgaagtcacctcctccgagtcaccagtagctttctgatattctatcacaggaaattcctggtggtccacaaaagcagtcttctgagtgcagctgcagagagagacagaaaataattgccgaatttgacagtaaggtctggggatctgtgttcaggggtggctagcacctgggctgtgtgagctgcaaactgggaggctctttgaacaatgtcagaataatccaaggaacaaaggtcaactgacctctcattgtaatgcatgtaatgcagagaaaaaggtactggaggatgtcttttgtgtttcaacaaggtagctagaaattatatttagatttggttgttttgaagctgtagtaactaaacaccaccctgccccatcttacctagcacttaatattcattatcaaaacgtcagcttaaaagtttggatatggcagtggcatgcttgaagtatcaga

SEQ ID NO: 129798 - DNA, 1024 bp, Homo sapiens
agagacaggcattgattaggtggcccctaacactgggggtcaatctgtccaggtttagagggttgctttgctgtgatgccacctgcagagttgggacaatgcttaggaaagctgagacctgcaaccctaaactggacagaacctacacagataagctttgggaagatctttaacctgactcccttcatacctgcaagaagccactgtaagattaggaaatgtaattacatctgataaagtgattgccaagacattgtttgaagagagggctttatcagccctattgtatgaagattaatagagatctggatcttctagccactggtcttgcgcctccaacagaatgaaatctgattatattagaatgtttacatagtagctccatcttccttagactttcaacactttataatttattccctttgttacacactagcctgggagcccacaaataacctccagtagcgtgggacccatccccagggctcgactggtgatgtattgactggcttcacattctccattgcttgctctgtgctcctccctgaagcatgtgccttgcaaagcactgacttcattacattacaattctgtttctctgcctctctccccactggactggaagacccttgaaagacaggcacttgcttattttgtgttcctggagcctagcatggattttgtcttctaagagtcagcccccacatacctgatcagagaaacctgggcttttcccactggggaatactggaaaggtgggtgagggttgagcagatcagaggaatccatgagaccccaggaggctggattgactatttactaaaaccctggaggggaggaagaggacaggcaggtggggcggggcagagcagaggagaacattctcacagctgaaagatgttcactcctgtgctgaactggaagggagcatctcatccaaacttcttatttcatcaatggggaaacagagcttgaacaaggtcacacagaaagattacatcacgaggaacgttccatgtgacat

SEQ ID NO: 129799 - DNA, 1059 bp, Homo sapiens
gcttataaatgacagagccaagatttgaatgtttgaaaacagaataccataggtgctaaaaaaatacctgtaaaatacattttctgcaatctatctaaggcaaatctgatctaaggcaaatcagaggagaaaggtataatcaagaaacattaaaaatatatatacttccagccggacgtgatggctcatgcctgtaatcccaacactttgggaggccgaggcaggcggattacctgaggtcaggagttcgagaccagcctggccaacatggcgaaaccctatctctactaaaaattcaaaaattagcagcgactggtggcagatgcctgtaatcccagctacttgggaggctgaggcagggagaattgcttgaacccgggaggcagaggttgcagtgagacgagattacgccactgcactccagtctgggcaacagagggagactgatctcaaaatatatatacttccttagttttttcagttctgtttcaccaaagaaggtgttaaagagtggattgtctgagggaagtacctggaacttatcagggaaataagctaatggtggctttccttgagattgaagcttacctactctagatttgccagtgaccattagcaacgcaaggttaaccctccctcaacttttccctgagaaaaacgaattctcctgtttcccccttcatgtagctgttatttaaagtagaatgccttgttttactttcaaatgaaaagaaccgtagtctatggcagagacatttaaacttttgcatgtgacccacagttgaaatctgtcttctatatgacccttataaacataaacaaacacacagttgaaatcacagtttcataagacacaatctgtctttatccaatccaatatatttttattttatagtaaaataattctgtttataactctaaattgattgcaggatccatggattgaaaactcaagttaggaaccttaacttcaggttctcacagacaagttttagagctgtgcccccaaacacacatctccagagctatcccctccactttcatatctactggctgttt

SEQ ID NO: 129800 - DNA, 1040 bp, Homo sapiens
cctcctgagtagctgggattacaggcgcctgccaccacgcccagctaatttttgtatttttagtagagagagggtttggccatgttggccaaactggtctcaaactcctggcctcaggtgatctgccctcctgggcctcccaaagtgctgggattacaggtgtgagccaccgtgactggctttcttttgattttttcaaccattaaaaaatataagaactattcctgtcttgtgggtgatacaatgatcaataggtgaccagatctggcctgtggatcttagtgtgcttacccttggcctggggtatagaacagctgggccaatgatattgtaactattagttgctggataatcacgatgctggccccatcaaaggcagcgtgtagtgactggaaagagacgactgcctggggagatgtttccagggtggagttgataggatttgggtgagagctttgaagaaggtggagtcatggagaattctaatttgggaaactggatggataattaaagcagaattaaccaaaattagaaggagaaattgaacaaggagggagatttggggggagactaataaggtcagatttgggtgtgttaggtttgacgtgactgtaggacaatcatgtggacatgctcaaaggcagctggaggtagaacatgctcaggaacatgggtcacacggggccgggtgagagcaggctggagatactgatgtgagagtcaaaagcatgtcaagtgtaggtgaagccagaaattgcaaacatataaatactgggtttaattaaacctaaaacattttatgtactttctaagaagtaataatgatggaatatgacacactatcacttccaagacacggagacaatcatgcacaacccagctttattcttctgtctagagacactcctggccaggtgcagtgcctcacacctgcaatctcagcactttgggatgctgaggtgggaggattgcttgagaccaggaatttgagaccagcctgggcaacatagtgagatcctgtctctacaaaaaatttttaa

SEQ ID NO: 129801 - DNA, 1068 bp, Homo sapiens
caccacctatagtgatatcactctgtagtgacaccaccttacagtgacacccctctacagtgacagtgctgctccacagtgacattgcactacagtgacaccacctacagtgataccactccacactgacaacactccacagtgacactgctctgcagtgacactaccctacagtgacaccactctgcagtgaaacaactctataatgacacccctctgcagtgagctgctctatggtgacactgctttacaatgacaccactctacagtgacaccagtctacagtgacatagtctacagtgacactgctctacagtgacactcctttacagtgccatggcggtgcactgatgccactctgcagtgaagccactctatggtgacactcctctacagtaacatcactctgcagtgacatcactctacagcgacactactctacagcagcactgctctacagtgacatcaatctacagtgacactgctctacagtgagaacattccaccgtgacatcactctatagtaacattgctgtacagtggcactgctgtacagtgacactgctccacagtgacaccaccttacagaaacgccactctacagtgacactgctccacagtgacaccaccttacagaaatgcaactctacagtgacaccactctacagtcacagcactctgcagtgataccagcctacagacactgctctacagtgacacagctctacagcaacatcactctacagtgacagtgctctgcagtgacagcgttccacagtgacatcactctgcagtaacatcactctacagtgacagtgctctacagtggcaatgttccacagtggcatcactctgcagtaacatcactctacagtggcattgctctacagtgacaccaccttacagaaacaccactctacagtgacaccatgtatagaaggaagcatattatgtcattccttcctctattctatttcttacttctgcttttttctaataatttcctctatacgatcctgaactcgttgaactatgtgtctattttctttctattcactgctacctcac

SEQ ID NO: 129802 - DNA, 1049 bp, Homo sapiens
cccggcccctcctccgggtccctcctcctccctcgcccctcccgagccagggtgggagcgacggcagctggaagagaagggatgaggtcatcctctccctcggagtcagctggtggaggagaggaagcgggaggagggagcgcgcgcgaggggaggagaggaatgtgcaggtccgaggagcgccgcggcggccgctgctgctcctgctgctggcggcggcggcggctcgggcggcagcagcgaagccgggacggcgaggagcgcgggcggcgggcaggggcgcgcgcggggcgccgcgagcagcttggctccgcgcaggcagccaggcggcgctcctgccggccccaggcgcgccgctagcccggcccagcgcccagcccggcgggcggcgggcggcggcggacggcaggcgagccgacgcaggagcaggaggagggggagccgcaccgcctgggagggaagccggggcgaggcgaggaggtggcgggaggaggagacagcggggaaaggtgtcagataaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggt

SEQ ID NO: 129803 - DNA, 1102 bp, Homo sapiens
cttgtcatgcttgctattccagaaggcactgattgtgtcccatgttcaaataagttgggaaaatgacagattaaacaaagttaaacagctctctctacagcaggacttctcagagccttttataagctaaggtacagttatcagttaagtttttaaagtcacatctattaaacattcttataatgatgcatgcaaagcacttggataaatatgccattcttaaaactggccaaacaaaaataataacaattttattggcactttaaaaatatacaaatgtttttttctactttttatgtcatctacattttaaaataacctaaaagaaaattattagtatctgtatatgtgagacaactgtctcagagaggttaagtaagcggcttaacctcttaatagggtcacccaactattatgtagtgtagttaggattaaaaacggggcccattttaccatacagtctatgctttttctggctgaactggctacctccaaatgccaacttggataatgatgacaacaatgtataaaaataacaatttaccttcactgtggatggcaaagtgggaaagggagctgcagtttagatggattaggggatctttccaataacacactggtagttaaacagtaaaacagagacttgagcttagctctttgaactcccagttcattgcctaacttactataccatttggacatactgaggttgttttattaaatcccagctaaggaacatgatctcgtagtagttttaatgattacatggcataatgtatgtgaatatgtgaaaagttaattacaaatgataaagaggttctagagataaagaatgggtagaaaaactaaggaggatataggttacacctttgactattaaaaaaggtggtcttcaattctgagttagtcctgaattctgatatagattaggcaagattggtgccatttgctgagtttatcaaatggttattttctgcatatatgtgtttcctctctatacatataaattaattagtcattcaacacacactgagcacctgctatgtgcaaggcactgtgcttgttactaattattccaagatgaataacatatatatatttc

SEQ ID NO: 129804 - DNA, 1115 bp, Homo sapiens
gggagagaaggacagcagatgagaagggggtttggggccaaactaaccagcaacttgggcgctctcttaaggaatccgaagttgactgtgttggggaatgcgcagcaatgagtgtcaggggaggctcacaggccacactcagacatgtattttcaaacagtttccttttcaaagtgggaaagaatcaattgcagtttgaaagtactggagaaagaagtttcctgtactcttcagaggtggggaaaaggaagtgtgagtgaggggtggacttgaaaaatcttctgagctttaaaaggctccataatgagtggagtgaaagcatttaagtgggcttggctgagttcttactaaagattctggtagtgctggttaagaactctacttaatgaattattggaaaaggcataaacataaacagagttgggagcatgttaaataaagatgctctgtaaatgcaggctgggcaattaaaaaagatttaccagagtaaagcttaatacagtatagtggataattaatgagcctgtgacaactcagtaataactaccctgaacttttacaatggtgcatgaacatgtgtgcaagtcagaaggagggtttgttttcacagtcagctccagttagctaggaaatttctcgacagaagttaattagggattcctggtaatggagcctgctgcttaaccaacctcctgtgccaaaggtaactgactttgccattcattcatgggtttcttgttgagcctaaagggagtttggttgtaaatttgattctcccttttctcagttccctaagctctcactgtagcacatgttttgagtttaagtagggcttacctttcttactttaagaaatgaacttctgtttgttttataggcgggtgaactccaccctggaaagacctctgttggtgagctataggtgcctgactggtccaggaaattcaaattattaggatgtggtgaattctctgtctttgatactttgggaacatgggttagaaactgctcagtaaatattcttaagaaaatggtacttttgagacccctgtcaccttttatttcagtatatcttcatttgggaagttttcggtttacagaagaattgaatggaa

SEQ ID NO: 129805 - DNA, 1014 bp, Homo sapiens
tgttgttccattttactaagaggttgaaagagaagttaaggggcctgcccactatcatataattaacagggaatgctaattttccaatccatgtgtatagttgtccccccttatccacaaggaatacacttgaagaccccttgaaagtgtggatagtaccaaaccgtatatatactgtttttccctatatgtacatacctatgataaagtttaaattagccactgtaagagattaacaataataactaaaaattaaataaaacatttataacaatatactgtaataaaagttgtgaatgtgatctctctctgtggctctcaaaatatcttactgtactgtaccacaggtaagtgaaaccatgtacagtgaaaccgaagatatggagagactactgtgcctgactccagggccatattattaacctctgcactagaatcccgtgtcagaaattgagctcgtcagaccattaacttcaaggtggtgtggctgctgggtcctaacgtacttgcctggtgaggagttcctaagtgggaaagcctgggtgtaaaggaggagtggtgcatccaggatgttctcagaatagaattctactaaaaggaatgggcgtccgaggcccaggatcaggtgagttactcaaaccagggtgtcccatctgtgctcagctccctgtgccatgtgatggggggccattctccgatttgtgaggacagctggaagcacatgatcatcaggtaagcttagtcctggctagggtgggttgagccagtgggtgacaagtgactatgtgaccaggttggtccttgaaagatgactgaggtttggacacctttgcggggtggagatgagaggaaagagagagaaatgcatttttgcctgagcaaaaaggggccttgtttgtcttgttcatttcatttatctaaattcatgttcaagaaaaatacgaacaattaatggaaaacagccacaaacttatggaaaagcagatagtggaatacacaagaaatttttaagag

SEQ ID NO: 129806 - DNA, 1050 bp, Homo sapiens
ctggctgtggattcgtgggcccatcctgcgttatgcttgaggcaggacctcagcttggtgatgaagggcgccttgcccatcaactgtggcctatttttagaagagtaatctctgtcaactaagaaaataaaactaggatcattaggctgtctgagagacctttcagatgaactgtagatgttcatttgtccatttttattgtgttgtgacaagcattttttaataaacagttttattgaaatataactcacataccacacaattcaccaatttaaagtgtacatttcagtacttttagtatgtccactgcgtgtgaaaacatcaccacaatcaattttgtaacacttttgtaccccacagaagaaactctgtacccattagcaatcagtccccattcccctcccacccacgccttcccagccctaagcaaccactaatctttctatttctataaattgtgcggcaaacattttattttaaactccgcactgggaccgccctgcctagcagcctggctgtcgcaggaccgcctccctcctcctctgcctccagccccctctccagacgcatctcctggaggtattcttcttctcttcccctgtgtcctgtccctcccgtgcccctcaactgtggccgctctggcatcgctgtgggccacagtggggaggtcggatttctcctctgccctcctcctcctcaccttccgtctctactggggccccaaatcccatcttcctcagggactttagggtcacacgagtcagaaacctatgaaaaccgatgcaatcaaaggagagaagagtgggggaaggccaggggaaccccagtgcagggacttggcagtgggggttgattctcgtcaccctctgcatccgagtgggcctgagctctactttctgtctctcttggtgcttctgcttctctctctctctctctctctctctctgtgtgtgtgtgtgtgtgtctctctctgtggactggcgtcttctggtcctcttcctcccagtccataagtaatagtccctaaaacagcttgacacagattcaaat

SEQ ID NO: 129807 - DNA, 1056 bp, Homo sapiens
gcagagaatgggtttctcttcctactgaggtgcttccccactatgaattattaaagacttgaggatgaaagtgttattgaagacaaaagtacaaataagccaagtgcacccatgtcttaattagatgacattgaagaaatgctgctcaggaaacacatttacttttttttttcctttacttctaaggtgtagccctatttaatctttgcctagaaacaagtttgtaatgaatgtatttggataacgggcagcatggcttggcctgagccttgcaagcagagctgctggctgtgtctctgccattcgagagtctatggcttctttataacttgctagacccatccagctatcctgattgtccctcatattatctaactaattgtttccatcatttactttagtcaactagttctctctttcagttgactccctttttctaggtgctagggaacatgaaaaaatataatactagagctgccttacgctgtgacgtaggagaatctgaagggaggtcggggtggggacaggagcaggagatgatgcatttgaaaggcttaaaacacacaagtaggagagcaagagaaacaaaagaaaagaagtgggcctggatggggtggtggggagcctttggcatcgagaaaaagtttaaatttatacattacataatgttcatcagagtttcttggcagcacggggatggtttttgataactaacagggtgatcgttctcagaatggttgtcaaatgggaagagcgtttcagaagatgccccaagctctggcctttggagtatttatagcttagctgagcccatagccggacagcagccagcaggctgggattaggaaaaaactagctgatatatttgagtctagttgtttgttaactattgcagaagcaggtgctgccttaagatgtacctcatgagcacctttcctaggagcatgtggtgctggatctaaggaaacttgcctatcaaaaatcatagtgagggccttggctatttatggataaccaatccatacaaggggaaaccatattgacacattctttata

SEQ ID NO: 129808 - DNA, 1085 bp, Homo sapiens
gatcgatcatattttttttttcaaaggaattaccaggcttgggatgtttaatcttggcagatggatgcagtctcatgagcctgttttgcagatttccagtgctatctgggcagagccaaatgaaaaataaatgcaggggaacatggacacaggttctagagtgggcaatccctcctgcagagtggaagtccttacaaatcctgtaaactccactccagtctcttaaattggagagattccctaccactctgtgtacatgaagagcagagagtttagagagcttgagatgcttggctgtaatctattcatgtgcacatttcccacctgagggccaattatcatctcagattcatttagttgtgactgagagcttcataaacacttctttgatattgacatcatatgaaactgatagatgggctcctaaaagaaagacatgggtggttcaaaatggaatcttatctcaatcctgtcattctgaccacagatcacatcttgcccctcaggagtcattttccgttgggttgtacatccaagtcccctggctcttgtggccaaggggagggacctctggatagctctcttcaaataggaaagtggaattctcacttttggggtgggcaggcaacttgccggacattagtgatgcttgaccaagtgccaggaagaggccattagctgggtgcactgctgagaagagcccattagcacccagctgccaggccacagtttggaacttggagcaagctatatattcacagcttagaaattgtgattctctcagtgtcctacagatggcttggaaagcgtgcaaagatgaatcatactctataatcattttgaaactttttccccaagatatcaaagagacagaagaaaaattaaaattgtggtcagtttcctggacattttatacacttgcggctgctttggaaacatcaaattttttaaatttttatgaacatacaaaaaatcatgtagaacttgaaaattgcctgaatttttcccacagtggcactttgttaaatgcaaaacccatttttcaaaaattactcatgagctaaataaaaaataacaattataat

SEQ ID NO: 129809 - DNA, 1034 bp, Homo sapiens
tggtgcaaataataatctgaaatgcataaaatttgtcagtccacattcttatgcataaactgactcaggttttgctttgacagaactgggccatccccaggatacactgcctcgatggccatatgtaaatgaggacatgcattgtttatgccagaaggtgtgtagtttactgctttctgatgtgtcagtccatgggaaagcctcaaaagaaagagaccctgctcaaagtctgtgaggagctgggacttagcttgattctttgtccagtgggagaggcagaggcagaaggaatggcagagaatgaaggttgatcaaaatcagaaagagtacagaccaaatgagatatgcatgggctatttctggggctcgttgccttcagcttgtcctgccttatgctatattcaggcaggggatggaacatagggaagaaaagtcatcttggcctccagctttccaaaaaccagggagagtaggatatgataccggaaagcacagggagtggaaagaacacaaatcaaatgcatttgcttgattttacctgctttgttgaagagttttgtatgtagaaacagaaactgttttgaaaatggagcatttgggtgatctgaaaattttacttactatgctatgccttttccttccgacgtaaatattctcttccttcctcagctccatggtagtaaaaaaaaaaatatgactaaaacttttcaccaccatggaagccaaatgcaattaaatggcgacatgcctctgtgttgctttcctgatatgcttctttacaaagacgatggatttaataccatttatctacatagatggcagggaagccacacttttttttgtaatcttcatctataatttctactgggtttatttttatagctacaattaaagtggcaatagaataatatccaaccccataatttttccaacgaaccattgtgaaaaatgaaaggctagcagttctgtaatatttcttttccagcactgcatagattgtgtcttgttccaagattcttaccttaaggatttat

SEQ ID NO: 129810 - DNA, 1031 bp, Homo sapiens
ttccttttaaggaaatgctgttgcacgtatcacttccattttcattccctggtttagaagttagtcacacagccaccctcagctactgctagtgaggctgcaaaatggagtctttgactgaacgtccatatggccagctaaaatgtggcatcccactattaaaagaaaagggtagactggagattgggcaggagctaatggtttccttcataattacctgttaagattctgaacaagtaatttaattaattaccttttcaaaagccttttgcacctttttccatcctccaatttgccaatactattttttttcttatggagaaaacaaatacagataccacacagaaaccaagctttgcaatccaattccagtgcaaatttagagaattaatgaacaacaaggaaccaattatgcataagtaaaaaggtcatagttgagctcctgttgagattagaagaaggaagtaacagttttagatggaaagaaactgcccaagactatgcaggaccagaggagaccctaagattggagaagtcaagcaggactgctgagataaagttggcaattttcatactcaccacaactgttgttttgtaccaaaacatgtatgtgtttatgaatgtaggtagatgttcaaaagaaataacaaaattgtatattatacaagaaagaataagggccatcagttaatacatttgggttcttatttctatttttaatatttagttgtgtgaccctgaacaaaatgcttaacgattgagggtctctatttcttcatccataaaatagagatgttgacttagatttataagcaatagaaaacacatttcaaaagcctattctgtgctagactacattccagacatgtaagtaaatgcttcaaggagctcacagtgtcttgggctggaggattggtgtctactcataaacagacaattccaacatgctgatcaacacagcatcaggaaatgatacccaagagcttggggagcacatttaaaagaggcttcagactagaaacgtgagattt

SEQ ID NO: 129811 - DNA, 1209 bp, Homo sapiens
cctcccaggttcaagcaatgctccttctgtcttctgaaggagcctcctgagtagctgggattacatgagtgtaccactacacctggctaatttttgtgtttttagtagagacagggttttaccatgttggccaggctggtcttgaactgctgacctcaagtgatccgcccacctcagcctcccgaagtgctgggattacaggtgtgagccactgcgcccaccctaaatagtcattttaaattgatttttttgttgtactctttacacatttctcacctataatcatattctttgatctagccacaatgaagaaacttcactttccagtgtaataaatatattttaattttgtggtcaatgagaagagtcaattaatgattacttgcagtttcctccccccaccagtgagcagtgtttggttcaaaattgatgaaatatttcagaatgaatgaataaatgatataaaatgaatgagaaatttgttttgggtcaactattgagttttaaagactgaagttagccaggagtggtgtcatgaacctgtagtcccagctacttggaaggctgaggcgggagaattgcttgagcccaggagttcgaggctgcagtgagtcgcaattgtgccactgcacagcctgagtgatagagcaagcccatggttctattaataaagactaaagaaagaacagcatttattgctaatgtggcaaaagctattatttttacaatatttaagttttactgctttaattaaaacctttttttaaaaccctgatattcagactaacatcattgcttcagatctttatctttgctatttgagtttaattcccatttataagagtcagagaatatgactaaatatagaaatatggctgggcatgatggcacacacctataatcccagcactttgggaggattgcttgaggccaggagtttgagaccacctggacaacataacaagacctcttatcaaataaaatttttttgtttttaaattaagctgggttcagtggctcacacctgtcatcctaacactttgggaggctgaggcaactgggtcacttgagcccaggaattcaagaccagcctgggtgaaatcctgtctctacaagaaaacgcacaaaaatcggctgggtatggtagtgcacacctgcagttacagctacctgggaggctgaggtggaaggttgagcctggagaggtca

SEQ ID NO: 129812 - DNA, 1643 bp, Homo sapiens
ccatctctacaaaaacaagcaaataaactatatttacttatatgtataaataattcagtgtattttgtcttctttatcttcttgtgttttagctttatgagttaactccatcaaattttaatttcttcatttgactgctcttttttacttttaatttttttgagacagagtcttgctctgtcacccaggctggagtgcaatggcgtgatctctgctcattgcggcctccacctcccgggttcaggtgattctcctgcctcagcctcccgagtaggtgggttacagacgctggccaccacgcctggctgatttttgtatttttagtagagatggggttcaccatgttggccaggctggtcttgaactcctgacctcaagtgatccacctgccttggcctcccaaagtgctgggattacaggcatgagccaccatgcccggccctgactgcgcttcttttctttacctaacttctccccttttcctaactgattttgagattgctgctgtctatttctgacttttgtattcagagaatacaaattaattcatttagaagcattgtctctttgctctgtttactcactgtttgtttaattcctccatctcactttctgttagcacctagtggattccaggcacagttctaggtgctatacaacagtgaacaaaacaatgtccttgcagtatattaggcgtcttccttctggcgagaggagagatataacaaatgattggttagttatatgtgaagtagtaggttttatgaaggctttgcctgtagtctctttcctttagtccactgtattttactgttttccaaagcttagtaggaataacttttaagcttatttaaatatctcacctattaagcaggtaattttatattaggcatttactcatggttgactgtaagtaatgtaatactcccccaaccaaaattttatctattctgaaacatcatttaattcagtatattatgtatatttttaagtgtttcattcaattttttatctattttagtattcacagtggcataacctctttacatatcaatacttcattattttatatgtatttaaggttttcattattaaaaatatactgaatcattgatatttttggagaataaaaatcatgaacttattagcagaaattctctacaatcaattatggagaattcttttttttttttttttttttttttgggagacagtgtctcgctctattgcccttactggagtgcagtggtgtgatcttggttcactgcaacctctgcctcctggtcttaaacaatcctcccacctcagcctcccaggtaactgagactacaggcacgtaccaccgcaactggataatttttacatttttttgtagagacagggttttgccatgttgcccaggctggtctcgaactcctgggctcaagtgatccacctgtcttggcctcccaaagtgctgggattacaggcacaagccaccgcacctggccaaattctttaatatatgtgcttttcctttttgtctgtgtggttgagtcttatagttacttttcattgatgttgagtattttagatttaatagactcacaaaaaattttaccaattccacgacagcatcttgccaaaacttgtcatttaaatat

SEQ ID NO: 129813 - DNA, 1180 bp, Homo sapiens
taagaataatcaatataatgtatatgaaaacaatgataaaaactaaaatcctaatcaaagatggttcaactttcaagtttatattttgaaagaattgttttttcaaaagtttaagataaagatgacaaaaatagatttaaaatcacataaatatgccatgggattccaattcctcatccttaagtttacattttcggcaacatattgcttggaagaaggactgaaagagataaatgatgcagagaaaataactctttctaatcctcgagtttccagataattaatttaaataaactagataatttaattgagatttttatataaaactttagaaagtttaagaaatacctttttataagtttaaaaacaaacagaaatcttataagtttgataaatattgtgccaccccaacatctcatagcacttttaaacactttatcttatactcctattcagtaaggaggtgatgcatataattattccaatgttgcagatgaggagactcaggcacagagagatggagggatggaagggatctggtcattcagcaaggcagcagtagagcagagcacacagttcagaactcgaggcaaccggtactgttgccattcctgactacattgcacagtgagtctgctgacgtctaagactgaaggggcttcccagatacgtgagggaagtctttcagtaatatatatgtgtatatatgtatagttgtaagtggcacaagtatcccctctggaaaatcccttaataggcctcacaaaattataagctgtgaacaaaatttaaggctattgttacaggattaaccacatttaaattgtaacatagtaatagaaattaaaggggaaaaagcctgattgtcaaggcaagttcacaaaatattggtagaaaatattaaggtttattcgaaagtgacagactttttgatataatacaaatcaccctggtttgtgaattcttgagacttacaactttggtaagaacttttagataacttcatgtctacataagttgaggagataactagtccatttactgtaattgtaaagtaaatagcagatataaaagaaaatattttgtttcaataaaattatatgaattatctcactttatccataaaaactttgagatagagataattattatttattcccatttgatgcatgaagaaagt

SEQ ID NO: 129814 - DNA, 1124 bp, Homo sapiens
tgccagttttggaagagctaagcgtagtttgattcacattctcctgagtgattctcttttttatagggttaatggaagattagatttctgattgctgatgggatatcatttctgaatcccattagaatcctatctctggaatctctgccctgccacttcttagatgtgtgactttgagcaagctattattctgtaagcccaagttttctcatttgtaaagtggggagaagaatacctgtttgtcaagattgttgtgagttttacttaagaatttgagccagagaagcttaatatcaagcttaagttaacctttagagtttttgttgattttaacaagtaaaaaagtttactgatttaagtataaatagtacactatgtagtttgtgaagatttttcttttgaagaattaaacaagaaatacttatgttgtaacttcatactcatgtttcttacagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtggtgagttatataaaattaattattgaagtaaagcttagtcaaatttaaaataaatggttaagtaatgagccaaattgtataagaacttagacactttcgctgcaataccttaaaaattagtatgtaggccgagtgtggtagctcacgcctgtaatctcagcactttgggaggccgaggtggatgtatcatgaggtcaggagtttgagaccagcctggccaacatgatgaaaccccatctgtactaaaaatacaaaaattagccaggcatggtggtgcatgcctgtaatcccagctactcgggaggctgagggaggagaattgcttgaacccaggaggtagtggttgcagtgagctgagatcgcaccactgcactccagcctgggtgacagagtgagactgtctcagaaaaaaaaaaaaaaaagactggagaatttgaatgtcattttgttcttttactttgccttcggaaagtat

SEQ ID NO: 129815 - DNA, 1063 bp, Homo sapiens
tttctcttactagtaatactgtacagtatttttaatgttttcaaccccctcctctaacagtgaaacctggctcccgttattcttactatgttgactcatttgatcagtccccctgtgtgtaacccatctcccatcattgctgccttcccctacaactcatggatgccctgtccctgcttgtgccaggccaccactctgtacagtgccctgtccagctgctcaggctgtgatgccctacaccaggccacctgtctcgggctctggcccctcctgccaggctgcttgctggttgtggatgcccccatttcactcaggctctgactcccaagcttccgtgacccttgcctcctctcttccccctcagcagccccccaacctgtgataggctctcttctgtgcagtgccctcgtgactctgctctggttctgactccccactccgcaccacctgtgtgagtgccttccttagtgtctggcgccaacactccaggctacctctccacacaggttgtctgcttcactgtggcccacctaatggctgtaggactgatttgttcaagaaagaaagagaagaggaaagagagggaagaagggggaaaggggaagagaaccaggaagactagtgtacttttgtgagaaaagactgagctaccaaccatcctttactgtaaacgaattaatgaatatattttaagtatttgcattttgtcattcaaacaggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccaggtaaactttcactgtagatagtaatgtaaaaatgttttattaacaaaaccaagttatgtggtcgtctctatcctgagctctctaacgtcatttgaaaaagctttttgccttttagggtgtgtataacactcttggaactctaatatgggaatatctaattatcctttttaggcaat

SEQ ID NO: 129816 - DNA, 1033 bp, Homo sapiens
agactggggattccgaggcggctcctgggagaccggacgcgcgcggcctccgccgctcccagtcccgccagacccgatgccgggctggagaagcgcgggggccgacgcacctcggataggcgggggcaggggcaggggcagctctcctttaccctagagcggcgacagaagctcttcgggggatcagtggccaagggggcggacagatttgcacggcggattcctccgaagcaacccgtgtgaaagaagccaagcggcggctgcagcccgggccgcgatgggggtgacaccgcccgtggtcccgccccttcccgtggcccctcggagccacttccggcggcagcgtccgggctagttcccggcgcgagcggccgcgggccagtttctatctcctcatccagggcttgcgggcgaggcctgttttaagtctccagtaaccgagcggaggcccggcaggcgcgacccgggctgcgtacgtcagagctgcctccgaagtggtaaaatgtgctgcgagaagtggagccgcgtggcggaaatgtttctcttcattgaggagcgggaggattgtaagatactgtgcctttgctccagggcatttgtggagtaagtagaaaagagaatctcttcatgttctagcacagtcattacccagaaatgtaggtattgcaaacgtggttgtaattgatccctgaaagcagccagaacatctgacccttgggcacggtgatgtttaagaaaaacaaaaccctcagacatgacggagtggtcgcccactgccattatttttatgtgaaggactacatctacttggtaggctgctatgaaaaaatgtcgtaggtgctatatgtcatctcatatttgtaaatcgaggggacatttaaaaattgggggaaagcgacatgtaaaatgaaatctctagtagatatgatgtcataaagtgaaagtttaaagttgagtgacttgctttggttaacgtctttttttaaacctaaaaatctacttaagcccaaatgcacataattaaaacttcaaa

SEQ ID NO: 129817 - DNA, 1029 bp, Homo sapiens
aaagcaaaaaagatactgagacagaaaatcctccagttgaaaacacattatctccaaagctagaaattacagagaaatgggaaaagtattggaatgaatatggaggaggactattgtggcaaagttggcaagaaaaacatccgggtcaagcactatcttctgaaccttggaactttcctgatacaaaggaagaatgggagcaacattatagtcaactttattggtattatttggaacaatttcagtattgggaagctcagggttggacttttgatgcctcgcaaagctgtgatacagatacttacacatctaaaacagaagctgatgacaagaacgatgaaaaatgcatgaaagttgacttagtatcttttccatcttcacctattatggttgataatgatagctctggtacaagtgataaggatcatagtgaaatacttgatggaattagtaacataaaactgaattcagaggaagtaacacagagccaattagattcctgtacaagtcatgatggtcatcaacagctaagtgaagttagtagcaaaagagagtgccctgcttccggccaaagtgaaccacgtaatggaggaaccaatgaggaaagcaactcatcggggaatacaaacacagacccaccagctgagggtaagattaaccaagatttattctgccatgtaatggttagcaaaatgaattcatttagcaaaataactactaatcctttattgtagagttaaataataccaagtacatttcatataataatgaaatgatttaatccatcctgttttcatatcacaagttatccttttctattaataagaatatttgcatgcagttctcaaaagtatcattccttctcttgtactttggtggctaatgaaggaaaatgtggaatctcttgagaaatctaatataaagtgagcttggaacttttagttttccacagcaaatgaatttataagaggcatgttagaaagcaattgagaatgtacatttgacattaggcaaatgtcttatgagtca

SEQ ID NO: 129818 - DNA, 1061 bp, Homo sapiens
ggaaaaacaagcgtgcctctactgtgctacctctgtatggtagacattgcttgttaactccccagttcctgctagttactggaggcaaagatcatgtgtgttcaatgagcgtaacttattttgaaggacaaactttgtaagaattatttctcaccattttcctttacttggaattacggccagggatggtcactggttactaaaagatctctagtaggtggattctcctgggttacctaatatcacttgtatcacaaccttattctttttagtaatttttttcttttaaaatttttttggattgtattgatacttatcaaacgtttccttgtttgtttttaagggaaacctctggagaaatcactttaggagattaatttaaggctgcagcttttactgatgtttttccaaaggaaaattgagagattatatttgtaccatacctaggaatagaaatcattacttgacatgaattaagactggaatacttattgctgtgttccaaatgctcctgggtacttaccttatttggaaaattctaattaaagtattttttttcctggtttcctggatttgtgaactatggttgactatggtgttgggaagtttgcatgggtcaattatattgccttttttatatttatctgaactagtgggctctggtggtaatggcttatcactgtttaccttttctttatttagccatgaactggacattgatgaaaacccagcttcagactttgatgacagtggttcccttctaggattcaagtatggctcaggacaaaagtaattattcataaaagctattgttttccagaagtcctaaccacttcaactatcttagagcactctgatactcagataactaataaatgatcatgtgttgagatgttatcattaaatcacttcttgttagaattgtggtagagatatccctgtacatttgatgtgttcatatgctttaactcagttgcactttatagcaatccagtgttgttattccatttcatagataaagcaactgcagctcacagaggctttgactttactggagaggg

SEQ ID NO: 129819 - DNA, 1227 bp, Homo sapiens
tctttgtgtaaaacagaaaaattaggtcatattatacatactctccagtttgcttttctccctcaacaatgtaccatagacactctttcttgttggtagaaacatttagctaattctgtaaatgagggcattgtgttttatcagttatcctaattaacaacatctaaattgtttcctaagatctaagcataatgccctagaaggtccctccagattattacatgtgcctgcctgccttccttccttagggtctcgctctgtaacacaggcaggagtgcagtgctgttttaagttttttcatggagatggggtcttgctatgttacccaggctggtcttaaactcttggcctcaagtgatcctcccatctcagcctcctagagtgcagggattgcaggcatgagccaccacgcccagtccatttattccttcttattgctgaatagaattccaatgtatggatgtaccaaaatttgctcaaccatgcaacaattgaagggcatttggattatttgtggcattttgctgttacaaataaagcaacagtgcaggtgcagtggctcacacctgtaatcccagcactttgggaagctgaggtaagaagattgcctgaagccagaggttgagactagcctgggtaacatagcaaggcagaaaataaaaaaataaaatgaaatttcaaaagtaaacaaagctgctgtgaacatttgtgtataaaagacataagatttctctgggattaaatgcccaagcattaaatataaaggaacatgggtagttgtgttagaacaactagagattttatcgtacatgacatgaagactaaactgagtaggtaaagcctgctaaagacagcttacaccagtaatctaaaccatgactgggttctttgatgtttctaagggttgagatttcaggtcctacttatctgtttcataagttgtgaaatttaagtagatacctacacattatgaaatcagcaagaaagggacacgaggaatgtctcaaaattgaattgaattcaaattagttcagaagtacatgttgactcttgtagtttctaaagattatcagtttttctcccttaggtgtttcaaggcaattatagttaatataatcaatagttcatataatcatttaaggctaagatcataaagtttagcatgtaaaaaggtttttaaattcctggcaggatgtattactatgcacatgtaattttattgaggaa

SEQ ID NO: 129820 - DNA, 2665 bp, Homo sapiens
cctcaatacagtgtcctccctaacttcagcatacttgtaaaatatgctacatatatatagctggttttattttgtattacatttcaggttggttggctgctggtgatgttttaataaatatgttcgtggtgctagttatatctgaaacagactgcctagtattagtccagtcagtgccataggactttccgtaatgtgttggatataatagcccctatgcattcatctatagatgagtgcagaaacagctactaagcattgctgaggaaaaaagatatgtaactgttgtgtctaacttagatacctaatttatttataggcacatttctttagaggaagattctgggttgttgcccatcatgtctaccacttcattctaatttactcactctcaggaaggtcatgaagacaagataggaagaatattcttgttacagaagatgcaaagaagtatatgatctgatgctgagccttgtttacattccaaagaacaaacatttgctgggacatatcttactggctctactgttgcattaaaaggcaactttgatttttttccaaggtagactgcttctattcttacagaagaattggccctaaatctttttagggttcgtctttgatgctaagtaacatttacatagattgtagcttgaccattgcagaaaggtctatataatttgaaaaactaaaattaatgattcagtagtaagtaggtacatttgtaatgtagctgtagcacagttaaattgttaagaacccttatggaaaagccactgggacagtttggctttatcctcttagtatttattgatagcaggaagtatttaatctgatatttttttccttttaaagaaaacttttaataaggtcatggcatgcccagatagcattctgattaggtcagaattacttactattaagcttgtgtgatgcagtctgcttttcagagccaataattttgacacagcttttcagtcaagtcacaaattgtaataggtaggaagattctgtgtagtttggaattaattcctgctcatgatgtcatcttaaaatttaaggtagaaaaattcctcacatgggttaataaaccaatggatgaagaagcatcacaggaatcatcttctcatgacaatgtgcacgacgcttccacaagtagtgattcagaggaacaagacatgtctgttaaaaaaggtgatgacctactggagactaataatccagaacctgaaaagtgtcagagcgtatcttcagctggtgaacttgaaacagaaaactatgaaagagacagcttgctagcaactgttccagatgagcaggattgtgttactcaagaagtgccagactcccgccaggcagaaactgaaggtaacactaaatatgcttcaacttgctaatggatttagataaaattttttttgttaatatgttttttcttagttttcacttgtgaatcttctgtacctaaggagtcactgctacttatttttaagtgagagaaggcatattaagtgtacatgttctaactggctatgacttagcacccacagcactcctcactcttggctgagtgaacatgatcaagtagaaaaggaaagactgttgggagcattgtgtctgcagaccactgtctgcagttcaacttggcctctgctggtactcagttccatgggctaaaggtgaccatcctttgccttcttcgtatgtggtgtagctttggtttacttcttcctttttttgtgtgagacagggtctcattctgttgcccaggctggagtgcagtggcacaatcacagctcactacatccttgacccccagggttcaagcagtcctcccacctcagcttgagtagctgggactacatgtgcataccaccatgcctgcttaattatttaattttttttgtagagacacagggtctcactatattgctgaggctggttgccaaaggctcaagcagtcctcccacctttgcctcccaaagtgctgggattacagacatgagccaccatgctcaggctggtttccttttggtgtgtttttgtgtgtttgtgtgtgtgtggttgatgatggtcatgtgtttttgatggcacgttaatataaaaagtattcagagcagttggctctaatgaataaactgagtaacattttcaatttatgcacttttgtattcgaatttttatagcaaaagttcttatatagtttaataatggtattatgaaaccattatatttattgtgatccttcatcatatttctttattactatggaaaataacttatttgagtcttgattttttttttcttagtgcaagtgtgggtgtatgtgtatgtgtgatctttttatcacatatttctttacattctaaacagcatacctacagtagtttacatttattttattatcaatgttataataaccgatgttcatatgacatttgtaggtttgtgaaatgcttttatgtgtcttattctcatttaatctgtaaggtagccagggaagtaggtggaattattttccattctgtaaatacagaaagtaaagctgagagaaatttaaaaattagcccaagtaagtggcatagctaggactcattaccagcttctccaattgctaagtcccattttcctgcactatcccacttccataaacaccaattctcat

SEQ ID NO: 129821 - DNA, 1034 bp, Homo sapiens
agatcatgccgttgcactccagcctgggcaacagagcaagacactgtctccaaaaaaaaatggagttttttctggagtgtccaatacaaatccaggctattgcttcaaccttaggagtgaaataattgggaaactcagcggagtgtgggggagctagccaattagagcagctagttctctattttccacaggagtcagtagttaaagcctcaaagagaaacatcaaaattgtaaattcagttattggaaagatggaggtatacagtattacaaaagaattaggttaagaattgaggtcatcatttctgtggaaattgggaatggtactgctttttataacaagctttgaatttttttctttaaaactgggtgatttataattttttaaaaagggaaactaagctttttaaaagtatgtaagatatagtaatgtttgctatgtttatgcttgccttggcttcttgaaattgaacatgctaacacaaatactcttcctttgcagagggctggttttcagttacacccgagaagattgctgaacacattgctggccgtgttagtcagtccttcaagtgtgacgttgtagtagacgcattctgtggagttggaggaaataccattcagtttgccttaacaggaatgagaggtaattagccatcaatggaagtgaactattttatgtccagttaattcagtaaatgtttccattttgctacagcctatcttactgagatttaatatataattaataatttaatatgaaatgatataaaataatagctagcatatattaagcatatactttgtattgcatactggtgtaaatgcttcctacagttgacccttggacaatacaggtttgaactgtatgagtccacttacacccagatttttttcagtaaatatattggaaaatgttctggagatttgtgacaaaaaaaagaaactcgcagatgaatcccttgtaacctagatacatcgaaataatttaaaaggtaggaatgtcatgaatgcatgaaacataggtagatact

SEQ ID NO: 129822 - DNA, 1642 bp, Homo sapiens
agaacaggaaaaacaccattataaatgtatgattttgcaatatgttataattggtgcttatatttattgttcaagtgatttagcacattatttctcaaaaatgttaacaaatttggaaactagcattttctggaaaacaatttccatgacaaccacgccgtaagcgtaacggttacacttagccctttcaaatgaagaatactgccattaacacagtagtgcacatgcaagtatactgagtagtttactgcaaaacatggataggctaaaattaaattatgtctatgttgctaattataaaattggaataaagtaaatgaaagtccatttggtgaaaacataatatctgtttcctctacctaaaatgtctcattaaacattatcggcaggtgtttttacatttcttcttcatcacttggctacataagtttgtaaaaatgtgttttattttggttttccttagaagttgtcgaatttctgttcattttgggcattgctacattttgaagaagtttgtcttttccaaaacctagcattacaggctgtccatacagtcagtgaccttttcctactcaggctgtagcacagcacaatggtggccacatatttggcactcagtagatattttgtggcaagtattgccacttggttaggaaaagctgtagaatgagacaagaaagccaagtccttcagtcacattttcttggtacaacacagtgaatctttctaatttaaataaaaaatttaaactgaagtctgtatctcgggtatatgtggccaaatgtctcctcctctttataaagagttcttatacagaagatgacagactattcgaaagacaaactatcctatataagtaataatcagtgtcaattaactcatttttttcttttcccacttttagtgattgccattgatatcgatcctgttaagattgcccttgctcgcaataatgcagaagtttatgggatagcagataagatagagttcatctgtggagatttcttgctgctggcttcttttttaaaggctgatgttgtgttcctcagcccaccttggggagggccagactatgccactgcagagacctttgacattagaacaatgatgtctcctgatggatatcctttggaagtcttaagagtttactgaaacaatgattgtggagagaaaggagcatgagagtgagagagggagtgtgggtgggtgggcagggtggctcacatttgtaatcctagcacattgggaggctgaggcaggtggatcacctgaggtcaggagttcgagaccagcctggccaacatggtgaaaccccgtctctactaaaagtacaaaaattagctgggcatggtggcacatgcctgtaatccagctactcgggaggccgaagcacgagaatcacttgaacccaggaggcagaggttgcagtgatctgagatcgcgccactgcactccaccctgggtgacagagcgggactctgtctcaaaagagagagagagattggccaggcacggtggctcacacctgtaatcccagcactttgggaggccgaggcaggtggatcacgaggtcaggagatcgagaccatcctggctaacacggtgaaacctcatctctactaaaaatacaaaaaattagccg

SEQ ID NO: 129823 - DNA, 1167 bp, Homo sapiens
ctcagcctcccaagtagttgggactgcaggcgcacaccaccacgcccagctaatttttgtatttttagtagagacagggtttcaccacgttggccaggatggtctcgatctcttgacctcgtgatctgcccgccttggcctcccaaagtgctgggattacaggcatgagccaccacgcctggccctcatctctccttagttggcagagtacttgaggctccaattgtctttttatattttgttctctgatgtctaggaagggaaatgttcctcattgtaacagtcacttctaatactttattttggtaggtaggtaagtagatagatagataggtcgataggaatgaggtacttatttataggtaatatttctaaaacttaccatatataagaatagagttgtaagtatttgaataatgtatttgaatttgaataaatatgaaaaactattaggtaatattgttatgtggaaaatgttttaaatataactaaattcagtttattagcatttgtagtggttttggctaaatacaataaaaatttatcacagatttctttgcaaatattctaagtagttatagtatctgtgtatttaataaatagaagattgggtcctaactggtttctaaatactagatttttttaatttgtgtcaaatttttctgaattaagttaatatagtggaaatctaatctaatggtagctctctcgtagaggtagagaacattagtccaggtttaggaaccagaagcatgagagaataaaaagaaggctaagaactggattgggcttctggtacatgttggaatagtagactccaaactagttacttgaaaatagcctttacaactcagagcactcacaagtgcattcatcctactacactaacaataccctgcattcatacactatacatctacagcataggagctggcacacacacttagggtgtacagtgtcctcttagccatttcattgactcatcatgacattctggagcagtgtgtctctggagcacctgatttcattgaaggctatggaggtatggtgatttgcctggtcattctgccacacagcgacagtcttattacaccttgctgtctcccactgacacaatgttcattaccaagaagaaacagatttatctgttatcacaatattagctca

SEQ ID NO: 129824 - DNA, 1049 bp, Homo sapiens
ccttccatgaaaccagtcacggatgctaaaaaggttggggaccactgctctagctaacctagactcctgatgatttgccatctatagctaataagcagcagaagcttatggtgtgatacaacattccacttcttttaggtgtcttgagctgagtttcacttttttgtaatttcataataatttctattatgttacatgcatttagataagctgacaactcttaaagtgggacataaatacactattatatgtatttctgaatatgggtggctggattgttgatcataaaaatctgaatctggaaacaaagttgatgtttaataactctccttggttggctggatatacataattcagactctgctttgaatgtccccttctggtcctttaaatggtctatttccctaccttacgtaagtttccatgagctcatcttgttttcatagtgttcccttttattgttaagagaaacaaaaccaaaaaaccccacttgtttcagcaatgccctgttgtcttcctctgtgtgaaattgctcaactaagagttatgcaaatggggatgcggcacgtggtggaggcttcttgcagcatgttgatgggggaccaagacctggtcttgcctcttcctcctccccctgctggcttcattccggtcataccagctcctgctgtggccatcagctcatcccaggaccttggcagggcctgtttcttttacctcacactgaagccccaaactcttaggctccagtaatcctcccagcttggcctccagtgcactgggattagagatgtgagcccccatgcatggctactctctaagttcttactcccacggacaattagagtttgaaggaccttaggccatgggttcagattatcttattttgcttcaaaattttaaaaacttttttatttttctgtcatatacatatacgtgtgtgtatatatatataagttatatatatataacttgtatatgttactttttatatataataaaatatattatatttttaaataaaatatattatattttaaaatataata

SEQ ID NO: 129825 - DNA, 1016 bp, Homo sapiens
atgcaaacacaaatatctaatttcacaaataattacaaagcaaaaactggtgtgtcgacctctgagaggaaacttgctagccccagaagcccccaccgtccacccatcccctcccacccacaccctacctgtcccccagagacaacagctattccgaccttcctgatggttttctgacttcttcttaattttgccacttttgtatatggggatgtatgcatccccccaaaatatagctcagttttgctgtttttgtactttgtatgaacgaattataccaaatgtgctcttttacgtcttgcctcttttactcaacgggttggtgagaggcatccatgcttttgggtgtggctacagttcattcatcttcattccatgtggtgttggtaagatacatgtggcttttgggtatggctacaattcattcatcttcattccatatggtgttggtgaaatgcatccatgcttttgggtgtggctacggttcattcatcttcatcctatgttgtgttggtgagatgcatccatgcttttgggtgtggctattgtttattcatcttcatgccatatggtgttggtgagatgcatctgtgcttttgcgtgtggctacaattcattcatcttcagtccctatgatgttggtgagatgcatccgtgcttttgggtgtgactacagttcattcatcttcatctcatgtcgtgtttgtgagatgcactcgtgcttctgggtgtggctatggttcattcgtcttcatcccatgtcgtgttggtgagatgcatctgtggctacggttcattcatcttcattccatatggtattggtgagatgcattcatgcttttgggtgtggctatggtttattcatcttcatgccatattgtgctgtgctgcatgtgttttcaagatatacgatcatttatccatttatttcaccatttactgatgaaattggagttcatgttagtccattttgctttgctaaaggaatacccgagactgggtaacttataaagaaa

SEQ ID NO: 129826 - DNA, 1081 bp, Homo sapiens
gatcgagaccatcctggctaacatggtgaaaccccgtctctactaaaaatacaaaaaattagccgggcatggtggtgggtgcctgtagtcccagctactcgggaggctgaggcaggagaatggtgtgaacccaggaggtggagcttgcagtgagccaagatagcgccactgcactccggcctgggtgaaagagcgagactccgtctcaagaaaaaaaaagaaaatgttaagacatgttcctttttttttttttaagatgaccattgttggagatttggcagagggtggtcagttattttagaaagggctcaaatggtgattgccattacccactgtctttaaaagctgaatgatcaaaatagtatacatgaaaagatttcaggaattcataagttttccggttttccttgatggcactttccagtcacctaccctacatatgaaaatgggagcctatttctgttttcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtatgttgcactaatgatctttagatgttttattattgtgttttattttgtttttgtctgtttttgacaaagcaattacaatagtcaccattaagaaaaacttatttggtacaacatttaagctgtaccataattgtctgcttatggttctattctaatagtttctagaaggtactctcttgattaactccacatgatacttttgttaggcttacaaatgctatcagttgtatttcaattaagcaatgcaaaacacaaatagattcagcaagatgattcttgtttattttgtattgttaaagttttcactcaaacaatgaatataatatacggggctgtggagaaaatatttgtaacattaattctatattgtttattccagccttttaattacaaattaaaacatgaacattaccatacacacagaactaaatataatgcaaaaaatctacttcttt

SEQ ID NO: 129827 - DNA, 1168 bp, Homo sapiens
agtgttggattaaagttaaataacaatgttaacttgttgtagctttacagtttctagaactgacacttataattgagatcaaccatcttataaagcttaagctattttgtaactttaaaaaattgactcggtagggcccggtggctcatgcttgtaatcctagcactttgggaggctgagatgaaggaatcgcttgtggtcaggagtttgagtccagcctggtcaacatagagagactcccatctctattttaataaataaataaaaatataaatataaaatgactgtattatttatatagtaatatgttattactatattacttttttgtgagcttgtatttctgataacatctctttcattcacattatttttggactggatttttgaaaatagaaataggtattttataaacagaaagattctaggatgaggttgtgaataaatccaagtaatataaatttaattacccagcagttatttgaaattatgaatgctttcttgaggggtggagggaaacacattttcgaatcattattcttttcagttctgaagagggcttaaggtaatgtacagctgtggaaagtcaagtgaccagaaccaccactggtcatttatgtgacagaacactaggtggcactgttcctcgaaggaattgactagaattgcataccaagagtccttttttttttttttttttttttttttttgagacagggtttagtgctctgtcgcccaggctggagtgcagtggcatcatcatggttcactgcagcctcaacttcctgggcccaagcaatcctcccaccttagctttccaagtagctgaaactacaggcatgtgccaccggctaatttttttaaatttttttgtagaggtgggggggtctcactttgttgcccatgctgatctcaaactcctgggctcaagccatcctcctgcttcggcttcccaaagtgctgggattacaggcgtgctccccagtgcttagccttgttcattattattaactgaagtccacactttattcagacctccttagtttttacctattgtcctttttctgtctcaggatcccacattacatttgagtcatcaagtcatgtctccctaggcttcttccagtagtggcagtttctcagactttctttgcttttgatgactttg

SEQ ID NO: 129828 - DNA, 1068 bp, Homo sapiens
taagtaggtggttaataaaaactaaatttttctctatttgaataactatgcgtatccctgataagacactcaggcaccttggtagccactgaaatgaattcaccatacatcaaactaatagaagcaagagaaacaatctggcaaagaaatactcaatgaaataaattccaaacatctgtttccttttatatttattaatcattgcattctcacaatatttcagccaaagcctggggaaagtgagaactctacctatttaaataagttcaacaaaaagcccataataaaatatttagcataagacacagatctaaaaaatgaaaagacatagatctaacaaaactgcaattaaagaactgtgcattgttttcctataagtgatttgtcagatgttttaaaattatatatttcttattatttgttcacttaagatttatcactttgtacattaatcaagtctcaagtgttttcatctccaagagtcacactgtgagcttgaatctttttcaaagaaaaatcccattaagctttgctttaaagaaaacaaaggaaaactcacaggagcaaaaagtattttgtctcctaaaattgaagaaagaggccaggcgcggtggctcacgcctgtattccaagcactttgggaggccaaggcgggtggatcacctgaggttggggttcgagaccagcctggccaacatggtgaaaccctgcttctactaaaaatacaaaaattagctgggcgtggtggcaggtgcctgtaatcccagctactcaggaggctgaggcaggagaatcacttgaacctgggaggtggagggtgtagtgagctgagatcacaccactgcactccagcctgggagacagagcaagactctgtctcagaaaaaaaaaaaaagagggaagagacataaaccagtgctataaaagctgtgagcctgatttatcacagttgttaccacaatgccagaaaataatcttgacaagcacaagttctttaaagattcttctttttatttttctttcaaaacaatctcaaatttacataaaagctgaaagaacagtacacag

SEQ ID NO: 129829 - DNA, 1062 bp, Homo sapiens
ttgattgcatgaccttctgaaggtcttgtgtgtgtcttacctttttttcataacttctcttaatttttttttttttttttttttagagtctttctctgtcacccaggctggagtgcaatggcgtgatctcagctcactgcaacctctgcctcctgggttcaagtgattctcgtgtctcagcctcctgagtagctgagactacaggtgtgcaccagtgttcccagctgatttttgtattttatgtagagatggggttatgccattttggccaggctagtctcgaactcctgagctcaggtgatacacacacctcagcaaatcttttaaattatacattctgtgatatttccttgactttcttatccagcacttgtattgattatttttcattttgataatgttgggtttttaaaaactcctttatgatggaaaatttcaaacatacacaaaagtagagagagaatggtataataaacccactcagttttaaggattgtcaactaataccagttttatttcatgtatgactccaacaacttccccaaccagccttcagattatttgaaagcaaatttcagacatcgtattttactcatacattttctagtatctaaatctgaaagagactcttttctaacagttctgtagcattaattatactcatactgttgtgcaacaaatatccagaaatcttttgtcttgcgaaactgaacctcttacccattaaacactaactcccttttttttcaccctgaaccattggcaaccacaattttactttctttttctgtgagtttgattacttgatacttcatgtgagtggaatcatataatatttgtctttttgtgactgacattttatttagcttaatgtcttcaagtttgacccataccatatcatgtggcaggatttttccctttttttttttttcagacggagtctcgctctgtcgcccaggctggagtgcagtggcgcgatctcggctcactgcaagctccgcctcccgggttcatgccattctcctgcctcagcctcctgagtagctgggactacaggcgccc

SEQ ID NO: 129830 - DNA, 2422 bp, Homo sapiens
gaaatatcacaacaggacgtttcaggctatgaaaaataactgcttactaattctaacgtaagttatccagattacgagaagcatttctgccaatgctcatgtcagctaagctcagagaagttacctcatcctcagagagcaacgaatggtatggtctatgtagaaagcaaaatttgcaacggaaaaaccagagttcgtgtgcactttatgaggaagagggttaggtgcaccagacagaggagtttctcaggtttccgtgtcgcctgttctctcgaccaggtggccctctcggcgcaggcggggaccccaccctgcgggacttcggctcctccgtgcggacagggggcgcccgcagccgtgcctttcccgccaactccactagtgctccagctcgcccttgtgcgaccgcctctagggcccgggatatttcctgttccggggcgtgtgggacccggatgcaagcgtgctatataagcgttgctcaagtcccacccctttctttttgaggaagacgcggtcgtaagggctgaggatttttggtccgcacgctcctgctcctgactcaccgctgttcgctctcgccgaggaacaagtcggtcaggaagcccgcgcgcaacagccatggtgaggcggcagtcggcggcgggcggcgcaacgcagggctcgggcgccggggggaccccggtttcgagttcgtgctcctgagggcagatgccggggcgtgtaggggcggaaaggcgctcctgaaatggtggggaaacgcgggaagcttccggaagctgcctttctccagaagtggcagaccatttttggcttattgttctttttcatgtatctaataataggcttttaaggataccggaaaaacacccgtggagccggaggtggcaattcaccgaattcgaatcaccctaacaagccgcaacgtaaaatccttggaaaagggtcagtgcattcgttatgcgggggggagggggaattgggcgaaaagcgacgagctttactcgttaatgttagtgtagaaggtggactgcaagaactaaagtgacaagttacttaaaaaagtaaagcgtggcttaaaattgcttttactgtcatacagctggcgatgaggaggtacctattgtgttgagtaacggtgataattttatacgctattctgagccagcagaagtgaaggccttaagccgattttaattgtttcgattatactgagaggtcttttatttcctgtagtgtgtgctgacttgataagaggcgcaaaagaaaagaatctcaaagtgaaaggaccagttcgaatgcctaccaaggtaaagtaaatcggaggggcaggaagtaggagttgcttccggatgttgcataaattcaggttctttaaggagttcggctgccaaaattgttaacactgatgctgtctacaaacgcacatagaaatcggtggtagattgcggttcctagtaagtagctaatgtttagatatgattgttgaattattgttgctgtgttcttggtgtgctttggtgcttaacaggcgcaagctctaagggtggtgtcctagcacagtgaaaacagacctggcattttcaacccatggtacctgaaaatctattagtgtaaattggaatcataccaaagggaaactaatgaaatgattagaagtaatgattttccagatgttctagggataagtataaaacgataaacacttggtttcctttgtcttttgttacagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactattttaataaattgatgaccagttgttaacttctgttggtttttattcagaatactggcagattttaggaatataaaggtgtactatgagacttccacttttcaggtggaatatatgggtatcttagagtggtctatcctgttttcgttgtcgtttgagtcatttgaaaactggattccgttaactacataatatgtgagacctgactggttttattggacactggcagtttataactttggcatactctagataaattctgattggtatggggtgttaaggtttctggggcgtttgtaatgcacacccatggttgagaacctagtgcgctagtaggcacgtgttaaaaagctagtaactaatatttttaaattaaccaagtttaacgtccttaaaaaaggattaagtggcagaggcaggactaaaactaagttttagggttttaggaactaaaacttagtttaaaaatacttatattttcagtgttttatattttaaat

SEQ ID NO: 129831 - DNA, 2149 bp, Homo sapiens
ttttcaactacaaaaacagggaacatgtcttcatagaaagaaaattaacaatataaataaagattaacgagaaataacaaactggaggagaggatttgtacctcatattacagcaaagggtgaatccctctagtgtaaaaagagtttctggaatttgacaaggaaaagaccaacagatgaatgatcagttcacagacatagaaatatgagtgattcttaaatatatgaaaattgctaattaaaactacctttcaataccattttccattatggccaaaatacaaaaatttgacaaatataattggtgaggcatggggaccatggggaaatgcctaggcactcttggatattgctggtggaagtacagactttagggaaaataatctgggaacatctattaaaattacaaaattgctggtgtgattccatcctgtgcagctgttctcttgagcagtggtcatttatctctgtcccccttctctgccacctaagtgcgtgctgccacccgatggaagatttgatggacatggacatgagcctcctgaggccctagaactatcttttcggttgtgaactgaaggccaacaaagattatcactttaaggtggataatgatgaaaatgagcaccagttatctttaagaatggtcagtttaaggctgggcgcggtggctcatgcttgtaatcccagcactttgggaggctgaggtgggtgcatcacgaggtcaggagtttgagaccagcctggccaagatggtgaaaccccgtctctactaaaaatacaaaaattagctgggcatggtggcacatgcctgtagtcccagctacttgggaggctgaggcagcagaatcacttgaattcgggaggtggaggttgtggtgagccgagatcgtgccattgcactccagcctgggcgacaaagcgaaactctgtctaaaaaaaaaaaaagaacggtcagtttaggggctggtgcaaaggatgaattgcacattgttgaagcagaggccatgaattacgaaggcagcccaattaaagtaacactggcaactttgaaaatgtctgtacagccaacggtttcccttgggggatttgaaataacataaccagtggtcttacagttgaagtgtggttcagggccagtgcatattagtggacagcacttagtagctgtggtagaagatgcagagtcagaagatgaagaggaggaggatgtgaaactcttaagtatatctggaaagcggtctgctactggaggtggtagcaaggttccacagaaaaaagtaaaacttgctgctgatgaagatgatgatgatgatgatgataatgatgatgatgaagatgatgatgattttgatgatgagggaactgaagagaaagcaccagtgaagcaatctatacaagacactctagccaaaaaaggacaaaaattaaatcagaatggaaaagactcaaaaccatcattaacaccaagatcaaaaggacaagactccttcaaaaaacaggaaaaactcctaaaacaccaaaaggacctagttctgtagaagacatcagagcaaaaatgcaagcaagtatagaaaaagtgcattgaacagtcctgggcactactggtaaattaagcccaaagatggggagaaaggaaaaggagagaccaatatagtccatactgagtgtcatcaacaatccagactgaagtcttctattttaatcccaatccccttttctgatttgccacccatgcctcttcaggctggaaacaatctcactcttggttccctaaagcactttcttctgactgctgtgattcggtgaaccttgccctttgctttctattacttgtgcatttgcatcacctctgaccatgttttttttttttttttttttgagacagagtctcactgtctcccaggctggagtgcagtggcacgatctcggctcactgaaagctctgcctcctgggttcaccctgccattctcctgcttcagtctcccgagtagctgggactacaggcgcccgcatgcatgcccggctaattttttgtatttttagtagagacgggatttcaccatgttagccaggatggtctcgattttctgacctcgtgatccacctgcctcggtctcccaaagtgctgggattacaggcgtgagc

SEQ ID NO: 129832 - DNA, 1051 bp, Homo sapiens
tggacaaaatcattcaagacagccgcattttaatcagatcaaatttcaaaatttcaaatatctataagcattttatgttcttaaaaacatgagaaacttgcaagatatcattaaattcaaaggtttccaaaaccagtttgaaacacatttgtatgtcttaaaaccttttgtgaagtttagctgtatttagacaagtaaaattttatttacgtatctccagagtcaaaatacaaaacccaagcgatcagggcaaagtggaagcaaccaaccccaacctccccgcatggaaacagatagtgtgcgctggtcacatccagggacgtgctccatgcaatccacaaactaagatctgccccgaccatattatatggaccatataaaaattaaagtagctgtatatgtactttactgacatagaaacaagtctatgttatattgctaagtataaaattcaaattttagaatgtcaatagtataatcccactgaagtaaaaaaaaattgatatgtttttcaagtttgagtctataatctttgtatgggaatttttagtaaagcgtatatattcatctacagcttaactttttagtcttaaaaaaggcaaaagtgaaatttcgacgatgaaatccacggttgtaaccagcaataccacacttgcacggttgcaatactcgcgctcttcgcactgtaacctctggaatccactgtaacctctcgaatccgctgtcacccgagatctcttaacctggcggtcccctgccaggactcgggcggccgtcaagagtgcgcaggcgcaagcgcggccgccgtcggtggggttttatgtgctgttgagactgctgttgagcttctgggcctttttaagactgccttccaaaagacgacgtgatgactctaaagagaaaggaaaatttgttgcgtacgcagaagggcaggctgggcgcactctgagcgtctttcggggaccgacggcctcgcccacgtgcttccgggcaccagcgcgcccaaagcccgtgcactaggaaacgcacaaaagcaccagcgggcgagccc

SEQ ID NO: 129833 - DNA, 1017 bp, Homo sapiens
ttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaattatagaatggctttagataatgtagatcttcctgaaattttaatagatgatacttttctattt

SEQ ID NO: 129834 - DNA, 1998 bp, Homo sapiens
gttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgtggagaaatgtaaattgtaataatgtaaatgggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctt

SEQ ID NO: 129835 - DNA, 1044 bp, Homo sapiens
ggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagacttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactccctgttgtctggctaaaatatttgccatctttattatgagcctttaaggaaaacaaaccctaaacacaaagcatcagtatttatagcaaaaagagactctgttaggtgacatggcatttcgtgtc

SEQ ID NO: 129836 - DNA, 1463 bp, Homo sapiens
tgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggtattaaactctatttgtctttcagattatattttctcttatgttggctgtttgaagccattgtaaacgtatgtatttgtatacacatttttcagctaatttgcaaagaggaaatgttaagtagattagacattggtttagtttttagtattctaaatcacatacttttatgtgttagtgtctttggactttttaaaataaaatgcttaatgagtagaatttccatttgtagaaagaaattacaacaagaaaagggtaaggacgtttacgtgagtatattcagtcttgctcatttgcttttgtaatgatagctggaaaccagcaaaaactaaagtggcaacttaaatggctcaagttttgcagtaattaggtatattaactatcctcgtggtatatattaagttaaacagtttccattactaagggaattctgtgttagcatagtagtttagcttccatttgaaaagtgaatacatgccatttttgtcataataactacttatagattatatctgtgtttaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacacttt

SEQ ID NO: 129837 - DNA, 1028 bp, Homo sapiens
caggttaggaaatcaaataatgaaaattaaggtttgtttcctgccttggtagaatgctttataccagtttatagtgtcattactggtcacagcagagtagctgtttagatatttccaagggaagcagaggagctagcttttgaatgagaatataacagaaatagagcaagaagcccttgagatccagaaaatctaaaacaaaaagaacatatgttaccattggtaatgtcagttgcattgtgttaatgtcacttttaaacagcaaggcggatttttagaccgtttgaatagcacaaaggccttgcctgtatctacctaataaagaaagacacctgaagcaagtactgatgaacttacccatatgccttactatgttaataaagtgagtggataattgctgtattttgcctgtttagaaacagcctttacattaaaataaagttagacctattgtaacatagagttaattttacaaaaatgtaggtatttagagctcctgcgaaagtataactggaatccgtgaaagtcagtctaatagtaacttggtagtagcttgggacagcaagtgtcagtgtcagtctggtgccaaaacacaggtgatataaggaagttggttttaaaagaggttgcaggtattatttctatggtctcttaaaagtacatcacaggccaggtgtggcggctcacgcctataatcccagcatgttgagaggctgagactggaggactgcttgagccctggagttcaagaccagcctgggcaacatattgagaccctgtgtctacaaaagataaaaaataattagccaggcataatggcatgtacctgcagtcccagctactcgggaggctgaggcacttgaagatagcttgagcccagggaagtcaaggctgcagtgagccatgattgccccactgcactccagcctgggtgacagagtgagactctgtctcaaaagaaaataagtacatcactcaactagcctttataaacgttgaggaattggaactttgaggagttggttttc

SEQ ID NO: 129838 - DNA, 1034 bp, Homo sapiens
gtagctctgagaggcccccgttgtgctagtgtgcacagtatgggctgagtgctttcaccgggagcctgttgttctttgggtggctccagatgtaccctccgaaaggggcctaaaattgtcacttccataatattaataaacttaataaaattttgatcatttggtttataaacagtagccctaatatccatttcagtaggtaagtcagattttagaaataaataaatttgggaaagaagtggggagtcattcagcatcacaaattgctatttatctaggtaatactttttatttatgcatttatttggtcacgtaaatgtgcttagacctaataaacatatgtagttggtgaaaattaatgcatgactcgtaagcagagtatggaatgtaagcatgtgccatgaaactgcaattcttttatcctgtattttccatcatttacataccggttccatttagaggatagtccattttcacttttttttcatagattggccaaaatgggaaggattggattccactctcttccacgaagagtcaatgggactggctaagatcaaagtctgaggctttttccatcagtaatcaggtatgcattgaactaaaaatcactataattctatgcatgcacctttaaagtatttgactgatatgcatattatgaatgtggtcttttattagattttgagctcacaaccttatcctatagtttgaaatgcacctatgataattaatttgagttttgtaatatactaaaataaaaaggtattatcagccatgaaaaaatttcagctggtcttagaaaagtgtaatatttgaaatcagtgcaatcttcattgctcagtatgtacatccaaagataacagaattcatttgttactccatattgattatcaccaattttagtaacaatcaaatgtttgtatattgcatattggtgcacttctaataattttttttaataacttagaagttgtttttcttaactggaattctttgcccattatggttggattttataacacaatggcaaa

SEQ ID NO: 129839 - DNA, 1028 bp, Homo sapiens
ttgacatcttctgaattacttactaaaggcatcttgtaagcatacaggagaataaagctttgatgcttgatggtatttgcccttaattagcaaaatctgtttgacttttaaatatgaaataattattgatgcaggtaagtgaaaaaattcacagctcttagcaaaatgattatcagaactatggaatttaaaataagcagttttaatacaggcctgttcttttgctggcatctcataggaactgattttagtagaccctctgatgtatgactcattttggcttgttagttttttatatgagtcactgttttagaataatgtaaaacatcggaagataaatctgggtgtgtgtgcacaaacacgccatactctctctattgtttctgtatgcaaagttgccctggaaaaaattgcttcttctggtaccaacaaaaactagaagggtattctgaactgctgttcatcttagagtgatttgaaatgggtgtatgtattttctactttggttcacagttcatcagaccaaggcaaaggagaattttcgtcacttgaaaagcacaataaccaatctttgtgagttttttttttttaagtagaaaagaaaaacatgagtaccaaaccaagttttgttgcacttttcagaatagtactcctggtgctttttaagtttttcttaatcctatacaagagaatatacagataattttatctaacttttcagttaggattacataaatacaaactgtatattttttattatatcaatccaaagaataatttctaaccagtcctgctttcttttttggggggagatatttagtagaactttgaaattatttggcaactcataagaactcaaaataggttcaatttagggaaattaagaaattcaagattatgttttgggataaaataaaatgattggctgtgttattttagactgtaaaatacatagaatgggtgatttctagactattggaatatgtcacaatatacataattttaaactgtgttgaaatacttagatg

SEQ ID NO: 129840 - DNA, 1057 bp, Homo sapiens
tttcagttgggcatggtggctcacgcctgtaatcccagcactttgagaggccaagacgggtggatcacttgaggccagcagttcgagaccagcctggccaacatagcaaaacccccatctctactaaagataacaaaaaattagccgggtatgatggtacatgcctgtaatcccagctgctgcggaggctgaggcatgagaatcgcttacacctgggagttggaggtttcagtgagccgagattgcaccactgtactccatccagcctaggtgacagagtgaaaccctgtctcaaaaaaaaaaaaaaaaagaaaaggaaaagggagttttcaaaagagaaaaaaaacttttaacttaacgtggcatttttgctctataaaataaacaaccaaggaaaatatgtctgaattgggagataaaatttacttgatactccttcttcattgggttatctgttcattctctctggctactctagaaaatgagtggcctgaaaaggaacatcctgcttgtacagataagagaactgatattggggttttctgattccactttggaattcattgactttttcctgttggttcttacagacaaaaagttatgccatttttcccctcacttctcacttctcaattagtttttattatctgtatactaaatataagacatttctaaacatcagtaaggctaatttttatggtaaatttcaaaaagatgtcctagaactatattttaatgaattgctcaaaatgagttaaaaatataaaacgcagtaattcaaaaagggcatccttatttttgattaactttagttaactatgacatctaatttaggaaagtaaatagtgtagttttccacaatccagttataaaatgcatttttggggacctgctgtaaactcaggcgagttaggtgcatgtcttggctatgtctcctgcttcacagtagttgctccagctcctttctgttcccctctgtagggaccagcagccccaactgagagtctcgtccttcctgccccataccaaggactaatgcaggcatcaggcgtgtttt

SEQ ID NO: 129841 - DNA, 1094 bp, Homo sapiens
tgatcaaatagaattggtcaaggaatatagataacaaacctcttctaattgttccagccaggagagtacatggggtcctctggaggcagaggagagagcggctacccttgacatgatggttttgcctagaactgatcctgtttacccttaactgtgtgggaataaatagaaatagttgtttctagaagtgattttatcctggacatgcacatgagcataacttagggaggacagatggatggtatgtgcagacctgaaccaggccatgaattctgttttcattacattttttagtactactaaagcatcagcacatacacaacatttatgccatagcacaagcctgtctttaaagtacactttactttgagatggcttaaaactaatttctgcttgagcttttatagataagtacaacttatatttatagctaagtaaaactttctttagcacttttcttataaagtgtctgatgtctgcctttttgtttgaatttataggcagattcagtatgggtgcttgacagttcagacatgaaatctggattattctgtatttgcgattttaatagcattaggcaatttactatacatgaatggaggcatgttctctagatatttaggttccttcattgtgaacatttttatagttggtgtcaaacatttttgttgtacccccagaaacttaatcagttactggtaataagatcaataacttaccacaatttgggatacatacagttttcagattgagctgacctgtgggctacctactttgtaatcagaccaagatcaccaatattttgggactgttttatagaaaaaaaaaaaagcacaggaaattatctaaaaatagagtattgattaagcagtcttactttgcattcagatataattgtccttctttgctctctgaggcatcattgcttcccttttgcacaatttctttttcatttcctctttgaaaatactaatggccccatgtgaaaaaaatgaaaatatctcagtgttgtaccacccattgtatttttaagtctttttattttgataaaaatacacaatcatagggaaccccccacccccaccccaaatagc

SEQ ID NO: 129842 - DNA, 1777 bp, Homo sapiens
ctcagactggaaccatacataataggtgttggtaatgtttattccatcagtgtcagatattcgtcttaggagagtggtaaccatgtataattgagccttgaccctctgttgtagggaaatgaagcaggtgattttctgcatagaacttgtggcttctttttctctcttagttaatatccctagagatcagtcttcataacctgcaccaacagacggatgcaaacattgaatacttcagaatacattttgcattttctttgtatgtcgttgaggatggacatgacctgggaatttaattgaaaacaagcaataatcgcatcataaagactaattcaagagctcagaaattgtccctggctccttattctgcctctgcttgagggtgctcagtggcttgcacccttctctgtggacaggtggcctggtctctgactgaggaaagcactcatggggcaagatttctcccatagcaattgttaaggacaagatagacaccacaaaaggtttttctgaaaactgtgttgcagagaagataatgggtgtgtttagaacataaataaaataagcagcagttttgagaaatgacagtaaacttgaaataatttatcaaaaatgtgaataatctagataactgtgattcgggaggaaatatataaatctagggatattaatttgtgtacttttcatttttccatgtactatacatttttaacaggatttaagatacatttttcaataaagtgcaaagaatgtgaataaatgataatgaattaaaagcagtttggttcatatgccattaaccagattggcctgacttttggaatttaaaactaactcttcttttctttttaggttgcctcttggtgctgccttggccgtatttggcacccagaatgcttcattctgtgacggtctattaataaggttgccttgctagagtttggagcagggcctcaggtaggtggcttttatcattatatggcatgactttcaaagtgattaattattccagttcctaaatactataagatataatattaaaagctttgaaaagcatgccacataataagcatgccacttacaatcttagggtctatcagtatgtactgtgatggggacttcagtaataattatggtcgaatgggaggcttgaaatactagcaaggagcagtcttcctcactctttgcacaaaacacatagctgctgtaaaaacttaatttgttcctgttccccagatagcccacagatgtactcttaagctcttctttctctaaatcttgcacagtgatacagtatcccatgttgcccttatatcttttttttttttttttttttttttttgtctcctgggcgggatcctattacctatgggcaggtggagagggggattagacttgctcacagggatggggcagatgctagaataaggaacccaatgcaacaatagcaatttgccagcattgttgggaagaggacacacacaagctatctagatttcccagcctgtaggcgcagctcagtgtcacagaatcaaggtgtagcaatacttggaaatccaggcacacgtggatttggtaccaggtaagtctgtcagtacgaccttcaagatagggtagaggttgagaggccaggacccccagccctaggacggggagactggaaaaaaaaacaatggtggctgtgacagataccaggggatgggctcctgaactcttcactgatggcagatgggggaaaggaggccttgggcagggtttcacaagatacatcaacaga

SEQ ID NO: 129843 - DNA, 1015 bp, Homo sapiens
aaacatcctcttgttgaatatcatttgcttatcacccaatgagctatccttatttacacattctcattctccctcctcccattctctcactccctcccgccccacccaataacttctcttgctgaagtttggtgtcctcatgcctaagtggtgaacctatgggccagttctgtagctcttagcatttttatctttgtggtttccgccacatttttcttccttctccttgaagttctatctctggtctttctccccttaaattagctgattttgcctcatagaggtgatctttaggctctatcagcaattaaccagtaacttggcttgaatctgtctctgtaagagttggctgtacaactatcattgtctttcttcctcatatctctttttgttaatactattaggcacataagtggactttcttctagtaaatcttatttttgctggttttcatctccgctttggataactccaacacatatcttctgtgtctcattcaaacaagcacttcctttcctccctctcccgtcctacctccccaagcatttgctgttctcagtgctttcaatccatctcataatgagtacaagagtgtgaacagtccagcccattgggcacttttctcatctgaatccgtacagcatgtataaattacacttcacggtagccagaaggtcatcttagaatctaatcatctgtggttctaatctctgacttcttttttggcagtcatgccctcccctacaaccacacacacacttttttctttgtctttcttaattgtacattttttaaggcaaaaatcaccaaatatccatagtactcttttccttttctgaccttctgtggtacttttttataccatataatattgtttttaaatgttgatttgtcactctgataccacgttatggcagatcttatttaacatttatatttcttaacttgacaaaaggtatatattctttttttatatacatactttaagttctgggatacatgtgcagaacgtgca

SEQ ID NO: 129844 - DNA, 1483 bp, Homo sapiens
acaaataatttttaaagtttaagccccttctgacatgacacgtccatggctccttcacccttcttgtctcctgcagagctccagtctgcctctcttgctcttagctccaaaaacagtgaatcccctgaagttacctagacccaccatacagtttgtgactccctctacctggagtacctgcccatgcctggctaatacttgttcttttgttaccttggcttctgtgttacttcatttgttttattgaattaatcaaaggcaagcctatcaattagcatggcacttctttcttttaaagcaactgctaatgaacattttttaaaaggctatgcagaggctgaattgaaacacttcagggggtacttcctttggtatttgataaatggaacgtatcccagaactatttatcatccgtaggtctcagttccagttagatgtattcttggagactttaaatcatgtagtgtgatatgccagcccataaagcaacaggtgaaccgaactggcttcctccaagtttgacagctgagaatgtggctctaaaacctgcctagatatatatccttttctagtaaggtctgagtgcaactcacatttaagccaatattcctttcctcttttttccctccctctgaatgggaaggagagattttagtcattttgagtcattgcacttaaaggattttagtttatcagtttgcagaaagttttattttcgtacttctgtaaatttatgtgatgatgagtttctcatcattttgttttttataatacaaaaactctgccattttattgttttttaacagttttggggggtataattgatattgtataaactgcccatatgtgaagggtgcttgcagttttcacatatatatgcatacgtccctgaaaccatcaccattgtcaacatagtgagcatatccgtcatttctaaaagtttgctcatggccttttgtgatggatccctccctatcctaccttctgtccctagacaacctctgatctgcttcctgtcctctatggataagcttgcatttcctagacatttgtatagatggaatcgtgcagtatgtactctttgttttgcccaacttctttcattcagcctgcttattttgaggttcatccatgttactgtatgtatcaatagcttattcctttttgctgctgattagtagcccattataggaatatactacaacttgttcatttgttttggggtttttgtttttgtttttctgagacacagtcatactctgtcacccagactggagtgcagtggcatgatcttggctcactgcaacctccgactctcaggttcaagcatcccaggttcaagcctcccaagttcaagtgattctcttgcctcagcctctggagtagctgagattacaggcgcctgccaccacaaccggctaatttttgtattttcagtagggatggggtttcaccatgttgcccaggctggactcgaactcct

SEQ ID NO: 129845 - DNA, 1406 bp, Homo sapiens
catgtagctattttctctgatttttagctattataatattttcataggtgcattatcatcttttaccaaccaaagttaagccataaacaggggtcagtccattgctggatagtcaataattacatattacccaagttacttttcaatttaacatgcaaactgactgctggcttccggtggatcagttttactttagctgtgatttgggtttatgtatgaccatggccaccataaaatttaaggtacaccctgcctatgccacagagatgagtaagatcagaagtatgctacttcaccaaatatcacttttaatacaaatctcattatatatgagccttgttctcaggaactattcccattgtttgtccttcaaagattccattgactgtgattccgtataagagcctgtgcccaaaaaaaacaaacccttattttttaaatccatatcaggccagggcagcacttacttctgagtaacactctgaatataacagctttgcattttgagccctcagaactatgctagagactttacatacatcactttaattcacacactactgcaaggtagatgtttttcccatcctacagaggaaaatgctgaagagagactaaatacatcattgaaagtagttacacagatagtgaaggtcagacaggattcaagcctagttctgattcttgcctttgtctctctgctgctattcccctgcactgctttaggttctgaatcagggcaaggattcatgttttcgggccctctccaagtcagagttttaaagtagcattgcaaaggtgatttccagaactatactgcctgagatgatggaaagaccttctctctgtaacacatctgtgtatcgcagtagggaaggagaccaggggaatgggggcaaactgaggagtgtatcatcatgcagtgtaggggccaccccagatcctggtgctgaagcttcaagaaggaggaggctgggactttgcattgatgggttttaaccccattttgttaattaactgtcagcaaacactgcaaaggcttaagtgagtttatagtttaggaaggtcaggccaggcacagtggcttatgcctgtaatcccaacactttgggaggctgaggcaggtggattacctgaggtcaggagttcgagaccagcctgaccaacatggtgaaaccccatctctattaaaaatacaaaattagccaggcgtggtagagcatgcctgtaatcccagctactcaggaggctgaggcaggagaatcacttgaatacgggaggcggaggttgcaatgagctaagatcgcgccattgcactccagcctgagcaacaagagcgaaactcggtctcaaaataatgtaataatagtaatttaagaaggtcacttttttttttttttttaatgcta

SEQ ID NO: 129846 - DNA, 1059 bp, Homo sapiens
catgataccttgatagttaaattaaatgataaggatttgtttatctgtaagtttgttcttatatcccttacccggagctctgtgcagatagggggtctatactggtctgttggggaagacgaactttctggacatgaccacaagatggcaacagtgactgcagcgtcctgatatctgtagagggtgggccaagtcaagaaagagaacaatgtcttcttgattgcaggagactcaagggaaatccaagagaattttcaaatttaaagcattgtgtcaatgcccagttattcacagaggtgagcaaatagattggacaactgttttcttccgtgggttcatttggccaacagcatggaaagctctcctcctgcccttcctctcatcttccttttattcattcagcacatacttgagtttcccctgtgtgcatccactgttctaggtactagacatacagaactggtcagtaaaaggcaggatcctgttctgatagagcttacattttgtggccttcactgggacccagtggaagatattgcagacagaaccaagagtttccttgctgttttttgttacttctggagtcatcttttcccctttgccccagcatggattgatccatagttttatattatccccacacgtttcatttcaacaagcaaaggcaccactggtcagcgaatcacagtgactaattttgttttagccatgattattggtggccttctcccctgcttcccagttacccagttaatcaagaatcgactgtgttcttcttacagttgaagatatggaagttaaagaaaggtaaaaaatcatgtctaatgttgcacaggtggatacatgagaaagtacatactcaggtcttggtatcattcattcctttctgatcattgtcagtaaagttttttaaagcaaaagaaagcaaacaagtccagcattgtgataggtgcctatagacaaatttgacatacactgtgtctgtgctaaaggtgacttataaggtggacctaatgtaagtttacttaaagttgcatgtagtgtttagaaacatttctt

SEQ ID NO: 129847 - DNA, 1573 bp, Homo sapiens
ccacagtgtgtgctgggaatttgagatgactacctaaaaaatgtgtgtgcatgtgtagaatgaatgaacttatgcagtatgtcctaggttaataggacaagaaatttgcttaaaatatttccttacatttaaaagtggaatcttcttaatctaaaaacatagaaaacctagcaatgtgaaggtgttaggaagcaaaaattttttttggtgccttttaaaaataagaattttaaacaatgaaagtatgtaacaataagtatggactaaaatgtccaaaattcatggtaaagaatttggtagataagaatttcagagtaaaataacaattgtggtaaattaaaaattcatcttatgtgaataaataataaccaactacaaggcaaaagttgtaattttgccttaaaaattagataattggggagatctaccaaagaatatttttaataccaattgctggtttcataatgacctttttaaaatagatccccaaagcctgccttccttctcttcttagatttgaattaaactaaattaaattctaagaataatttgtaatggttattcagaattttttttaaataagaaaaattactttttgctatttttataaaatattttgaagattgttttgaatgtgtgtcttcgtgaagtgtcctgagaaagttagaaattattgaaaatcattttcttcattgttcatcagaaagtttaaaactttaagttaatgaaataaattttaaaacctcagtctaagaatagtttgcttcatggacttttttagagcaatttaaataatttgttacagacttagtcacatttaaaaagcctttcacaagataatgataacatttcaccaacaaagctcctaatttctggtatgtttttaggtctatgctgccgattaaaggaattttttctttcccgtttattaattagcaagtgcttttctgaaagagtatctaaacttttggtataatcttctgggatagaagttgcctttactattagaaaatattttgagagaggagggggcatcttttcttaaaaggcaacagaatcctttacagattgtgaaggatgtgccattagagagtcttgaactcttcttttttgagaatgagagcccccttttagcctttcactcattaaatatttgaattattattgcagaccaatattggaattgcacatatatatattgattgtgatttcctatctttttgtttctgaatgtgataatattctcagaataagtgctatatgttaaaggctgccatatcagtttttaaaaaattatctctctttaaccagtggttagacattagagccctttaactttaaaatacatttttggagactgttaaactagaaatcaattagcaaataaggaatttagcccctttggctcaaaggcaaaattggaaggtgtcataatcaattttattcctttgaagatacattagtaaatatttattgaattgttcttgatcatgagaattttaagaaattaaacctggaaacttaagatagttcaagtgtacagtttcaaaataacaccggttggattttagtc

SEQ ID NO: 129848 - DNA, 1109 bp, Homo sapiens
gttctttggaaaattaagatatataaaaaattaccagttacacacatccccaaggaaaaaaaagttttactgaagaaacttacttacattgcttggaatacatattctttttggtgtgtttgcaagtgtataagaaataaatattaattttttctctttatattgataacatcttagattctttaattatttgagtaagggaagagtttcaaaaggaggaaactgaatctgttcaacaaaatccaaggtagtgaatatgatcaaggtaaaagggctataaatcatcccttgagccatttttaaatgtcttaagaacctgataaacaccttttctgaaacattgaatactttgaaactatatcagtcacttctgaaaaacaaaggtagacctttagtttctttagttctaccaggaattaatataggtagcatatttaaccaattagtaagtgtttaggtagtcatggaaaagtatttacaagtaagtaaaatatgaatgcagggtaaatcagattgattagctgtaaagttaacctgattttagaattcatgcatgggaattcttttctattttaccgtaagactactttggaggtaactaatttttgctttttgtattttattgcctaaattttttgaaatgctcaaacctaaaatccactgttactacttttcatttatgttagattaacttttatatcttatttgcaaatttcattgtaaaatttgagaaattaaattaagatttttagattataacattttataaaagtattgagctattaacatttgaagttgtaagaaatgtatgtgtatgaaagcctagtagaaattattacagggacataatttgatttttacttttaaatcgattagtctgctgtccagaggtttgcattatactcactgtttatagctatccctgcctcctctttacagggtggtactgacaaggatatggtggtgtggaacctccaagggcacttgggtatttttgttttctgattttgtgtatgtattggtgtttgttgttaagaattttgctcttaaaaaaaaatgcttatcagaacatttaaaaattttataaaacagaaatatcttattttttt

SEQ ID NO: 129849 - DNA, 1978 bp, Homo sapiens
cttttggggagggatgtggagttgcttggtttcccccttcctgacatgtttgcttcacctgttcatccttcctaaagaatgttaagctgaggttttctggttttatgtgtataaaaggatgatgtctcttgcatcacattgatgttaatgggaaagtgctgctgatgttggttccacgtgggatatgggacagagcagggcattttaaagggacagcttctcttttcttatggttttcatcacctacacagaatcactgtctgaggaccaaaagcagaggtgctgggagggtgtggtgatggaagagccttccctttctgttactccagtgcacccacccataggagtgatggagggacaggagggataaacagcctcaaccgaagatggatatgtgtatagtttgtatccaaactgttcctttgtgtaacaagccctcccaggaacttttcatgttacattgctttgctttggaagctgattttggaaggaattgtggaaaaatggaaatagtttaaggtgtgtggtgtaatggtatagcattattgaacagttatgaattctgtgcagtgagatcaaagagctgtgtatgcccataatgtgattttacagccattttgtaaaaactgtaaaataccttaatattcaatttggcttaaggtacattgaggacttctggttgaaaattacagagtggtgaagattctttaaaattgtaagcagtaggcatttctttagggggaaggaaagcacacacaccaacaccatggaaaagtttacacatccatttttaaagtccatcctatgcatgggttgtaactttgcgcctttgaaatgaaaagatttttaaaatcctgagccctgtgagttttcattttctaagttgaatttatttgtgttatttaacagaaagtgtttactgaccataaactactatcggctcttatgttttagatttccacgatattttcaaaatttaaaatgtgtaaattgttagctgtactataatggggattaaggttaatcttcagtagaaattacttgtgttccattttccacaggtatatggagtttctgaaataaatccttatttcctcttgtttttattatttatagacatggattaaaattagagctgaatttttagacttcttatatagaatgttttttcttgccctactgtataaacaagttattatttttgtagtctattgtatgttaacttgtgtttacaactgagttcttccaactttctgtaaatacctctatacaacatcacatcagtaacgtgtttgagtacatcatcttgtggtttctgattttggaagcaattacaactttctaagaactcattaaaagattaatctcatcacccacagttaaatcaaaattgattggaaaaggattaagctatcaatagagaagggaaactcctccatgcccaatgatcttctgtccagaggtttcagaatgccattaagacttacaaagccttttcattttatcttacgttttcattgtattttggctcaagacagttacattgactataagtagtcagaattatgctgtgcatttaaaataaatgagacttagatcttgaataattgccactttgacaaaccagatactaatatcaataaattcaatctctataaaaaaatgaaggaattcaagttatattagattatcgtgttattcaggttgtttggacactatgactggtttattgtcaatctaaataaaagtgctggtattgtgattttttttcttcctctcatatagggtggtgtaaaactttcttcatgtttgtattttatgcaactagctacttgtctgttcagaaaacgcactcagagtgcaccaatctaaaatctgtaatcgcttagagagtcttatttagatggggcacagcacaatatttaatttgaagtgattgtactgagcttttgtgatgccttagaaatactacctgttg

SEQ ID NO: 129850 - DNA, 1787 bp, Homo sapiens
ggattaattgatcacagttatttggctcaaattcctgtgatcacatattcagaaaactggcccacattataaaaaggaagatgttagcctgagcagagtgcatactgggatagctggcgagattgtccagtttttattagtctacccatcaaaatgaacacaaatgaactatttcacattatttgcttctggggaagcagcttttgtttgtttgtttgtttgcttttagatcctgttctaccttttaaatgatgcctctcttatatctgtaaggaatctgatgcttccaccagatgtctggatgaaaataactatgacagggaaaggtgttccacttacttcttgaggtacaaaaactgccggagattctgggtaagcctagattggttagctttgtgttaaaacccatctcctagggttgaaactgaagcctaaaattagtcagtacccacaatcctttcccactgatggctgtagggaaacttaacttttcaactttatcctctgtgtgctactttagccgtgaaagatccttgagagctcttgttagctgcctcgtcgtcctctaagctataagaatgcagttttaatataggtgggtcttcttagacatttaagtatctgcagccctaaaacaatgtctttgttataaatttagttttcctggagatgaacagaatgtttaacttcccttgtcataacacatcatgttaggcttcaatttctgcctttttctctctcactgccatccgtggaagttaaaatggtccatttttctgaaaacattggtatataatttctgtttccttgaaccacgggatccagctatttcctttcgctttgctaaatgcactgttggttttatttcacgattattcagtagctcttcttgacagactgtatatacttttgtactttgtactttgtatattctcatcccaattgctgttaatgtattcctgtgggaatgagtacttctatttaattgttactaatttaaatacgtttatctggagtcctataattaggttttgggattttttttttaaaaaaaacttggtttttagaatttcctttttgaggaagcaatagcaaattactggcaaatgattagcatttaatacatgactgattttggtttcttcttttttattttaatgcctgtacacagaattctatcgtgatgcagagaagaaagaacggagtgaagccatttatgcctacggcagcagaaagagatgaaatcttgagagcagtgggaaatatgccctattgaatgtttgcattaaaagtgtttatataacttagaagcagatgaatatttctaataaatgattgctgtaatatttaagactgtacacccctcacccagacagaccttaagttcttcaagtggagacagtgaagtcaccccgtgtcctttttgcttgctctcagtgccatgccgatggtatgttgctgttggctgtgttgtggcatgagtttgcatgactttctggaggcatggagttaggtaaggctacatgagaaattgagcttttccactgggttttgaaagaagagtatgatgtgaacaagtaaagactgaatggggctgagatgaaggcaatgtttccaaggaaaggaaatgttatgagcaagagtgtgaggcaagagaagctggaaccacattcagagagtatcctgtagattgctccacctagaatctcaggtgggtggagcagtggtgggagaagactggaaaggtaagttgaaggtaaggaatgtgtggtgggcctcagatccca

SEQ ID NO: 129851 - DNA, 1066 bp, Homo sapiens
ttttttataaagtactttcaatgacaaactaattgttttgggatttttaatcagcaaatccttaacatatatgtaatgactctgtccaggcaaaacttgttcagtttaaaatttgtcttcagtaattccctaattcctagtttacctctttacacctaccctgaaaacttcagtatactcttcttataacctggttgttcaagatctcatggcaccacttttgagtggcagtcttgggagtttttctcatcaccactgttaaatttgcctctgttgtatttatttccctttccaagattctactttgggagaggtgaagctaattaatttgataaattgtgtcagtgggcgccatgagaaattttggcgtcggcaagcctttgatatcaattatcaactgacaaaatatagagaaggcattttgctgtgttcatgtgcatctctgtcctgcaggaaccatcttattacagattctcagtgggttgggggaggatggtgcactgtgtctgtagcacggaaaagcatcttttttttttttcctttttgagaatcggatctagtatttgtaagctcctggaggacataatatcattcacggttatagccataatgcctggtctgcttctattatatagtaaatggtcaacaaatgtgtgtgtttgaggaggtggtggcttttaaaattgaccacactgaaaaacatgcaggttcaaacaatgcaaaagggtatacagtgtacaataaatctgccccagaagcagccggtgtcaagttttcaagattttccatgcatataaaagcttatctattacataaaaagaacatcatagtacgtgagctgtaggataccttgcttttttcacttaatgatattaagtgatattaagtttggaatgattttctatctgtgattatagatttactttatttctttcagtggcttcagtttctgttttatgatataccattattgaagcaatctcctgttgatgagtgtgctataaacaaggttgcaacatctttgttcttgggtctttgtgcgtgtttttatctgtaaaattgctaa

SEQ ID NO: 129852 - DNA, 1050 bp, Homo sapiens
attaatttttaacaacaagatcacttagatacaactttagaatggaaatattattgctccttaaatatcttaagcttctaatggtgtttttatttgttcatcatatgtcaggaataaaataagacattttaattattaatggatcatctttagattcttacgtagttatatatttaatcttctcagacacgaagcttaaatactcattaagagcttactaaatacgtgccttcaagattttgttgcactaataaaatgctttctttcattgtgaaaataatatatgtgtatttaacatcacttaatataccagtatatttttaataataccaagaaagacttcagagggctgtaaaaaactcctgaaatgctaagaaatatcatgcatgttttgtaaatgttcacatattagtactctctttatcatacccaagtgatgtgttaaatagaaaaaaacttaagatcattcgaatgtatagacttacaatgattttatatttaatatttatataagaaaaaggaaagaatgtatgctgatgattcctattttaccaaacaccatgatttccattgaaaaatactttttctgtacaacagtgactaaatgtgaagaaaataaacatgaataatttgtgcacttgcatttgtataattttatatctgatctcatcattatagacattttgttcaaaataataaagtctgttgtatccagcaaagaaaaaaggaaaaaaacaaaagatctgtacttacaacaaattaacaaattaataagaatgcaaataattcatcagatttaaattgagtttttaggatgtgtttataaactttttttaaattgttgtttttctttgaagattgaaagtatttgcaggaatactcgataccattttaggtaaaatattaacacaagaaagcaaatgacccttaggttattaatattgattttatctctaagacaagaagataaaaggaattttgaggaaatatccctgattaggtaaataaaaatttctcctttttggttagaaaaatctcaaacaaaattat

SEQ ID NO: 129853 - DNA, 1069 bp, Homo sapiens
ccacctttcagatcctaggggactttgtctcctctgcgaagtttttccttacttctgcagacagctgcttgcttcttgctctaaaattgctaatgcatgggctcatgctgctgtcaccttgctcactggaaggctggactgccttttttatgtctgtattctttgccctcctctcattctttggtacttcgtagatgcccaatttccgttcattgaataaatgaatccctcacttggctcaagttaaaatcaatcatcttacctggactgataaacatttcagctccctggagctcctcagtcataagtatattgaggtagcaggttacctagatgaagacttacaaagcaagaccaattatctcccactccttccctgctttccttccttttatcattcttctcgtagagagaagaggacctggaaaagactagcattttggagactgggaatggtgactgggaggccacaagagggctgcctgaagaatgtgctggaatgagggaaagagattgtgtgagagggtttgggctaccccatcctccagggctcattcgaaagcactgttcagtcactagcgtttttctacttaatcaatggtgaatagctttccacaggatttcacttttgcaacatgattggtaatggctacatagtgttctttagatgacgtcttataatttaactttagatgatgtcttataatttaattaacttcccctatttttgggaagtcagactgttgtttcttttgcacatctaaaaaaggaacacctctcaggtctgactccctcctgaggacagagatctggctgtgcccttgtctcttgcaaggaaatctacatgttgctaggctgttttgcacccccagcctgtcctctgggaataggaacgagcctgctcactggcctggatattctgtcgtaagagtcattttttttggctttgtaacacataagtatttcaaaagccactcttgtggccttctattacactatgaaaaactgagggtccacatttgccttgaatgcagacctccctgccctgctggggatgtctctctcattt

SEQ ID NO: 129854 - DNA, 1045 bp, Homo sapiens
ttatttgtccacaaaaagaatgaagtactgatatgtactacaacatggataaagcctgaaacattatgctaagtgtgagaagccagtcaccaaagaccatatgattgcattatgtaaaatattcagaacaggcaaataggtagacagaaagtaaattagtgattgcctatggctgggtgagtgtagagaggaggactaattattagtgggtatgaggtcttttatggggctaatgaaaatgttttgaaattagattgtggtgatggctgtccaactctgggaacataatagaatccattgaatgttacatttaagtgcatggatttttgggatttgtgaatgttatctcagaaaatctgtttttttaaaaaaacaaggaagtcaagatgtacagacacatggttaggcacatagccaaggctgggcaaagaaggcaaagcaaaggcagcatcttctaggagagggtagtggagctgcaacctagagtgattaggagttagcctgggtaaggtgaagaaagaatgggtatagaattgtaggcagaagagacagcaagtgcaaagccagagataagaggtggcacagcatgtctagcttatggtaggctgggtatgtgcatagtatagagacacggcttgtgggtggcaataagtaaagttgaagggataaagaaggacctgatctcaaagggctgctaccatgctaaggatttaggactttagccagaaagcactgctgagctgttaaaaaattttaagcagggaaatagcatattagatttttgagacttagaatggtcgcttttgtagcaggactgaagccaatcaagcaggaggcagggagacaagtagggagctgcgctgtggtctgggaggggcttgagtaaagcatgacccaaaggtcttcaaatgaacatgtgcttcagtagagcctctgcctcacctgggtccatgctgagaccaattcctgacacctgaagttcaaccaaaaaattgaaatactcaattgttacatttaaatacaatgaatactgtcttggagatgt

SEQ ID NO: 129855 - DNA, 1038 bp, Homo sapiens
aagaaatcatgtcctttgcagcaacacagatgcagctggaggccattatcctaagcaagttaatgcaggtacaaaaaaccaaataccacatgttcttagttataagtggaagctaaacactgggtacacattgaacataaagatgggaacaatagacgctgcagaacactagatgggggaggataagaggggagtaggggatgaaaaactacctgttggacactatgcccactacctgggtgccaggatcatttataccccaaacctcagtgtcacgaaataaactcatgtaacaaacctgcacatgtaccttctaaatctaaaataaaatttgaaattatgaagaaaagtaagacttgacttcagtaagagaggaatttttccacctgtgctcaagatactctaccacaaattttttcaggaaagcgagtccttgctatcagtttttgttggaatagaatctaaagctcatgatccaaagactagagagactcagtcaagttatctcaagcaatgggagcaggaggatggttaatgggagatgatatgagcacaggaccaaggaaatcccaaacaacaaggtcctaggaaaagcacaccatggctctacattcaactgctccactgtcatgggcctcagctacactctaatgagatggctcaaattctcagcctctatccacagcctgcatctggttttcatggtttctacttcctcatcacttcagcttccacatgacaacttctctagttcccgtctatatcataggctcttcttgctatcatgctaacttctcgtctattttttctctttaatttgaattattgaaagaaaaaatgtatttggttttgctaatcattctctaccaggtcccatcttgtttttcaggcatactctactgacagccagcccttgtgtgagaagtctatttctggtacactcaacttgactctgggtgatgggaagtaagggttccctggcctttatagggctttctttttagtagagggtggagattatttgacttggaatggagt

SEQ ID NO: 129856 - DNA, 3594 bp, Homo sapiens
ttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttagtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaagagatggtgtgctgcatctgcttttttttgcgccccccgcccccccacctttttttctcattgcggtaaaacacacataaaaatttaccattttaaccatttttaagtgtacagtttagtggcagtcagtacatttacagttttatgcaaccacctggaaccatttccagaacctattcatcatttctaaacaaactatactcattaaatagtaactcttcattctccaccatcctcgccaaccactgctaaaatccctgtgcccacccctgagccaactcctggtaactcttcagctttctgtctctatgagttcatctgattttgaactcttaagtcatctgtttgagaacagatgtacatgacatacatataaaactaacttgaatcctttctgagatttttaaaaagtaagatggaggataaaaaaagaacaaaagacaggaaaaaattgtagaaaggtggtagtgttattg

SEQ ID NO: 129857 - DNA, 2299 bp, Homo sapiens
aaaaataaataaataaataaaaataaacaataagttactttgcaatgtatttttgttctgagtttaatgtttatacagttactttaaaatttttttaatttgaaataattttaaacttaagcagttgcagagactgcagcaagctcctgcacactccatcctgctattttaacaggatacttaatcaaaaaagtatgctactttcttaaaattttttgaataataacctaaattctttgtttatcttttaggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaag

SEQ ID NO: 129858 - DNA, 1054 bp, Homo sapiens
tactctgaaaaaaaaagctttctgttttgggggaaaatacaaataattttttagaagagagctattttgtcagtcatacatagcactttgggttctgaagaatataacctttagttttaaagcttcagtgccattaatggatattatatttgcttttcagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggtatgttcctcttcctgtgtggtccctggagaatgttcctggcatggtcaaggctatgttaggagactaatttgcttgtccatgcttgggaggaaagtgaggaggagtggtgtactttcaagacaggcttggtctcctgtttggtaacctcgagggtgggattttagtcactctgcccttcttattagaaagaagcagtctcacaacagtggtttctctttcttgaatacacaaaagcatattcccattagatctaccactaattgctttttatgcagtctgatttcaaaataattgtcttacttaactgtgggaatatcaaggagaggaagaaagatcaagcacttaagatgcttcatatggcagaaagacgccaggagtcatcataagtattattagaaaggctaatccctgagtcacttttaacacccctgaactctttaacctgcatacctgggatgagcaagagaggctagtgcgcacccaccttatcgtatattctctactattgtattatagtcaacctagttttttggaaaagaaaccgataataaaatttgaagcctcatgagccatatatatacagtctctgttgcatactattatttgattttctttaatgaacttttgaacatattttttaaagattctcatcttaaccctgtaagaacaggccatgacccggatttagcttgaggggctgtttgtcaactcctgttatgagtactgtct

SEQ ID NO: 129859 - DNA, 1010 bp, Homo sapiens
actggctacacaggacttcatttgatccttaacagcaactttaagaagtaaattttatttctgcctactatacaaacgggaaatctgaggctcgtgacactccagcttatatgaactatcccacattttagctagatttttagaaggctatttaaaacttataattgtagaagcttaaaagcagtaatagtgaaatacagcaagcagagttgatttttctttttttaagtaaaaacaaaagtatcttaaatgttgaaaacacatctgtatgtgtgtgcattctcatttattagcaaacaataagggaatggctgccaagggcagtgagctgcattttattaacataaaagctaagcttttggaattgcagatgttgaagtctctggcttaatataaaacaacttcttgttttcttgtgactatttgaatgtttgcatgtgcttctgtagtattcatgttgggtcatgactgaaggaatagaagaggtttgtgatcatttatacagtgtcaaagtagggatggtgtcatgttgagcgatctccttatacccctgtgttataggctagaggccaaatattgtagccaactaagtggagaatcaacctaaaaggagtctttctccttttttgccttcccctctcctaatgcccagaagtacagtcttaaatccctggttaattttgaagcctcaccccaaatttcttggtaagaaacttaaattatatcccacttagtttacttcctagtggaaaaagaccattgagaagcaacagatacttctttcttttatcctagtgccctatgtaaatgtagaaagatctgttttctcccactactttcctatgtagagtctgaagtctgagctttcgtatgtaatgttcactcctcagtaaaaggatataccaggggttatcctagagcactcaactggagacagttttgtcccctaactgacatttgacaacgtcggaagacatttttgattgtcacaaccaggggtgggatgctac

SEQ ID NO: 129860 - DNA, 1035 bp, Homo sapiens
ctgggctttcctttcctggacaccacaccaggcatttccaggatcattattcactgaatcacctcagcagtcccctggggcaggtctctttgatgcctgttctacaagtaaataaacagtggcttagagaggttgagctacttgctcagtgtcacatagcaagggtggacagagttaggagggtcaatcgcaaacccacctaaatggaattcagtccacacctttcctaccactcctcactatgctgacccttagaattttggttcacaggggtcaccatcagtctctttatcccgaggggaacaggctgtgatggctgctgaggcaacctgcatttctgtcccccacagctggccatgaggggacagcccttggagaggccttggggaaggccaggttatccaggtccagaaaagagccagccatggactctgtgactcagcctagggacgaaggacccttaagggtctcactgacacaaggctgctggcggagtacctggaaaggatgaaagttcagcagctctcaggtggccacatctgtgccccaacactgtctgaaaaagatgtggaacccaagggggcaaactccaggaataaaattacacttcgcagcaggtgggggcataatattcagaactgaccgttccttttatttgtcccaaatatgacagaaaattctactttaaatgactgccactggggcatatttaatccattcttcatgtattgaccatcagagtgcagtgacctggcacgaggcacccacttgaggcactagagcttcagagaaacaggggagacttctgtccccagggagctctcgggctatagggagacagggacagacacgccagcagtcattctgaaacagcatccgtgttgaagatatagccctgcacgagatatcatgggaccctgatggggaaatttagcccaggaaatccacacaggtttcctggaggtggtgatgcatgagttagtatttgtccagctatgaaaggagagcccagatgagaacaagaggcaggaaaca

SEQ ID NO: 129861 - DNA, 1090 bp, Homo sapiens
taaatttttcgtcttcagtagaaatttctaaacatatattgatgaaaaaataggtggtgggaactttgaggactgatccaaatgtcatacatttcatatcaagccagatcagtaacagttggtaccaagatgccagtttgattgaggacataagttatattcagcctatcatttggtttccaggactccagtctccgagttactcttatgcagttcaaagagaaagttgttcagaagagctgttatggtgtttaaagagactcactgtaaggaaagccaggagatggctggccagaattataaatgaaaaaaaaaaaatggtaaatgtgacttggcaggaaatgcctggaaaatgtgaagtgaggagggagtgaggaggcagtgtcaaagcaaaggcagtatttgtcaaaagaagtgaaaattatggcattgccaagctacttccaaaccaaatggacaatgagcagagaataaaactggcttctgagggctttaaataaatgttctgttttcacaacagccgcctcttccaaaccattggctatctttagttggaggatcacctgcagtcttatttgcacatctgtattataatttaggtttatggtttatattcacagattcactgcaaccttctatgtttgctataaaaatgaactgaaatgagcctgtatttaactataagaaaatgaaattttgaggacataaataacaataaagagcatatgacagtgtctgtatttatagccaaacactttattttggatgggacaggaggaggaggaaaggaaaatttagaaatatcaataaagctttttcctatgacatgtttttaaaattgtaaaaagctatatttatgtgcttctggaggtgttatataattatatggctctcctagcatttttgaccacaaaaaacctaactgttgtctgggagatcagaaggatagaatccacccacctctgcagtgttaattatcatccaatatcacagagttcttcttcccctgaaaggtttccttaggttccccactggctacaaacccaagcccagcagttcacagacctcacctagcccttcattcactcag

SEQ ID NO: 129862 - DNA, 1025 bp, Homo sapiens
gaattaaattctccttggctcactcgtgtctccatcacccagcggagctcataacttggcaacaaagcccatacaggctgtgggaagccgcgatgcctgctgcccagcctggtgccctcctattgtttagagctggagctgtacagtgtaaatggcagtgacaggtctcccttaagctggctcgtggggaaggaagggagataactttgcagtgtgcttaaattactctggaaagtggaaagaaaacacctggtgctcagctttttaaccctttcaagttgttattcagatttattgacacacacacacagaaaagtgcaggctttctttcctgcctaaaaaataggcaacctctgtgttcttcctcacagccaacttatgtcctctgcaaaatctggcacacatctgtgacaacattgcacttctggcgtaactggtctatttctcaaaagggaatatgatagtagaataagcatttttgcagtatggatagtaggacttccattttcttcgtttcctttgttggtgaagaaggtatttattattttccccccagtttacacgtagtgatttctgggaagatacttgtattaatttcttgtactcatttttgtgacatcacaacccctggtcattcaggtaagctatttattaagcatagttattctagaataaaggtgagttaatggtaaactagaatccttcactgataacatcccattggtttaccctacggtatttaatctgtagtattactatagattgtacatgtaaagtcactaattgaacagagaggtggttggtgccttgttagcctgacataaagtgcttagaacagtgccttgcatatagttctaggtgtcagctaatattacttttaatttttcttatcaagctatgtgttattttctgtttggaaaatggtcgttttgatttttaaaattctgatctgttaggtcatgatctattttaagtctgtggttttaattttagatcagggctgaggttgggttgttattatgcct

SEQ ID NO: 129863 - DNA, 1064 bp, Homo sapiens
ctcattgtaatgacttttgttagtacattgattttgatgctgtttgtatttttcaacaggaaatcatactcattttagaaataagaatatttgtgtattcttcttcaggcttttaatcttgcacagtttttgcttgttgactacaatccttgggtgaagtttaatgaataaaatgccaagatttatcttcaatccttttgtagacactccacattcatggatgtgtatatatatttagtcacacacgtgcccagacatgttagtcagtttactttctctggctaccacgggggccaccatttctactcttggtcaaaaagagacatttggaaattgggcattcagcaattttgggaaataccagtgaatcctgattacgcttgtgtgtttttaccacatagttaaaacaaggtgagagttgggaggttcattgtacagttgactgtgagttggggatttaaaaaaaattcctttaatctatccctagccagtgtcctttcaaatgatcatttattggaatgttgtgattttaaaatcagattttttccccccaatacattttattcttgtttagtgacaatgatagaagaagagaaatcattgtgtgggttgttaatatgactagtcatgggtgctcttcacagcttctgttggctttgttccaacctgcaacatgcacccgggtgtgtaaccataaaccgttttataatgttttggtaaagtggccacagtttttgcggggatagactgcctgcctagtaacttagttccttaatttaatgaagatttttttttctagttcttcttagtgaatctgtatgttcctctcttattggtggagagtagtacagtcatataaatatatattttgtgggtagttgaaatgttcttttaggtagtgccagagaatatctgtggtctgcctgtattatttggaaattgacttcaaatgaattttccatggaagcagtgaaagtgccacacttgtcatggagctagtgtgtgcaggtgtgtgtgtgtgtgtgagaaaggggcctagtgttcagtatacacatagcatttcc

SEQ ID NO: 129864 - DNA, 1088 bp, Homo sapiens
tgatgggttttctctaggatctccttctcctgaaatgctgtgtgatgtctctagaactgaggctggctgagctttgcttatcaacaaagatttctctctttactgcactagatggcaaatgcctgctgttacagaatctttccccaaagtggatcaaagatggagtatcatcagtatcatcgcaagaaatgtcaagtctggcagaagagtatgaaaggggcagctttgggctgtccccatggcggtctttgggcacacatcaggggcttatggtggggagtgggtgttgtcctgtctctggcagtagtcccagcctggcgcactttttggggctcagtaaatagttgtttatatattggaaaggccctggtgggatggagggatttgtgaattatgtgcgttcaccacattgctgaatccacgagggagagtggtggggaagcaggcttcagcttaatgtgcagtcccaggtgacccaaaccaggatgggctgccaaataaagtgggccctctgttgttcagggacacagagggggagtccagtggggctgcacagtcatcttttggtcctgcatgctgaagccgagatattttttatcttgacacatcatcctcacccataaactacagttgctattgctatttctggcaccaccttttttacttctcattttgggtttattttatcatggagctctgagcctgcctgctctgtggtagactcaggtactctcagggacaaagtgttggaaaataaggtcacttctctctttaacaccaaaataaactgataaatgcttgtacgcagagtacagaaggagtaaggtagctggcctttcgtgctggcatgcctgtcactgtgctgtgaaagtgactgggacatgggcctcttgtgaacaaggattgactgtgcactaagacgtggcatctgcttgtgatgatcatgcttttgtcatccgttctctctggcttggaaaaggcccgagccaaactagaactgtcagacctaaattggcgtaacccatgtcagttcttcctcgaagagcccttccggattacctgcttcagtgatccagactgtctagtaa

SEQ ID NO: 129865 - DNA, 1067 bp, Homo sapiens
actttcttcctggccttaggctcctttgcatttattattttttgctaggcccatagaaaagtaactttttattttgtccaggtaaaattttttgttgccatcggatggaaggcttttttgtgcttctaattagacacagaaatcttctatacatttttaaagcaagtgccccaaagtgtaaagtgtcaatgagttctcttgcccccggatgctgattgggtttcaccagttggaagcactggatgaccatcagtgcccagttgtatgtgttaagtgacattcttctaatttttcttttatccaacttaaaaatctgtggtatctgtgctattctattgggtcaccactggttactgatacctgccaaccaaaaaggatatctgaaaggcagtaaaaaaattaataaataaataaaaccaagcattgctctgtaggacttgccctgagacactctttttcagttatggaactgcccaatcacatgtaagccagaaaacatgaaaagttaaagacacatacacagaaccgattcctagcattactactacttatggtttaaatgtaattatttactgtttcatgtactgtatcaatgttgttaaatatattgtcatttagtagtcagaacaacccagagtaacactgagattctaagttggggttgactacagaatatacacttttaaccactgtgctataaatgctaccttcttcaaccaagttgatcaaccagtattattttatccaataccaacttggatgagcaaggtatcatttatagcacaatggttaaaggtgtatattttgcagccaaccccaacttggaatctcagttttactctggtttattctgactactaaatgataatacatttaacaacattaacatgaatttccttgaagttctagagagcatatagcagacattaaatatggaaagttcaatctgcggtgaaaccttaccctaattgttttacacacatactctatggcctggctctagcattccacttgctggggagccagtgttgagagtttctggggtgcacaagtaagaagggagctga

SEQ ID NO: 129866 - DNA, 1057 bp, Homo sapiens
cattctctcctgcctagaatagcatggtagtcccacagaacatatcagagttacccttgtttacattcatacatggggatctaaatagtagtcccatctagctgctgctcacatgttggctgggaactttactataaactctgtgtttgctttgttattgtattcttcttttctagatgagttaggatttccagctattgactcaaaatcattgaaatcgtggaaaatgacaacattattaattagatcatatccagtcagtaatgtgctagctttgaaaacatgtatttgtatactaagccgtgtctgagtaccatttttaggagtgttaaaaatgaaactgtgagctgtgtagcactctttttaaaaagctgtattctttgccaccaggtgtatttatctttaatttgcaaccaagtatatttatccttaaaaagattttgtgacactgacattgtactaagcacttacagatttttccatcatggcattttccagaatttctatcttggcttaacatttctttgaccatatatggatttgctaaatgttattgtttatagagaatcaatgaacaaaagtgatgggctacatttgagtaaatttaatgaaactttcactgtgctttttttttttttttgtaaaacccagagaaatatacggatctgtttcaactcggtccaaataaaaataaataattagaatacataaaaggctttttaagttgtctttttccatagcatgtgaggagcattatagagaggggattttggtcttactagtttgaacctcagagagatgtctctaattgtataagcctgcctttttttggaaagaaaaggaaaattttccaattgttgggaaatcaatgatccataaccaaaaagggagatagaaagaactttattaagtgactcttctgtgcctggcatttttacatatattattttgttgacatacattcctccaaagtaggcattatttctatttgttgatgaaaaaatgaattgcctaacttgatttgtccaaggtacgttatgaataatagtggccagga

SEQ ID NO: 129867 - DNA, 1066 bp, Homo sapiens
tctttcacagtgtttacccaaaaacccagggaccttaggctacatcttccctctcctgtatgtcactctccatggattatcaagagttttagaaagtttatccctttacattgaagaaatttattgtagactaaataggattagaatacattttggaaatctattgtaaggtcacaacttattagaagttgtagaacaatggaataatttagtttccttataagcagtattgttgattattggtttttcttttttgtggtctccagatacttagccatcattgattgctataatccttattaagtatttgaagatgttgagtaccatccactgaaggagtcccagggctgattgaggaagttcgtgaatattaaaagatgggaacactgagttttttttttttaaagcacttttgtgagttacaatgtatatataactaaatttactgattttaagtgtatggtttaatgtattttcgcaaatatggcagttatgcacccactaccacaatcttgaaatagaacatctccatcaccctgcgtgttctgtcgggcgtctttgcagtcagtcccttcccccacactgtgactgtgccaatcattgatgtgctttctattgctccagtttgcctttctctaaaatttcatataaatgcgatcatacgtgtagtcttttgtgtttggcttcttttccatagtataatcctcttgaaattgctttacgttgttgtatatatcagtaattatttcctttttattactgagtagtattccttcgtgtggtataccacaaattgttgatccattcaccagatgatggacgtttggattctttcaagtttggagttattatgaataaggctgctgtgaacattcttgtgcaaatctttgtgtggaatctctgtgtttaaattttgtcctgggtatatacttagtagtagcattgctgggtcatatcgtacgtgcttaactttataagcaactgccaaattagttttcaaagtgcttgtaacattttgaatttccaacaatcattgtaggagaaccaagttgtttcatatccttat

SEQ ID NO: 129868 - DNA, 1005 bp, Homo sapiens
gttttgctcttgttgcccaggctggagtgcagtgctgcggtctcggctcactgcagcctccacctcctgggttcaagtgattctgctgcgtcagcctcccaagtagctgggattacaggcgcctgccaccacgcctggctaattttttgtatttttagtagagacggggtttcaccgtgtcagccaggctggtcttgaactgctaacctcaggtgatcccgcccacctcggcctcccaaagtgcttggattacaggcgtgagccactgcgcctggttaacacttgatattttgaaaccttttaaaattagccatcttatttggtatgtagtggtatctcattaaggttttgttttgcatttccctgattaattatgttgaagatctcttcctgtgtttacttggcatctctattttctttattgaaatgtgttggaatggacatcttgtcctttttccccccttaatatggttgtttggcacttagtcttaatatcaatagtgagtttataaaaagaaatataaggaaaatattttgttgctttcacggtttctagaaaggagtatttcttattggatgttttgtttcctgaccatgtgtgtgcatgtgtgcttttttgggcatgcgtagaggagttcttctgtcatctgttggccagatttcatttatcttaccttgcttccttgcacatactctttatttctgcggaatctgtcagttcacattccccaggaaaaccgcatgtggatttactaactacccatctaaagacacactcacagttacactctcatcccatgcaaaccttaactccagtgctgctctgaaggccttccttggtgacctccatcatcagcccacagtgggcaggacaccatctggtgcttttcggttctcatgcacctagcactgtgcagcaataaataatgggagagtcaacacatgactgttgttaataagctgctgacctgggtgacccaagtgctctgcagtgattctagggtt

SEQ ID NO: 129869 - DNA, 1099 bp, Homo sapiens
aagacagggaaactatatactctttttgtattaaatttatctaggttagacaacctaagaatatcccaaatttcattttggatttctcatgggcattcatattttaatctagctttatcagtgggacaaaaggcagcgtatgcccttgataacttttaacagtgggttatattgacagaaagttgagttgactcgtgatgttgtaatcatgctgattagaaatgattttttttttgttttacactaaaatagatgaaattgtaatctcttaagaggttatttaggaaattaaagatccgctatgatctaatagagcactggatttacacctagaaaacctgggaatctggagctggcttagctgtgtgactttgaagtggtcacttaaccactctgggctttctttttctcatctgtgaaatgagtcaactggagcagatgaccgtatgatccctaagtttcaagcatctgtgctatgagttatttgtattaggatcgttttgatttcacatggcaactttgaagataaatccaatcttgaagttctccatatgtggtattactccctgtcttaatcacagttgagtgacttttctatctgtgaattcattctagtaagtgttcagctctttgctattttctcccttcaaaagtgtgagaaggataaggcaaaaatcatgagaaaaatgaacagggattttagatataatttttggccaaaataaaagtattggttgcaaaatattaaaatacagaaccttttgctttgttatatgggtcacaatcaaattaatatgggcccaaatatattttaaatcaatatttctctaacataataacagcacatgatttcattaatttgagttgctggaaatcccatatacttcagcaagcaaataaaatactatcttaaatttcaggtattaaagcaataaaaagaaccatgggacttggagtttatatttctattttaatctaatactaatttactctgtgttcttgttgaaccttgttaggtaatgggacaggagaaagtaggctgttttgaaagttttgaaagtgagtggaaagtatcaatcttagttgttatttaaatggg

SEQ ID NO: 129870 - DNA, 2118 bp, Homo sapiens
aaatgtgttcagaatgggacagacattgtgacccagagtgtgggggaatatctaatagtagtagggaagaatggccgcaagttcagtcatctcatcgttagtttaagtcattgtctaaactttggtcacaaaggctcattcataaaagctttggttatgattgactactagagtgaatagtcaagagttatgtgtccaaaaatccttttattcttattaggtgctactttttaaatataaaaggcaatatattcttggatttttatgaaatttaaaaatcaacttaagaataaagatagtagtaattattttgttctctcattagacaatattttttatcatccttaaatgggaagtatactggaaaatgctcacttatgttatatggttgttatgaaatgattaaagcaagcaaattgaaatctattaacatttgaccctgtcatctcatacctaaattaaatgagatgtgtttaacaaactttggcattcattttcctctactttgaactaaagacacatttgaatccttggtatattagagaattttcttaccatttgtttcacacatttgtttttcgtatacttgaaactaatgacattacttggcttaaaaatgtgttttaaagaaaagagtatgcataattcactgtaagtcaccttagaaagtgaatgtgtctgagccctcctggccatagagacctgtcctgttatcttagcacccaggcctggcattaagcatgctcagtacagatgggaactgaattgaaaatgcagcaaaggaattgaagatgtgaaaacccatttgttagaatgctgagaatatgatgacttttcaaatttacctttagcagtacagttaaactataaagaaagacattgtagtgggagtaacatgtgcatttgagtgcagtgatagtgatacttgttctttgctctatgctaagtttaggatgccgatgggctggagtcatctgtctcttgtttccttctgccctccttccctgcttgccccttccccctccttatcttaccatccccaactcctcctccttatgagactgaccttgtgcaaggtcccatgtgttcttgttctcccagcattccctatgcagtagcccgggcctctatggaggaggtcctgatgtgaagcaataatgctactacacttgctgtttctgcagtggtgacttgtattcctgtagacccttatatcagttacacaccaagggaaggagtaggcagcctctctttcagaatcatggtgccacgtctctcatgctgacttaagtccacctcttagagtggttttatcagtgtcctttgctacatcttttctcagctaatttgggatgaaaacattctgtctctattaacatcattatattctggcagagaacagtattacgcctgaatttcagcaagtctgtttgcatttcacaggagagagccaggctcagccagacattttatattctgtgtgaaatcaagacttattatcttacttgataataccattcctcatggtggaaatctaaaactgaacttgctaagtgttcttctttccaacagtagacatcagcagtcttaaaaatcactgactttttaaagtaaatttgccttatttcatggttgcccacaggttaggatttgtcatgagattaagctggtaagaataatacagccacctctcaaaatttgtaatcatgccaagtgaaagtttctgaaaaccaaagagtagttaaggtgctgatctgaatgggatagattagtgagaacccccactcttcttgcacacatgtgcacatgcaaacacatgtgtgcacacatacacacttcccagaggtgtgatttgattttggacttcagctgtaattgagtttgcttccttatttgctttaggtattgatctgacttgagtaccattgaagagcaaaccccttaagcatgagtgtattttaatatgtagtagtatacagttcttcaacctcttcaaaccctaagaatttgaatttttcttctccaagtacaagagtatactggttttgtgaaatttggtaatataaacttagattttcccggaatgagtttcccttattgttatccaatcatacttat

SEQ ID NO: 129871 - DNA, 1811 bp, Homo sapiens
atctatagtaaatgcattcttattgttacataggattatctttttaaaaacagtacttttagtgatttgaggttttatatattaatatataatttttacttgccttctctctaaaaggaagtttttttggtttgtttgtttgtttgtttgtttttttaattaaaatgtcctccaatttggagcttagaatggtggcttatgaaatcccaacactttaggaggccaaattgggaggattgcttgaggccaggagtttgagaccagcttggcaacatagtgagactcagtctccacaaaaaaaaaaattaaaaattatcctagtgtgtggtgcacgcctataaccctagctactcagttaagcttaggcaggaggattgcttgagcccaggagttggaggctgcagtgagctgatagtgccactgcactccagcctgagcgacagagtaagactctgtctctttaaaaaaaaaaagttttccgatttaggttgcatacatcagtcatgatgatgaaattcttttttcacgaaaagtattgttcacaatctgtttagcttttttagtggcatctcttttcagtgagtactgtctttggcaatgttttctgacttgtttcctaacttaattagaattggaaaacagccgttacttttctctctttctctttgttgtctggggccgtcatacctgactatcttgattttcgctttctccttcccccactacagttaacgcttcatctctgaggctactttctttgtttggagtctatcagctgaacagataggcatcaccaatgtgtgacacaagcagggactgtctgggtttgaaatgcaagatgtattgtaccaaatgaattctagattgttttgcttagtagctcacccaatttttgtttctttaatcttcgaaagatacgactgggaggatacttgcacctattgagaaagcgtgtggtcctctccctgagtgattgctgatgacatagaaatgcatggtagcctcttttcacttaaaaattaagtatcaggtactgcttactctaaattaggttacagagctgccatcactcctcatcatcaaccctcggaccattaatgactgttctgtttactcagagctgtgttatattttgcatatggaatcctggagtgttgaagacagagatgttgcatatttaattttaactccttgattttcagaggagaaaacggagatcatttcacaattgccttgtaaatagctataagaatacagcaaaggtattcttagtgtaggtattcttcatgtaattaaaatatctatgaaaattacctttaatcccagcacgttgggaggccaaggcaagtggatcacttgaggtcaggagtttgagaccggcctggccaacatggtgaaaccccatctctactaaaaacgcaaaagttagccaggtgtaggggcacaggcctgtaatcccagctactttggaggctgagtcaggagaatcatttgaacctgggaggcaaaggttgctgtgagccaaaatcgcatcactgtactccagcctgggtgacagagtgattgagactctgtctcaaaaaaaaaaaaatctctgaaaagtaacaagtgcatcaaattatattaaaagtgatgagctctctctacccacccttcagatccacttcatcccggacccagagaagagcttggcattcaggaatttcctaaacagctgtgtgtttgtgtttgctcattcattggttcctttaacaaatgtattctgggcacccgctgtgcggtgccagaaagacgtggctcttgattgagaa

SEQ ID NO: 129872 - DNA, 1075 bp, Homo sapiens
ggctgaggtccgtgtttcctggctgcaggccaaggactgaagtttttagaagcttctagaagccacttgcatttgtttgctgtgggccttctcaggaacattgcagccaacagcaggatccctcatcagattcctgtcagacttcaaatctctttggattcttttctgtgaccagccaaaggaaacccttttaaagggctcatgaaattaggctaggcccacccagatactctctctatcttgaggtcactgtgccacatacctgccaatcacgggagtcaaatccatggtatttactagcccagggattacgcacagggcatacaccagggggtgggaaatcctggcccctctttgaattccgcctccatggaaaggtcagttaaaatgcttgggaaatgctgccaaattcaccccagcgtttatactgcttctactttgagatgctgaagaccgtgctctaagaactctcttcttgtttaaccttactgtgtttctatgggaaagaaaaacagctctgtccttggcatgcagagatgttcttaatttacagtcagtagggctgagggtttgatgcttaatgatttccattcattgacctgtattgtttcagccaatcactcctgggccagtggtgcccagatgaggactggagccaggtgtgcaggtttgcaatgaacatagaaaccaaactgactcttgttaagggcttaacctaggttaagaacgtgacaagctaggacacagggagctgccctgagttcgagaccagaggagcaacttatcaaaatcactgttttgagcagattaaccttgaagctgtgtggatggtaagaggggagaagccagaaacaaaagccagccaggaattcagaaatgaatgctcatttatcagtggtaagggagatttagaaatgttttgtgttccttgaattgctactattggtggtggtagtgctgggaaaatgaaaaagactggggaagtctaagcaagctataagacaaaatcaggctgcttgttaggacttgtgaacacctgggtagcctatgtttacttttcggagaggccgtgtgc

SEQ ID NO: 129873 - DNA, 1175 bp, Homo sapiens
aggccaaatctctgaagccaattcctcttggagtttttacctcctggtaatggtgattgcactctgataattcactaggatgatgcttcaaggtagcacacacagctctcattttctttagccaattatctccatcatattttttcagggtttgcgtatgtgtttgcattccagcacaagttttcactcttgaatttatggaccatgagtttctgtgctttcccttgaagtttatggtccatgtcattcctttcactggtttgtttcccaacagtttgtggtacacaaagattggaggatgaaatgcccctttgccaatagtcctgtttcttggctactaattaatctggttcctcagagcaaatcataatgcctcttgagcatgtcagctttttgtaaagttttttagctaaaaataaaaaaaaaaaaaactacagaaaagggaagtttgcattttatctttgatctttggaatggaatttgactggtagaacatacccacttgtaggaaatatgaaaaaaaccatttaacatttacagatttgattagatcagctcaggactgctaattctgtagaacacattgagaagaaagaaattaggggaaaagaagtagataaacaactctcagaacggagagttgcatttgactggctgacttctctcccttttcaacataaatttgtcattttaaatttaatccaactccttctaattaaaacttttcccaatttatattccatagaaaacatttttaaaatttatatcattaataaaaataattagaagcccttaatttcctgaaaatttatttttaagatagctttgtatagaatcaagtgaaagtagtgactattatgtatctaaaaagaagtaggggaaataatttgccttataacagtgaataccaataatggttctgtgtgattaatcaaccctaccattagcttctcagccttcatggcttcagaatagtatttctgacagaactgtacgatggagacatgttgaggtactctcttgagtgctgtgatgctggaaagaaagggagacaatatggagtggttgagatcactactactcattagagcttagtatagagcccagaatccaccctgtgccaggccctgtgctaagcacttacagctcattggcagtaactcttcgaggtggct

SEQ ID NO: 129874 - DNA, 1086 bp, Homo sapiens
atgtggttgaaagggacactatagttccacctgttcttctccaagaattgcaacaaagcattttcaacctcatctgcagccaattttaaggaaatctaataaagaggtttgcagagcacctgagagcagctaagatcccaagacaaagtagaaaattacctattgaaactacaaataaaaatgaaatttaaatatatcgttttatatatgggccatttgcttgctcaatctctttgtacctgggagtggagggaaaggctgggagtaaaatgggactggattaaaatatagtgattgtagatttttatgacatatgaaataaattgtaaatattaaaaagttgacctgtagtaacatgcttgcagccatctatgttattaagacagtacttaacgagttttgaaacaagtactcctggcaatattactactattcttaacctatatgtgatagacattttcaaaaagtcatcatatctgattgccttctatgctgttctttaaatgtttgaaatcgtgtttttatatatgaatacaaccaatcagaatacaggtacattgcttcaagtactatttcaaaaagtttctccaatgacatgactcagcgatttcttaaaggatagaaaaacactttgttaatggagaaaaccagaagtccaccttctcttggaaataaatgttgaattttaactgagtaactttgcatcagccacatcgtattactgacatgtattaggtggtagatttctgtagtagcagttctttaaaggaaaaaaaaaaaaaaaggatttcttttccattgccttcttttttttttttttaacaaaatgagatattcctcagatgggtaaccttcagctttgcagcctgagggccatacctaggaagtggaactaggtgccttgggtcagcattgtcctgtgttagggggaggtggtaatttctaagacttttgccattttcctgaaattgctttgggctccatgttacctaaggtttgagaacaagctctgaagctggatacacgcaggtttcatcacagctctaccactcaatatcagggtgcacttggcaaacaagttaatta

SEQ ID NO: 129875 - DNA, 1026 bp, Homo sapiens
ggcacccaccaccatgcgtggctaattttttgtatttttttagtagagacagggtttcaccatattagccaggatgctctcaatctcctgaccttgtgatccgcccgcctcagcctcccaaagtgctgggattacaggcatgagccactgcacccggcctgaatgaattttttaaaaaggataggtgatttatttttcagaactttttagttttcctatattcagatgcctttttcaactttgaatgtttatgcaaagcttgggaatctgattgttgccccaatataaataaatacactgttgtagtccattgaattagaacaaaagtgtctagtgaatttgaattccatccaatcactacttttcactttgcatggtttcaatctgcattaatttcaattctcgtattttagttaaataaaaccagttccccaacgtcacagttcaaatcttagttaccatagtatattaactgtaattaaataaagtgcaaacctcatagttaggtcttcattccccaaatcactctgtaaatagcaggtgctcatcatgatcaatgaccaatcatgccccttctttccatgtctgctggtgatggttctgtgcacatttattattcagttttcacacagacaggaaaggttgtccttgtgttgcctccccaccaagagtgataactcatgtggaattttacaaaaatagatttaaaagatggaattagtcaacaaagatggaaacacagcagggcaatgaaaagtggcagtcaaattagaatcaagcatgtgtagaagaaatagctgatggtggggatgttgacactgctcgtgatctgggaggagactctggataggccaacaggaacccagggaaggcagacttatcagcataaatgaggaatggggttttgacagaaaggacaaagatatcccataggaagtgatatcatcaaaaagctttacattaaaggagttctcagaaagcacaaaggataaaatgttggaagctgacccaaacttacaaagggca

SEQ ID NO: 129876 - DNA, 1086 bp, Homo sapiens
gtgtaaatagaactcataaagaccccagggcttactttttggtcttcaagaaaaggcacagtagctgtttttattagcggcacagaaaaatgattttgtttcctatgatactgatcctgcacaagtttttttctttttttcttttggttactggctaggggtatatggaaattctggggaggaaggcttgttgatgttcctgtggcttatacacctgcccaaagctgtgctccactgacacaactgaagaaggacagacaggaaaacgaggccaggaatcctggacaggccaaagtgcctgggatacccacgggggatccaaagggccaccaggcatccccagtgacatcggaaacacgaaaggctgtagggtggccagagccatcagcctcccaaaattgtccacccttagactaaacaacatcctgctgccttcccatcattaacctgcccttttatgcaactgattttttatgggagaaaacagtttattgcgggttattcagtttacttattcagaagctgtagagtggctcagcgacagggacaaatgaaaattcggaacatcatactctccatgtttactgtgatgattcttctcttccatcactgtctataaacaacactgtgaggacagaattctctgaaaagctaagatatgggacaccacaaaggcctgaagcttccatccaaaagaagtaatctgagttggacctagtggggattaagcatgctattgatttagtattcattttttatatttggactgtttaaaattacttatccaagaaatcctccaaggcgcatgattatattatcatactcatttgttggggagggtgggggattgtagttattagtgtaatttgccccagaccagaaagtactactaaatgctatgattagaaaaaggagaaggaaatctgtatttatatggaaaagaatttacttaggatgttattctgcattttaaattgtacagaagagaaaggaaagaaaccgattaagatgcttaaaatttaaatttcttctttggagaatcaatgactaaaatgtctcagaaggtatgtattaggatcatagttg

SEQ ID NO: 129877 - DNA, 1041 bp, Homo sapiens
tggcagagctgaactgggcctgggcaaggtggatgaacttattagtcattgctgagcttcctgtcacttgaacccaaaaatatatttcaagtgcaaattgtgatgaaaccttacctttaacattctaggcttgaaaatgattttatgtaagacacgttaagtgctggaaagatgaaaatatgtgctgcaataaataggtgtctatcgtcttacgtgtcttattttgaagattatttatcccacagttcagtctgaatccacagaagtgaaaaataaactgttcttttcagaatatacttaaggcaaagaactagttgttctaacaactgctatacaaagaactcttcaagagatggaaaataattctaggtgttttttgacaaatgagatcaacaatattcactatttttttaagtgaactcactggttctgctgtaaaattctaccttgtattcatttccttttgccccttatttgtgctctaagcagaattcagtgctaatgtgtttcttaggtggtgaataagcagtctccatgtatttgccttatattggagattactccaatcaaaaggaggtacttggagtatcgtttcaaatatatacacattcccaacttcacttcccaagattttatctgacattttcattgggcctttacaatatgaaagggtgtgctaggtattctactgaatgcttaacattttagttcaactctgggaacatttgaaataatgcctactatgtgcatagctgagggctttactaaaaatagcagtaaaattaggtgatctctgctcttcatatgctctgtgcagtaagatagaatgaaaccacagtcttatgttactgttctttttcaaatctttcattattttcttcaaagttcagccaactttgacagatccacagtcagcagcgtaaagaaggaaaatttaaaatgaacagaactcagtttataaacattttaccttcttttttgtgcatttaagctattaacaagtagcatggttatttggtttaacaaaaaatcaaggctttt

SEQ ID NO: 129878 - DNA, 1104 bp, Homo sapiens
agacatcctctttaaatgtctctggacatcagtttcctcatctgtaaaatggggataacaacacttggtttagggatgttcacgggatggaactcaaaaatgtgtgaaaggcattattacagttctggggacaacatatgtgcctaataagaaatggtcattactaatggggcattattacagttctggggacattgtatgtgcttaataggaagtggtcattactaacaggtaattttttaacataatttttgtagcaatttatctaatacactcacagaggaattcacccaaaatactgctttttctcccttcaaatttaaatgtttcataattttattataacacacattttatttcagagtaaatatcatcttctgccctaaggctgtttactagaaattaaaatatttttcaaaaataaatgttctgtatatattggcacagtaaactttatcatttgtgctagatttgccctagagtacaagtttacacagctaaaggagaaagcagtaacatgcaaagtgcggacccttaaaatggaccttggtagaagcactgggcacggctccccaaatccacaccaccctgggttctggtctgggctctctctgccactcaccagtactcaccctctcctctatacaaggggatcagaccgccttttaaggaggctcgctgagatgaggtgtgggaactcacagcacaaagacttataaactgcaggagttactaccagagtttataatcaccgagttcattgagttgttattactgctggaaggtgtgcctggttcacccaaaatggggaatccactaactctcagacttacagtagccagcaagtccttttttttttttttttttttttttttagacagagtatttagctgtgtctccaggctgaagttcagtgatgtgatctcggctcactgcaacctctgcctcccaggctcaagcgattttcctgcctcagcctcctgagtagctgggattacaggcacgtgccaccacgcccagctaatttttgtatttttagtggagacggggtttcaccttgttggccaggatggtctcgatctcctgacctcgtgatctgcccac

SEQ ID NO: 129879 - DNA, 1027 bp, Homo sapiens
tgatgcttaaagttagtaagcacaaatactattaccagaaaaatcaaaaagcagtgttccagagaacagttttacacatattgtaaacgttttgttatctggcatgttaggaagctagaagaatcagttctagaattcttaataacttcaaaggtaaattgcttcttttatttgctcccaagaatgtttgagctaaagacatttttcagctcaccagattgaacacatttgtttttatagataagaaaatcaagacacttagatgttaggtgacttagagctgaattactcagccttgctctttcaataccccccttttcctgctgtgagacacaggggaattactcattctcacatagaaacttctgtgggtgaatccaggttgtgttcagttcccagggcccttgctctaactccagtgctttctttcctacttaaaatttaaagactaattaggcattaactatccttttctttttcattaccagaagcactctttaaagaggaagtaacaaaacagcagcccaaatgtggccaacagtgtttttaatattgaatttttaaatcgggagagtttgtgcagagctctggatttgctgttgcgtcaacaatgagccacattccccatggcagcccgtagcggggggctcctttccgaaggccacacactctcccattatctgcctggcctcagaggctttgaggcacaaattgcccggattacaggaactttggctttagcatttttttcaaataaactgtgtatgaggttcattctctatatctaaccacctccaggattgcaaatgttcttgaggtctccccaaggttatagttcagctgagggtcctgttcacctgactgcacctgttcacctgactgcacctgtgaggagctggcagatgggaagttagaaaggttcaggccactttggttttaaaaacttggaattctctgagattgctatttctgtgcctaaaaagctcagacttttgctcattcagagacaagtaactttggcctgttt

SEQ ID NO: 129880 - DNA, 1049 bp, Homo sapiens
tagaaaacttggagtatgccttagtatcccacaacaccccaaacagtatctttagtttgttctgttgcttttgggtcttccaataagatgaagttgttttttttccttcccagagttcacatcaaaactataaactctaaccatggtcatgtcaaaacatcatcactgtgttgaaaattattagggaaattgggaatagcagaggaggagtgggaaggggtagaagccaaaaggaaatgaagtatgaaatacttgcagataattgctatgtgtgacataattctttcacacagattttaagattagtaattgttgaggggtgtggaacaattgtgagtgctggaggagccgtcttgagggtgtctgccacatgaatagagaaagcagtgtgcaaggaagacaagcagctttctggaaaatgcttcttagaagatagactggtattcctcactcttgtgaatcgacagtcaggctttttattcagtgttgccaacagtaccaaagcctaccttaacagacacgcaggtgtgcatggaaggccacgccagtggtgtaggtgttttaggcttctggtcctaatatgatagaactagaagagaagatggttagaagagaagcacaggcctgcatgaggaggaatgttacatgagaactacaactcatcttcagagagcgttggcctaagaacagtcagtgcgggaccatagaaaaattcagtcattcaccaatattccaacacgccattttgaaactggaagtaattccttcattcttagatcctcagaacctcacgattttacagtacgaagggattgaaggaatcttgtccaactaactcgtgccccaggagaagggagatgaactttgtctcccactgcccactaggtggtattcccactctagtcctcaggcacaaagctgaaggttgcagatcttggtcctgcccctcactgtgcccccaaactttctggtattgtcctggggtcagccctctcccaagggtcccgggtatgatgacctcggagttgcatcctggcccaggctctgct

SEQ ID NO: 129881 - DNA, 1012 bp, Homo sapiens
ctttatatattctggatatacatgctttgtcagatatgtgatttagatacattttctcagtctgtaacctgtccctttcattctcttaagagtgtctttcacagagccaaggactttaatttggatgatgtccagtttactaagtttttcttgtatgcatcctgcttttggtgtcatatctaagaacactttgtctaatccaaggtcacaaagatttctccctctattgtcttctgaaagttttatagtttcacattttgcatttaggtctatgattcattttgagttaatttttgtgtaagctccaggatataattctaggttacttttatgcctatggatgttcaattgttttggcacaatttgttggaaaatctattctttttccagtgaaatgtcttggcacccttgtaaaaatcaattaaccacatttgtctggatatatctttggactctttattgtgttctattgctctatctgtctatcctttcaccaaaccatattattttgattactatagctttagagtaagtcttgaaatagggcagcatgtgtccttcaacttgattgctctgtcaaaattgttttggttattctaatacctttggttttctatataaattttagactcagctggtaaatatgtacagggaatccttctgggattctgaatggagttacattgaatcaatagattatttggggaaaaattggcacgctatcattgtttcaatacacaaacaggttatatctcttcatttatttagattttcatctatctctttcatcagtactttgctgttttcagcatataaatacagtatatattttgttagatttatacctaaatgtttcattttttgatataattgtaaataatactactttttcaaatttgatttccagttattccagctaataggtagaaacatgattgttattgtataataaccttatattctgtgacccactaaactcaattatttgtcccgagagctttttatagattcc

SEQ ID NO: 129882 - DNA, 1039 bp, Homo sapiens
accagtcgcagataatatgtttaaggtttgggtaatcatcattaggatctaaaaagattgaaaccgctcaactcttctgaagttgggaacattatcagtgggtaacccctatcacaattttcattcaacttgtactggaggttttagtcagcacaatgagattagaaaaacaaaagtatacaaattggaaataaataaagctcattatgtgtaatgacataattgcatacaaagaaaactgtaaaagactgattctttttctgattcctctggtcattttgatgttttcctcctgtgttcctcttcattcctagaattttgtcccttgtcctctgtgcttatctaagtcctaatgtcctaaatccttttaaggcccagctgagtactaattctgtactacagatgcctatcttttattccttttcacttatatttaataagttagtttgaatgagtatagagaattacttcagcaatcaataaatatttttgccccaaacattcatgaagaattaaagttgaggacttacactgctgcatgcaaagacttattgtaaagctgcaatggttaagagagtaagaactgacagtagaccatggaccaaaatacgagaactcaagaatcataggcaacttgatttatgacagtgcagagcagtgaggggcagaatttcattaggtggtactgggacaaatggacatttatgtagagaaaaaatagttcttgtcctctaccttataccacctataaacgtcagttccatatgggttgtggatctaaatatagaaattaaaacaaatttctggaagaaaatagaatatctttatgaccttagagtaggcaaagatttcaaataataaaaaccgttaaccgtaaaggagataggaaatcatttgctatgaccgatttttgcggtaaggtctttctcactaagactgagataaaaaggaatgattattcactttgccagattagagatgtggaaagccttgaaggtgacttccattcctcgtttccagggcactccagagaggggag

SEQ ID NO: 129883 - DNA, 1028 bp, Homo sapiens
tgaaatactatatattaaagaaagttacaacacctttatataaagattaaaattttgtgatttttattatgattcagttttaagtttacatgaaaatatgattttttatattacaaattatttttgtcttatttcttcaggatcctggatgtccggaactttattgtacagtctcgtcctgaatttgcggctcttgactttattcttgtgacttcatttccgaataaagagctaacagatgaaagcctgacactgctagaagcagatattcttaacactgtgttactccagcaactaaaataatattgttcctgtccatgcagtagcatgtgggaatagatgatgtgccgtattaataaggacaatacttcagcattaaaaacagccaaattatttttattatttttacagataaattttggttttattgttattctgtcttccaatctgaatatagacaaatttggattaggaatagaccttgagataagtatgtttgagtttttagttgaaggactggcttatgttgatagtttttggatttctaggcaaatgagttgttacatgcttagtgttaatgtaacaacatttgtttgcagagaaaaatgaacaaaacccctttttgataaatgcatttggtaaaatttgcactaaagtttcttgatgcagcattgaccaacagccattaagaaatcttttgatcaaataagttgaaaatttgtctataatatatactgaaacgtgtcttttgattttgaaattgtttgatcatacaataattatttctcctattaagattttacacatcctttttacttactgatttagatatattactagtatcagaaactacagttttgccttgtattttacagaattatgactgttgtgaacttaaacagaaacacataaaggtcagcaattctttttttttttttttttgatatggagttttgctcttgttgcccaggctggagtgcaatggcataatttctgctcaccgcaacctccgcctcccaggttcaaaa

SEQ ID NO: 129884 - DNA, 1099 bp, Homo sapiens
gaaaatgatttcttaaaagaattgaacattgtaaatcaaagggcattgtcctgttttggattaacaaaacaggaaaaataaccaatccttgtaaaattatttgaaattttcttgtttttatcagttgagtgcctatagatgcacatacaaaaacaactgccatttttgtatataatagtcttccaagatagagatttacattaggagagaattaaacatccaggagggatgaacagtatttcatgtgtgctatgtagtgttttgcttcattgagagtcattttcatgaattatttttactactgcagtcatcttaaatttataatcatctcaaaaaagatgtcacaatgaacagacaaccatctgtgaggtcagtcattttgcatgatgtatgtaatcaaaaagtttgaaatgtctgcttactaataaagaatgttttcactgaaacttattggaaaggtttttcaaattttctttgatttgtagttttgagtcctgaatagattgttttaacatgaataacatttcctgtggtttaatttcccttggcgcacctttgtcagggacagggaaggaactggttgtagcatattatctgaatatcctgttactgtttctgtttttattctacccaaataaaaaggttcaggtgcttcttttttgccacaatggatttctgaaaaccttgtcacaactgtgaaaggaaagcaaatcttgggaccccagaatcactaagctaaagggaaaagtcaagctggaaactgcttagtgcaaacctgcctcccattcattctattcagttatctctgctcactgagataaaggcctgtctgattgcctcctttggaagggctcatcagaaactcaaaagaatgcaaccatttgtctcttacctacctgtgccctggaagtcctctcccacacttcgagttgtcctacctttccatattgatccaatgtccatcttacatatattgattgatgtcttatgtctccctaaaatgtataaaaccaagctgtgccccaaccaccttgggctcatgtcatcaggacgtcctgaggctgtgtcacacctgtgcatccttaaccttggcaaaata

SEQ ID NO: 129885 - DNA, 1028 bp, Homo sapiens
tctgaaaggataagtagattgtcaaagatcgtgacatcatgaaccgtctggaaaatgtttcaaaagtatatggcctttaagttcaaagataataaatttgagatgaagacaagccagtataccggtgaaacaaatgccagtgaattcaaagggcaacagagagtcattgaatctattagagatgatatgtgtgggaataagttagtgaagaattagtagtagagccagtgccattttcatagacatcaaactttatcggaaggaaattatttgtggattgctttttggaaagccaaaactgagtaagttccagttaattatcattgtttttttcaaggagagtgtttctagatattgacacattgtatatggttttgtcagcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatgtaagtattttaaatacctatttgaatttgtctaaatctcttacataataagtgattaatgttaaaataatttgaaatggaaatgctttaattataatagtgcatctgtagttgagaatattttaaatctactaacttaaatgttttcaattggggatgttctattttgcagaggcatagttgggacttctgaccacattactttgaaagatgtttcttttctgaatattctaactggaatacatttcactggcctacatatattatagtttgtataatagaattgtggcaattaaatagagcagatgtgaaggttaagaaaaaactttccaatgagagtcaatgtcagtgtgcctttttttttttttttttgagacggagtctcgttctgtcgccaggctgcagtgcagtggtgtgatcttgactcactgcaacctctgcctcccggatgtgtgtgcatttttaaaccaaatgatcagtattta

SEQ ID NO: 129886 - DNA, 1092 bp, Homo sapiens
tgtctatctgcctcttgagattctggagagaagggaaacttactcttagcattccaccagcaagaattctccattacgaaccaccacaactatatttatactgagcagaggggtggtaggcagtgcaactgcagtcaattgcactgcaaattgaaagctgaaagcatgcccacttctccttgcataccttttttctaccaggcattataaaaactgaggaaagtatatgtgaattttattccgtacttgggaagttgtaagagctcatccttaccaaccctctgatttaaataacttacttcaaatttctagataaaacaccagtatccattccttgggtaaaagaaccaaagggctgagaattaaagtatagtgcttatattaagtcacatgaccatatgcattaagttgaggaattgtttacttaccgcttaataatatgttcaaagataaaagcaggcatgattgtaatagtaactacagtcccagatgttgacagtatgtctgcaatttgagagtcctgataaaaacacatattaaaaattaattccacagaggctttatttaataaatacaaaactatgccagtcttggtaaagaaatacaaaatatatgtcttggtatttctaattttttctagtatttcttaccaagtttaattgtacactattttacagctagtaaccaaattgcttaagtaaactgagttgaatattttaaccaaaaaaaaacttttcctttctgaatattagataattttccccatatacaatattaccatctcctcttattaactgtgtattctaaatcaaattctatgaaatgaggaggtcatgcttaaaactttttgaccttaagacagacttatttaggaatttgtggaggagaaaaactataaaaataaagtattaatatgaaccaaaactattattcatttccttatattcctggattgagaaatgctgggccactattcatattctaaatctttgttgcccatatttccacagaattctagtgtgaggtacttctgagatcatttattccagcccacttgttataggaactgtagttctagatgacagcccaaat

SEQ ID NO: 129887 - DNA, 1051 bp, Homo sapiens
gttttattataggaagcagacaagaaaaaatagaacttacttcacttgtttagtaaatgaatagcaaagcaagagtaagcatcagagtaaagtttatctttgggtgcctcctggtcaacttcctaactaaccaaaatgtctttctctcaggtgctgtgacatgtatatggatgaatgaacagtgtagcagtatcatcacaggaggggaagacagacaaattatattctggaaattgcagtattaagtgccttttcctctcctgaatattaaattgaactctatttaatgcatttttaaaccaaacttttaaacggactggtgaatgtgcaatgttagtaattagaagttttaccacatggaaaatttgtggttttaaactttctaaatcatggtgacttcattgaaagccattagttgctattctcttagggcagataaaatgcggctgtgttaggaaaaacatgttacactgtaaggcagatgatcgtccccgtatgatgattgtcagaagacaggactaagtagcagagaatagctaagagataaattgggctggggaaacttgtcagaaagcactgaacaattaagaaattttccaagaaaatgtgcagtattctctgctacttctgaatctgttttgtcttcctaatctatcacaattgccacccatcgggttttgggtgtgtgttttcatagcgtggttactttctataatgctgtacccagattctaagaacctggagaaggattagcagttcttagtaagtttactgtgtataggaacggtttgtatttcattacagctattcatcttttctacattaaaaatatttttctctaaagaaagctgttttcactttatttaagtaacttaaaagactagtgtttttaagaccacaagtctagaatcatcttctagaaaaccatatttagtgatatgaatgtaattccattattttgaaattatcttcagactcaggtagataatcaaatatttttttctcttctaaatttcaaacaaggtaagctgtatagcagtagcagatttcc

SEQ ID NO: 129888 - DNA, 1065 bp, Homo sapiens
agaaatatttagtatgtaattcatgatgatgtgcaagtatagcctcgagagattccgccactcccacaaatccctcaaataatcatggactggctgtgcttcaggcactttggcggctcactataatttattattcatagagttatctttctgagactgtcagttttaagctattttaaaacagcattacctttactttagcaatacttcatttcttcttgtattccctagcttataaagaatttaatttcatttttaaaataagttattccgtaggatgatgttgaaatacatctgcattagcaacaccggcatactgcacaatagagtttaatttatatcatgatgactacatatttgaaccagactagagaaacatagctaatgaccataaatctaatggaatatgtatcaatgtgttttcttccttaggtagatacaatcagtttaaatgctgcaagcacactgttagtttccggcaccaaagaaggcacagtgaatatttgggacctcacaacggccaccttaatgcaccagattccatgccattcagggattgtatgtgacactgcttttagcccaggtagatattatcctttttaaaacagataatactaggtaaattggaattttgaaataaacaatattgttaattttgaaataaacaataaaacttacaaagaaaaacactatttgctgataaaagaggttttgccaatggctaacactgctttatgccagggtacagtatacttgtggcatttgtatcaggtagaaaagccggactgggtatttttaattcctcattagagaaattaatttaagataaaaatgaactcataatcaaagggtcatctcatccttacatcttggaaagggctagaaccatttcaaggagaggatagtcattgcttaagtacaaggattttgaagaaaacgaatgtggagattaggccactggactcagaaataaaatccagaataatgtaaaccacattctgaagctgtcactcatatctgagtctcaccttgtgttgcagatagtcgccatgtcctcagcacagg

SEQ ID NO: 129889 - DNA, 1089 bp, Homo sapiens
ctgtcataacttcttcatgggataataatgtgtatgtatctgtgcaccctgctctgtgattcgacgtgcagaatagctgcctctgtggacatgaggtgtgaaaagccagaagctttccctgccaggacacagcactgttttctaaagggaacagatattagagatgaggacagtatggttggatttgaatatgattgcttagattgaataatttctccaattggagtctgtttttctctaagttttaaattgaggagaaaacagatgagccagacatggaaatttctaattttaaattcaaattttgaatattttgatttagtaatttgagaacaagcaatttgtaattctagtgagccttagtaagtatagaatgaaacaacataatgtttctttaatatatgtttaggagccttaaaattaagccagactactgttttaatgcttctcattatcttttagctatttttattccatagcatttggaagacgccaggacacgttaatgggacatgatgatgctgttagtaagatctgttggcatgacaacaggctatattctgcatcgtgggactctacagtgaaggttcatatataatttaaaaagtttttttaacttggtgtgctatatggcatatgtataatttttagcttaaaatgtacatacagatattataagccactcaactacctattgctaatgtgttcagtcactccactctttttcacaaagcgtgtgagtgtaaggatattgaatgttattgcctgtgtttaaaaaatacatataaaatatatctataatatatatttatatattatttatatttaaaatataatatctgttatatattacatatatttatatatttttatttatataatacatattatatattttttaaacacaggcaataacattcaatatccttacgtatcacatactttgtgatatgtacattctttttattttttgtttaaaaaaaacacttccttatttacttattttttttagagacagtgtcttgctctgttacctaggctggggctagagtgcagtagtgggaattatagccacttcttaatataata

SEQ ID NO: 129890 - DNA, 1071 bp, Homo sapiens
ccagaattctatggtgatgatgtgagctttctagtcaatagcctgaagttggatttgggaaagagacaaggaggacagatggttgacgacgtggagcttcccccttgggcttccagtgagtccccccttggaggtgttgtattatagacatgctttaccaagtagtgcaatttcagtaattattttattgcttagatttttaaaaatcacaatataattctctaaataaggatatatgagccctattccatatcagaagtattctatgagtctgtgatgtaaaaacattaatatatatttgagagaccttaatgtgaaaatgattcttgccacttttttccccaaaaaacttacatttcatatgatagaaaaagaaaactgcattaagaaatatggacctcttgcctgtcctagaagctttatatacatatagatagacaagagaaatgggaggaaaaaaatgaagactccatgatttttcgattgagtctaatctaataggtcccgaggactttctccagaagagcaaagatgcattggaaagcaattatgtgtctgaacaccttcacgagtggattgatctaatatttggctacaaacaaaaagggagtgatgcagttggggcccataatggtatgtaatattcattgaaattttatttagcattgggtgaatatttagcattattcattttcattggaaaatgaaagcaaacaataccaacaaaaaaatgaggccaaagcaattagtcttatttcttcagtggaagcatgttctgtcagactccagcgtccactggctgcatgaccctggatcagatatttttttggttttctttttgagatggagtcttgctctgtcaccaggctggagtgcagtgacacaatcttggcttactgcaacctccgactccctggttcgagtgattctactgcctcagcctcccgagtagctgggattacaggcacctgccatcatgcccagctaatttttttgtattttttttggtcgtgacggtttcaccatgttggccaggttggtctcaaactcctgacctcaggtgatctgccc

SEQ ID NO: 129891 - DNA, 1089 bp, Homo sapiens
gttttgcacctcagtcgacagcatttttggatctctggggagctttctttgctctccagtctcaactctggctttccatttccctgaagatctctcttcattctgcagcccttactcacttctatcataggttgctcctcctcctgccactcacctgttgatctcttctttcctttttgcaatcatgttcatttaggttgctttacatgctcaacattccagtcggttttaaaaagctatgaagattgttcagtatatccagctcattttggttgttagggtgaaagcttcaacagtctcttacagctttcccatcctaacttgaggtggagatcttcctctgtatctttttgtcctgtcacttataaagagatttatttttaacccagttatttcagtaattgccttaaaatgttgatgatttggttgttttcccttattttttcttaaatcagttaaagcagaatgagaagggactttgttgattaaatattttaggagtgagtagtgaagagatcatttttcagaggttttctgcagtaaattcacagagggatatactcaaaaatatacaaaggaatatacagttactcaaatgtattataattcaagtaattataattatgtagtcagagccttataaagtgtagtgtgaaataaatgccacttgtgtcaaaatggtttataggatgataaaaataatgacagaaaaataggaaataatttaaatgtaagaatagtttcaaggcctatttattttggggggaatgagtttagctaagggttatttggtattatttacttgtctgtcatggcttctgtggtagataatctcacctatttctttgaaaaatgagtttttatcatgccatttctaaagagtcagttttatctaagcaatcaatttatattaccatttttcttatattaaatgtagtgtttagacaaatgtcatagaaagtcacactgtagctcccttagataaacctagaaagtagatcaatttctgatttttcttacttttgctgaaaaacctattttcaggttccaaaacatttctgaaaagctgcacatggaatgcaaagcaga

SEQ ID NO: 129892 - DNA, 1063 bp, Homo sapiens
ggctctttacagaaagtttaccagcccttgatctagatagtaattttcaatagctgctaaaacctttaggtgagagaagctgctgggaaattttgtaatggctatatggagattgacatcacctgatcctctgggtgcctctggatgtgaaggcagtacccgtgtactacctctgaaagtattctttgaacactggctgtatacatgatgacattaaagaattattaatttcttagagtgtgttaatgattggtcacttattaagagaggctgtcttcagagatttttgctaaaatatttgtggataaagtatatgatgtcaataattttctgtgttattcagcagggtcccagggggttatacacaagacaagagtgaccacatattgacaattgtagagctaggccattggtacatgggagttttctattctatttgtatatgtttagaaatttcataaaagtttttatgttactattgggtaattttgggtattagaaaagtaaatgcagttaacaacttggaaaaatgatatgaaatggtataaaatttcaaaaaccctttgagaaagaattgcaaactaaatcataaccttcagtagaatgggccttctcatctattcagtacatgtatattgagcactgagaatagaaagccaaagtaaatatttactgctcacaaaagaacaggcagtgttactctggggtgggatgagtgtaggcattctcagtctgtaagactatttctcagtgtgatgtttctggattcattaagtttctagccaatagatgctgtaaactatatggagatacacatataaaccaaagaagtttaattaaaaactttctaacatttgaattgtaaatgccaatatgaaccactattctgtgttttgttttaccagttaatttaaaaatagagacgttctctttatatgcattattgatcttttattatgtgatgctttagtaacctgctttctagttaaaatgtactatgattatcttgtgatttttgttatgctcatcaaacaatctgttgtacttggatccctaggaaaat

SEQ ID NO: 129893 - DNA, 1021 bp, Homo sapiens
actccgtaaaatgtagtttgaaaatcattgttctaaaaatcatgcaacttaattataataatttttacatagaaaaattttaaagcgggtataacaacactttagtaaaaagaaaacatagactcagaaaagtttcataatcctttacttcaaacaatatgatttggttatatcccttcactgtgtgttttacatttcttgcaaaatatgcatattgataaattaaggaggctataattaattcacttaccaaaatgactttagttctaaaatagctgatatgattatattttaataattatatggaagaattgtctctgaaggctacttgtgcatcatagaaataaaattatgccattgtcttattgaagaatacttactctattcttccctctctataagagaaggagtgaggcgattaggaaagagaaggaaggatgtgtaactccaattctgtcttgtgactatattgaaattcagattaagtattgatagtgtgcattttgttttgcactctggcagtttaccctgtaattgattcttgttcatggatttagatatggaggacaggtcaataaaagttacagattaggatggtaaaattggtttctgctatcatttttaattttttgagttacttttcttttggttcagatgatgatgatgatgatgatgatgattttgagacggagtctcgctcttgttgcctaggctggagtgcagtggcgcgatcttggctcactgcaacctctacttcccaggttcaagcaattctcctgcctcagcctcccgagtagctgggattataggcgcccgccaccacgcctggctaatttttgtacttttagtagagaggtggtttcaccatgttgaccaggctggtctcgaactcctgacctcaggcaaaccgcccgccttggcctcccgaagtgctgggattacaggtgtgagccgctgcgcctggcctattatttttttttgatgagcatctcttctggtgttatgaatataacttcttctt

SEQ ID NO: 129894 - DNA, 1084 bp, Homo sapiens
aatcatagcagttttccctgaaactttgcaggaggccaccttctcttctgggagaccagcctgcaacaaaccaatattgttaagtctaattgttctttgtaggtaatctctcttttctctgactgcttttaagatctcctctctgtagttttttgctgtctagatatagatttttttttcttcatctatcctgcttgagcttcctaaagctaaaagttttggaaaatttggagccaagctgaactaaggctagaacaaatgttctctgatccaagtccaacctcttttccactgtaccatactgcttctattttaaatactaggttgtgggctactggccagtgcttatttttatggtatccttgaagtttagactgattcaggaatgaatgaagcctgttttatgtagatatcagaatcttgttagtcaaagtgttgtccacaggccagcagcgcatgtgtgcctggagcttgttagaaatgcacattctcaggcctcaccctgaagctgctgccttggaatgtgcattttaacaagatccccagttgattgtgtgcacactaacctttgtgaagcgctgcgctagataacagtaattcagcattcatcttgattttttatttgtttgttccttccaactgaacttccttctttaacttcttgatagtacatataaaaaggctgagggaagcctcctgccctgcagtatgacacttgatgaggaaactggaggactttgagagcatagatgacatttttaccatttcttctcataaattgctgggacttgaaaatagaattgactggctttatggatggtgtcagtgaaagggattttgatatctgaaccatcttggctggaagtcactgcatctcacatagtcagggagaatgtaattttctagagtccagctgagtgatagaaagctttaacctaattactgaggggaagggctaaaaaggccagatgaaatagtgaaattgtttaaattcatgagaactctttctgggagggaagaagggccagtaatttataggagaaaacaactggtacaggaactagaaatgatacttagtccctca

SEQ ID NO: 129895 - DNA, 1057 bp, Homo sapiens
ttttaacttgtattcagtaagtaacttagaattgttatcttcttggtgagttgaattttttatcaatatataatgacctctttacttctagtaattttttttctattttgtctgatattaatatagctatatcagttttcttctggttatttgctttgtatgggattttccattgttttacttttcactattctgtgtcctaaggctttaggcctgtttcttataaatagcttatacttggactttttttaaatgattcattttgataatttttatcttaatgaattagtttagtctgtttacatttattattacaaatatatctgaattcacttttattttttagttttgttcttttattttgccttccttcccttcttcctttggattaaataaggcccccttgctccctttcatttttccccaaagagtatggaagttatatattttatttgtttttctaatgcttatccttaaaacataagcatattaaatttaagatctgaagctaatcattatctttactctcctctctaccagtgtaagaaccttggaacacttaactgctgtgcccccatcctcagttatagtctgttattgtccggtattttttatctctattttaaacctacagattgtacattactaattgcctggttaatgcttctgtagttttacatgcatatttaccattgtttttgttcaatattccttcttacatgtcatatcctcgttacggaattattttctctttcctgaagaatatcctttagaagttcctctgatcagggttggatgatgataaaccacctctgtttttgtctgtctgaacatatccttattttccttttgctttgaaaatccgttttgctagatgtttaattctcagcattttgaagattatccaaacaaaggcaaagggccagggaatatgcatcagacttgctggagtgctctggggtgttgggggggtacctcacagagaaaggtcagtgatagttgtgccttgtccccctggggtaacgttcagctacctggctgggccaacttcagactt

SEQ ID NO: 129896 - DNA, 1027 bp, Homo sapiens
atttgtttttaacttacttaaaagttaaaaattggtagcatatcaaccccccggccccccttctggatttgcagtaggattaagatgcagcaagacggtctgcagaaaaggcgcttgcaacttggtatgtaactcagtatttcacaaaaccttcccctcctccaccccaatgtctattaatatctgcaggcacattagtgttctgtggaacacagtttgcataatattgatgtgtttaccagtctgggttccatcctatgaaatgtggtgcattatttttaacaggttttgttgcattttagtcataatgagcttttggtcataatgagtttgaccctcaagcttgtaagttgagaataactgacagtgaacaaggaaattaatttgcaaattagactcttggggagaactttcgttcacttctttcttaacagtagctggggcctccgagtttaaatggccttcatactacagttcagtttaatattacacagggcagacaaagtcatagattgtaactgaaagaattttggggacgttttgaatgcaaagaatttgtgggatctatttaatggtgctgcaagacataatttgagtgacagagggaaggcaggcaatctgtaattaaagaagaacaagggttcttttggttagtcattgtcacaaatatttaatattatgggatttgacttctatctgttattggaatttttttttttactgcaacttgttaagatcgtaagaacatttaatacgttattaatctgttttgaaaaagcaaccatgtggtttcactcatttgtaatttaatttgacctagtaatggagaaggaagctaatgaaagatcagtggtgttccttttgtacaagtgtagcaaacttcctacttgtcaagcctttaactgtgacttatttgttcattaaataatccagcagcacatgtatgaaactattgtaagtccttttctgaatggtggaaactttatttggcacaactatgccatttaatgctttttactgttcacaa

SEQ ID NO: 129897 - DNA, 1107 bp, Homo sapiens
cacatgacataaataaaagtggttttatgtttcaccttcatctggtaggtgagcactccaccttttcttgtgaaacataatcggttgtgacatggcaaaattagatcctggctatttattatcttctgaaatcaaaccccataactgggaaggcatgtggtaggtctgctggggcagcttgcatgcagagaggaaaggggggtgggtttccagttttataagctcaaggtgattttctccaacatctcgaacattttaattaattaccctgaaagattgagtaaattattatttgaatactttatggcattacatgttaacatttcaaggacaaagtgctgtactttgcttttcaacaatgcttcatctgtcagaatatatctttgaaatttatgtagtttgctacagagtaaagggggggacagacctggagtcctatgaattattaggagacaccagagtcaaatgtgatctattccacaataaaaggaatatttattggtatctgatttcaagttaggtattaaaaaattaacagtgaaattgattagctatatttttctccaaacatgtgaaacaaaattggctttctttgatgaagtttgtctgatttttttttaaccttcggcaaagctgaaaggctaagcaaatgcctttaaatcagaaggcaaaattcatgaaaacggttttgggcatgccagcttctccctgggtgccatgcttcacaaagtatgttgtaagatatgtgctcgactgttgatgcttttagagaaaaggtctttcagtttagatatagaaatctttaaaaatatatatttcattttcaaagcattcttcagcctgcagaaagcctggcttgctgagtttgacaaagtctgtttaaatgtagaagtgcataatatgtcataggctgtttagttgatctttgtaaccaataacaagcttctctctgcagatataatctttctttctccataagggcactgaaccttttactaacttcatcctaccatcagtagattagattaaatccccatttactgcatcatattaatattttcaatggtgcactaatccaagaaataaatgtgtcagtttctatggcta

SEQ ID NO: 129898 - DNA, 1026 bp, Homo sapiens
gctttagaatcctacaactgtagctacagtttcccggtgacatttttttcaatgtcagaagagactctaatggagaaaatgaatattctcttcctgaagctttctaaactaaaatgtgattgttttactctgctgacactttccggcactgctgctctatagattgccaaaatgctacttacatttttcagttaataaactctggaggaggcatttttggaaacggtttaatctagtattgctctactgtaagactaatacacgttatgaacatatcactatgcaaagtagcctccattttcacatagcccattgtgggaacaatgcgaatgatgttggttaaggcaagtgtgtgaggcatctcttacacaaacagccagaacggatggcatgttgctgtatataggtcagtgttggaaatagcagtgtagctcatagactggacagacacatggaggctggagttaacagtattcacctcttgcagcctaatgcatggttatatttcagacattgaaagatgagtaccatagtggagtttcatctaattagactattttaagtaacattgtatcccttaattgagctgaatgctaccaaaataaattggattaaatgagcttacaattggagttctgtagtgatatagtcttgttttctattctagttaaagatgtcagatcatcagtttaaatatatacctacagagtaataacagttcttttcagtttcttagtgcagcgtcatttccaaagattgttttcactggttttatgctaagataggacaaagaagtggtactttttcatttttacaacgatgtgatgtgttcagttattgctcagtatctgcccacataaggagtagtaatacaattatgttatgacatggctaatgacagggatggtgacctcggcctgcagtgggaggagaaataatgggcttcactgttctcagtggttgcctttatggaatcatgtcctgaatctttctttggttgatttagaaacagggaagtccaaaaca

SEQ ID NO: 129899 - DNA, 1033 bp, Homo sapiens
caggaagatgaatggctgttccaagggaggcatcacacaggaagacttttttaagaacgcatcatatgaatgttataaataaaactaagagaaaagctgacgattttatcagttgtattaaattgtaatagttcattaaataatatctcagaattgctttaggtgccaattagctgatcccctcccaacaacaatggaaacaagactgctgttgagcaagacgtaggcatagcaaatagtaagtgctgaatggttccaaaacagccctggggtggaagaacactattaactgtaaaatagccaaattaaaaatcattgaaagttagatttcaatatggtattttctttttcaagagaaagcatgaaattacattaaggctcatgttgattactcaaaacagagaaataaggatctcttcttttgtacagcagtgtgtttgctgagtacaagccttcattttccgctacatttctctgcctcagtacataattgttgccttgtatgccagttattccacacgtattgaagtacaccaaggtggtgagctaatccttcggtttaatgcagtattatgcttagagtaagattcacaaatattttgagtgaagaaatgaataaagctccaaattggatgattaaaatcaccttgtattcttacaagggaattggttaaacacaaaacacactcagttaatgttcaacttcatgggtaatcaggaaatgcacattaaatcatctatgatacatcacttttcacctaacacacactgcagtgaattgtaaattgctacaacctttctagaaagcaatttggcaaaatatatcaagagctcaaaagagttcataccctttgtcaggataataacacatccaagaatctattctaaggaaataatcagcgacacaaagatttttgtacatcgtcttgtagctgtagcactatttataattgtaaagatattacgattttgaaacaatgtctgaaaatagaattgttgcatttctatgattaaagggctatgattaaatgct

SEQ ID NO: 129900 - DNA, 1032 bp, Homo sapiens
tcttttctgaataagccattgaggattttcaggcaaaaagagacagccaaaaaactgtataactgctggaattgcttcaagttccaacatgtacctatcacacctgattacataatatataactttgtattcagcatatcacctagtaaagtatcttgtacacagtaggcatttggtaaatgttttaagaaataatacagaagcacctgtgtatctaaattttctgtattaactaaacagaaaatagctgtgctttatactcatatagccttattttttgcagcctctcttctggatcctttagcgctgcaaaattacttgcacaataattccttccaaccaaagcattcattattctagatataaccagagctcttctggaacagtcttcagatgagagttagagatcagattttccttgtttttagtgaccttgacaattttgaggagtactggtcaggtgtttcatataatgtccctcaatttgactttgtctaatgttttccttatggtttggctgggcttgtggtttgaggaagatcacagagatgaagtgccattctcaccatatcatataataggtacatgctgtcatcataagtcatgatgatattaaccttaatcttaaccttcatttctagaagaagggagtgtttgaaataggctgtgttaggtaaatcttagatttgcaatcatatatttgctttttatttttcttctgtagaaattgactaatactttaacaaaagctgattggcacaaaaggaaaaattggaatatagataatagaatttatttaataatcctgagtaattgcatgttaaatatttataaagtctgttgtttttatgagtttatttatgaaagatggattttttcccagggggcttaaactgattaaactttttctgaggctatttgataagaaaggaatagtttcctatattttgttcacaaatagtaatattaataagtaatatgacaggagataaacagaataaaccatgttacagcacatattgcatttataat

SEQ ID NO: 129901 - DNA, 1044 bp, Homo sapiens
tggaccccaggttatttccttttgcagaaaataaatacattgtgacctttaggccccattaactctgaattggtgtgattttacagtttgataatcaatttcatatcactttcttgaaaagtgctaaaagtatatttttaactatgtgaggtaatacacatgctaattagctcgatttagccatttcacaatgtgtatatattttaaaacattttgttgacatgataaatatctacaatattttctgtcaatttaaaaagattaaaaaatttaaaaagattttattgtgactatcatatttgaaatgtagtttggtcctggtagagtgggagcaggaaaaaatatatagtttggaaatacataacccagcattataaatattttctaataaatttttccagacattctatatatttgtatgtatctatgtttatatatgtatgcatatgtagaaatgtgtgtgtgtatatatatatatatatatagtgtgtgtgtgtgcaggtgtgtccacagatacatatatactatatatgcataattctgaaatactgcatagtaatataatttattaaggaaaggaggctattttgttttattattttttctttttttccaaaggacattgcccagaaggaggccatttagtttgtttccagtttctttttgcagtgaatatccttacacatagactctttgtatgattggataattatatgtctattataagttcctagaattccaagtccaaaagtatatgcattctaaattttaatagagatttattacctaccttaggcaactaataagactgcaaatttcccactgccattgctagcaatgctagttcaacatcaaaaagttcagtatcattgaactaaaatcttagctgatgttgttttcctatatgagaagcacattatttgttatctcaaacaagtactattgtcatatatatatatatatatatatatatatatatatatatatatattctgcatttattatttatttaatagaattgtaagtcatttgggaattaggaat

SEQ ID NO: 129902 - DNA, 1048 bp, Homo sapiens
tgacgtgggcactgcgagcggccgcggcctggccaggcccggtctgcggcccccgacccggccagtcttgcagctgagggccgtggcagccgtttgcgacgcccgattcaggaagtgtgtgacaggaggggaggcctagcgcagggccgccggggcccgactcacatgactgcaccccacccccagggccccttgcgttaggtctcttcgcggccccaggaaaaagaaggagggaaacctaggggagcagaaggtgttggggcccgggtcttggttcctgaccagtccaaccttcctccaccagcacgcatctatcaaggcctgggcaaggcgctttttggcgtgggacaggcagccgagaaagagaaaaggaaacctttaaaatatgtattttatatatatacatatatataaaatatgcttttttaacaccttcaactctcacgtcagaataagtcacatctcattacttgacggctggagaatccctttcggggttaggaaagcatgaacgagttctgtggacttttgccacgtgtgaactggggttatatagtaatgtaaagtcgttcagtgctctgggtgtgtacttaggtatgtgtatgttgaggacgctgatgttttagatatgtcaagtccggtgtcacaactgctaattttcaggtgagctcatgtccatgagctgaaagaaattcagttattctcacttaaaatgacgtcctagtatatttcacagaaaagtaaacagactcttcgtagatatttttaatacctgtgatttggcattactttgaatctaataataaacataaagattgtttagatgttgcaactattaatataccagagtctgatttcagtggttactcttgcacaactttggaccctttgcacaacttcggtcatgtaagcagcagtttgtagttgaactaatgatgtggcaggttctataagtaactaaagaagcatgttggccggacgcggtggctcacacctgtaatcccagcactttcggaggccgaggtgggggatcacctgagatcaggag

SEQ ID NO: 129903 - DNA, 1066 bp, Homo sapiens
catggcagaaggcaaaggggaagcaggcaccttcttcacaaggcggcaggagagggacaatggaggaagggccatgccttattaaacaaccagattggccactcccctagcatgtggggattacaattccagatgagattttcatggggacacagagccaaaccatatcaggacatttatactcaaagtctatgatatgaggtggtgtagacttctttgaagtggtcactgaatttagcactaaccagtgcaaaaagacaaccctgctcatttaccctaatcatagtatccattattttttttttgaagtatgttcatgtatatacttagtaactgctgacattgagaatcttgaaagaagctttgcttctgattcctcttaaaaataatacagtatagcgagtgtaaatatacaactgcttttatagggcattttctctagaggcataactcattgaatctatgaggaagacaccattttataggtgaggaaagggacactggttatcacatacagtctttttgtatacagctagtaactgaccaatatggaacatgaacccaggtttttcggactccaaagttcatgctctcttccccatattacagttcctgattcccataaatttcacatcagacctcttctgttggcttactgtttggtctgttaagtttctgtgagagtacatagccttcaattcccttaaataggtaggacctccattcatgcataatagtgcagaactatcctatataaaagtaggataaagtactttctctgctatttaccagccatgtgactatgggcaacccatttgatctttctgagtctttgtgtcgttatctataaaatgggaatgaataaatgatatcatatgtgtaacagtgacttgaataacaaatgattatatcttttttatcctgcttctttgaatgttacaataatttccccatatgcatttgaaaaattcacccaaatctgaccagtgctgtatagtgtctaatgctaataatagcaaaaacataattttttttgccctctgtgtgttctaatatgttgatcgtc

SEQ ID NO: 129904 - DNA, 1081 bp, Homo sapiens
caacctctcaaagtgctgggattactaatgtgagcccccatgcctggctgctcctggctgatttttaaattttctgcagaaatgggtcttgccatgtttcccaggctggtctccaactcctgggctcaggtgatcctcccacctcggccttccaaagtgttggattacaatatgaaccaccatgcccagccctttatcaccttttttttaaaaaaggcctattttttaatgtagcccatttctatatttttaaaaatttcaatctaggagtctgtattttaacaggagaatttaatgtttttatatgtattgtaatcactgatggatttgggtttatttctactatcaagtaccaccctggttcagtcatatagacaaagatcaaggtgtagatcacaggcatgcccacttgtcatgggcttttgggtttagacgggcacatgtcttggcacaggaaacaatgtggtagattttccaagcatgtataggtcacctattccttgcaggccagtagagagattactgaagagaagatacctgccactaacttactagtgcacatgaacaattaatttaaattctgaaattttctgtttctaaaacaggtatagtacctgcctagtgcaccctatagggttattcaccaagactcagggttttgttttgtttttttcccctagctttacagctgtctttaaaatttaagtgtcagtcatgtgtttccttcatttatttacagttgatatatcagtgtcagtggtgtattcatgcttgctctgctgccccagcattattaaaattgatggatgacccttttgcatttgtccttctttagaaatagctactatgtagtcctcgctggttattttagcttagacaccactcttgaaaattttccgagagcctggtatttgtaattagcatatctcgattaatgtggtgtctgtactgtttacttgtgacctcagtaaagttcatacctcttcagttttagttttctcatctggaaaaaccaatagcaatgcctggattatctatacctcacaggatttttgtgagcttaaagtaaataatatgtgaa

SEQ ID NO: 129905 - DNA, 1158 bp, Homo sapiens
ttttaaaaactctcataactgaactaccatttgtcagcttctgattctgttagttgaggtctgtggtagcaaataacagaaaccaactctggttaatgtaaacagaagatttgattggaaatattggatggttcacagacaggaaagcagtaaaatcaagtttgaaaatgggcaaaatgaaggaaggcaaggcacagccaaattgctgttatcaatacggcctgcttgagaagatgctggatgcataccactggcctctactgctctctcatctccactgtagccaccatgtattgtctcttgatggtccttgatattgcagcactttttcaagattctaagttctagataggagtatctgattggctcagtctaggacacctgtctccctgccctagctgctagggagctcaaagaagagtgctctgatgctaggtagccagaaacagcaaatgtccacctactcctgctttgatgaatatcgttatagataatattgctgttagccttcttgtgcgtttgtgcaagaagtaaaattcctgggtcaactggtatttacattttgcattttgataggtactgccaaattaccatccattaaaagtatgaatttagaaagaatatttaattttgactttggtatatatttcaggtacttacaattcaacaggctaaccaacattaattgtgtatattaactgatgcctagtctatgggaatttagcagtttgattttgttactgttaatacattatttctttggctcttgttaatttaatctgtcaattgcacaagagtttttctgcttacagcctttgattttgatacaaaccatttgtattataatatacgacttagagatcatgtacagtaaatttattagataattatattttacatttacatccagtttgatatatactatcatgaaaaagttttctcttcaagcaactttattgaaatatatttctgaaatactgcagttcttatttggaatttttagttatgaaaggattagtaaaatggtcagattaaagtgtgttaagatacatgacttatctatgtgacctacttggaacactattatttgggataaactcagcatagtgcaaatagtattcttttaaaaacatttctctttattagatttctgcagtg

SEQ ID NO: 129906 - DNA, 1050 bp, Homo sapiens
gttccaatccactaaattggtttcatgacctaactagttatggcttactgtctaaaaaacatcacaccagaggacctctctagttccaacaaaaccgacatcctacaattctaagaggtatttataactgttttcttttttattttattttattttatttattttcaggtagagtctcactctgttgcccagtgggagtgcagtggctcactgcagccttgacctccctggctcaagcaatcctcctgcctcagcctcctgagtagttgggactgcaggtgcacacaaccatggctggctaatttttgattttttgtagagacaggatctcactaggtggccccaactggtgtcaaactcctggcctcaagcagtcctcccacctcagcctcccagtgctgggattacaagcatgagctaccatgcctggccgtatagcccagttttattcttcctgatttttcttaaacattctagccgttttccactattaagataaactagtgaggaaagttccatgagttgggaggaagaaaggaatagggatgccatttttgccgcattcttacttgctattagatttaatacctctgtaacttattccctaataaaattatcaaatgctgtattttccaactttttaagatttaaatcatatctagctttgtatttgcaaaaatactgcacttgaagacaaactatgtctttcctaagaaaatttaaattctacctatattcaaataccctcaactttaccaaattaaatttggcttatctaatgaaggatacgttattcatgctagttgtatcattgggagttcaattaggaaacataaactacacaggaatttgaacagagaaagtctaatgtaaacagtccttaactgtaacgtagaattagagtaatgggagaattggctaagaggtagaaagaactctgaagactgtggtaacagcagatagggtagtagtcactacctctaaggctatgcagagcatggaaggaaggacagatctgacattcaaacctcattggaggggcatggctga

SEQ ID NO: 129907 - DNA, 1022 bp, Homo sapiens
gattacaggcatgtgccaccacgcctggctaattttgttacatttttagtagagttgggctttccccatgttggccaggctggcctggaacttctgacctcaagtgatctgcccaccttggccttccaaagtgctgggattacaagtgtgagccaccgtgcccagcccattttttttatataagagtaatgcctacacatggtaatgttaaaacaatatggaagggcagaagattggatatggtgatgagagatgacattatataagacacaatgggtaaaaagcttttccttatgtgaaaactctggggcagaagtcaactcttctagtgtgggctgtgcatagtaatttccttcccaagaatacagtatggaaaagagggggaaagttcctttccattggagaagcctgacagactaccttagccaggttatgaaggttaaagtcaacagtgatcagtcacattgatagtatgtacccttgatatgatgtgatgaaaatggtattctttctctgtcatcttccttccaaacacttataatcccagtctaatcatgaaaaaattagacaaatttcaacacagggcatgttacaaaatacctaatcagtactcaaaactgtcaagaacatcaaaaaaggaaagcatgagaaactgttacaaccaagaggaaccttaaagaaggcctgacaattaaatgtaatatggtttcttagatgtgatcctgagacaacaaaaggacatgaggtaaaaactaagggaaaaaattagaactttaagggagttaaaggtaaagagattttataaagagtgcaggataaagaataatcccagcactttgggaggcagtcagatcacctgaagtcaggagttccagatcagcctggccaacatgatgaaaccccatctctactaaaaatacaaaaattagccaggcgtggtggcaggcacctgtaatcccagctactcagcaggctgaggcaggagaagtgcttgaacccaggaggcagaggttgcagtgagc

SEQ ID NO: 129908 - DNA, 1084 bp, Homo sapiens
aagtcttaaagatgagtagctgagtagacaaaagaagtcgctggttattagagaaagaacactgaataggctgggtgcagtggctcatgcctgtaatcccagcactttgggagaccaagtcaggcagatcacgaggtcaggagatcgagaccattgtggctaacacggtgaaaccccatctctactaaaaatacaaaaaattagccaggcgtggtggcatgtgcctgtagtcccagctacttgggagctgaggcaggagaatcgcttgaacctgggaggcagaggttgcagtgagtgtcgagatcgcgccactgtactcctgcctgacgacagagtgagaatccgtcaaaaaaaaaagaaagaacacttaataaatgtatgcagaggcccaatgtgtaagagatactgacatataggaacataggctttcagctgagtttatatctcatttactcatttttgtgattttggtctcatcccagaagtgttttaatattgggggtactttaatattgtaaaagaaagaaacagaaatagtagtagatgattgcatcaagggaaagagggtagagggttagttcttcatattgtccatttctttttttaattgattctttagcaactctcagctttgttagcgtacttttttctgcactttgcagtttccaggagaaagatcttttacattctgaaagccacatcctcttgggaactttatttttattaccaaacttgatgcctggaatatagtaggcatgcattcaattaatattctttgaataactatctcttctcttccctcctagctttcactgggcagccttctcaaataaatgctctgtattcccaattttcttttcccacaccactcaatatttcttgtgtttgagtaacttactgattgcactaggaattattatagacagaatcaacaagactgggaaactaacaacgtaagagtcttaagaggaatgaaagatgactcttgattagtgtattaggtttttagggccactgtgacagcttacgagcttggtggcttaaaatcacagaaagttgttctgtcacatttctggaggccaga

SEQ ID NO: 129909 - DNA, 1340 bp, Homo sapiens
aggtcacaggttatgaaattatccagatggatttgaacactggtgttaaaactgtaaagcctgttgtttattaattttctgtttgaaaagggcagactttattttttcatgtttcacggtttttcagtttgtaatgtaattacaaaatggctagtttttttgtatttttggtagagacagggtttcaccatattgcccaggctggttttgaactcctgagctcaagcagtccgcctgccacggcctcccaaggtactgggattacaggcgtgagccaccatgcctgacttgcgttttcacatattttaaattaaagctgtttggcttgtggttgtaaaaatagaatcatcactaatattgacgaatcctgcaattagtgggaagttggtttaggacaaggaaaatgaactccagtagaatacccagcacctactcgtatttcttgtgaaggactctttgccttaaaatgcaagaggacttaattagattcttgggccccacgaaagacgtgctaagtctctgggatggggcttcaggaatctgccttttttttaatttttatttttggagataaggtttcacactgtcacccaggctgtagtgcagtgggacgataacatctcagcctcctgaactcaggtgatcctccctcctcatcttccaagtagctgagactactgccatgcaccaccatacccagcttattttttgtagaggtgccatgttgcccaggctggtcacgaactcctgggctcaagcagtcactcctcctgccttggcttcccgaagcactgggttataggtgtgagccatcacacccggcaaggaatctgcatttttaatgggtactacttataattgttacctcattgacttggtatttaaatattcagctctcacaatggtgtcctactgagggacagtgactccgaccctgagtaaaggaagaaggtaaggtattggtagcaactctaatagcagcattaataagtgtagtgatttgtattaattacagagtggtaatgatctgtgtatatccaagatatccacaccaggccttaaaaaacaatgttttgcacatcattaaacaaatattcattaaacaaattcattattcattaaacaaatattcattattcattaaattattaaattattcatttttcattaaatatttcatgaatactagctcaacagatcattctaggtgctttggaggatgaaaagatgaataggaatacagatcttgccctgaaagaactttgtttataaatgttgtaaaaacaggcatttaaataactgtagtgtaagataaaagttagtacatagtaattgtcatt

SEQ ID NO: 129910 - DNA, 1055 bp, Homo sapiens
tgaccattgtttttgattttcctgtctccatgttgggaaatggccattgtcaataactccaaagttcatataccattcaggagagcagagattctctttaactcaatttgaagtttcctagggacgagagttcattggctcaatttggttcaggctcacttatctcttgttctgtccactcttttcatgggcccagaatcacttttgtacaacatggtttccaaattggtagtcgtaggagcaatctgggtgagtagtcatacatagccactaccagaattccctcacacctagctattctatttagtcatcatgtccttatcttttgtcccctgtaatgatcagttctctactctgtttataaaccattgactcctgagctcatgattcttctcagtctgcctctcttgctttctctcttacttttccctaacacgtatagacactatgtgccgtcaagtctttgctgcttgctactccctgaatacttagtactttttcataccctcaatctttctcttctcagaggatgccattgcttgacatctctgcttattacagttcttttctgaacaactgtccatatcccaaaccatagctcccatttaaaggaggtaagatttgtatacccacgcctgtggagaaatattgttaacaggaaaggaacaagtactgtataggcacacagtttcaatataatgctccacaccaatagggattcttagtagctcatgcattagaaatccattgttcataatcaggattagtcctcctaaaaaggcaaagcaaattttatggaagatgaatgtaggaagtcccatctttttacctgctgtgtgttaagggaaactacacccagtacacattcataaaatggattgttttttgttggggtcatagtccagccatggctttagcaacagtctgttattaaagaacaaagatggtagctaacatgaactatttttttaaattgaaattttattttagatcctataaagtgaatgtaaatgtgctctatacattcactatgcagagtctcaatatttaagatg

SEQ ID NO: 129911 - DNA, 1037 bp, Homo sapiens
tgagggtgaaaaatttaaggttggtttatgactaagaaggtattaaatgatagaaaagagaaaataaaagaccgtaaaagtttttaaaagcctctatacaaatattctttaacctttgactatctttgagtcatagaaacagtttataaatagcttcatggacacaattcagaaggtacagactagagccttgctcctcaaaagatggttcatgtgctgttgtgctggaccagcagcagcatcagtatcacgtgggagcttgttaaagaacctactgaatcataatttgcattttaacaggatcgccaagtgattcatatgggcactgaaggttaaaaagcactggaggtaatggcttttaaatattgattacccagctggaaatacactttatgtgctttgccttgtgcacacatcctggcctctcagtggctttacttctccccgccgtgtgatcttggttccaccctgcttcagctactccctcccatagtttctctcagaactcatcattaccaatatctggaaccatttcagaatttagtttcatgcatttgactatttgactttgtatcccatccttcctgctcactttctttagtccctaattactaacaatttttttacctcatcagaattatgccattgattctagtatcttttcactctcatctctcttgtgttgctactttcctccttacccagattcaactttaatagctgtgcccttataatcattcctgcatgcacccacagttttcttgtccctctcatgctgtatcatagtctcgtggctaaaccataggttaaatctagccatctattcctgacatttacagctagacaggtctggagaaaagcacagagccatgctaactagtctcattttaatttcttggacactcacatcaagtaaatccttagtactacctgacaattgtacttttatttccattatattcaccctttagtttcctgtagaacgatatcatactttcttgctctttaagcagacatctttgctatctttactctca

SEQ ID NO: 129912 - DNA, 1045 bp, Homo sapiens
tatgttaaaacattgattatagctagtggcagatttggagatttctttccttgctaattattcatgcttggaaccaatactatgatattgaaatatatctatcccttttagtgttttttataccatattaatgtaatttttaagaaattttaatatttaacatttgtgtttaataattatggctcttggatctctttttttaatttttatgttactgagcctgcaaaacatgaagaccacagttggtttctaatattgactctgccacatttcagtatcttagtattttaattatgtccttagcttatgtcttattagcacctcttccttagcttatgtattttctaagtataggaactgcatttgttaaagttgatctgtatattacctagcatagcatgtcttggaagtaaacattctgtttttaatccttgaaagtgagatatattcccactaattttgtaacaaatcatttcctactctatttaggtgtagagttcggtgctcgaatgataactattgatgggaaacagataaaacttcagatatgggatacggtaagtataggaaaagtgcactgtatgatctcagtaaagttactttatgaaagtacatcgtatatttgttttaatgttattatatgcctgttatggtttgttagacactgacttcctgcagccatgagatgaaatgtggtgctggagtagactggtttttcttatgcactgttttcaatagatgggccctgggtgttggtgttagtgagcatatctgagtgaatgttcacgttatgtggtctaaattgaaatgctctagaaactgtatttttaagaaaaacaatcagcatgtctcaagtacacataggaagtaaaataagaatatcaatattatacaataacttattcttcaggcttattattttaaatgttttagtcctaacaacttgaagtcacgttgctcttaattcagtatcctaattctgtcatacccttgttcattgagtacctattacatgtcatacaatattgtttttaatggtgattcc

SEQ ID NO: 129913 - DNA, 1037 bp, Homo sapiens
ggtgggggatgggggagggagggagtatagaggaagggtcaacaagagcaaggtattgtagagtgttgagtgttaaacagggtagaatatgagccgtccatgcgcattctgagggtgggaagggctaaatatttacattgcaagatcagaactcagaatgtgtaaacatcaatatttttcaagttaggggattttgaatataaaaatcgttaaaattggctttacgtttacttaattaaaatgcttatgtttttgcaaaagtaggaaaagaagggattaaaaatgaaaaataacttcttataagagctgtctcggttttaaactcagacagaacagtcacattcctccccagcaattcttaaaaaaacagaaattagtaccatgagtaaaagagaaattacctagctttgcataatctcttgtgtctgtttcacaagtggatataaagatgacttttacatcctgttgccttttgacaagcattatatatcaaatacagagaaaattgattaagtgtggagaaaaaaacttatataaattaaattcagaaccattttgcttttcataataaaatgattgctcaaagaattccatttgatgactgttgaaagctcactgcagtttatgatataactgataaaatctgcatccttggccttccaacaacctttacaccagcagatggtgggcgtaaagatgtcattcatcatttatttacaatgggttttatttattctagtgtcaacagctgccccagggagtgggttattgaattcaaatgtgaggctctgggttatttgcttcctttcaaatttgtcttcagagcttagttgctaggagtccattctgtcctttaataatgattcgtgtattgtgaagccattcagtaaattgggttgtcagggattgccaaaaagggtttagaggtcttgcgggctggggaggttgcaggagcgactacatgtgcactacatgtgcgtctcgttgacttgagcaatcttgagcaatagcggtgttttgtaactttttcctaagac

SEQ ID NO: 129914 - DNA, 1022 bp, Homo sapiens
aaatataataataaagttttttaactttaaaaataaaacacgctttaaaagcaactgctacctcccctcccccccactaataaaattctagtatgataaaaatgaataccctgctttcattggaaatttctagcttacactttctctctcactccgtttctccttttctgtctctctctactccttctccctccctccctccctctctctctctgtctatatcaattttgctttaagaggaaactgggaattaaacaaactgggatcaatgatgtaatgtatctttagtactttggattttctaaacaatttcctgtagtttctgagagttgtattttaatcacattcatagaaactcagtcagtctggccaatggaggagaatagtatagtcctgctctttcaaattatgttaagcaaaatggctttcttctctgggaatgcactgtactcaaagatataaggtattagactagaggctcccttaagttacggctagttctaacgttctaaagctctaacacagaatctttcttctgttggattgttagttctttgaaactagacagtgtgttctaaatactaaccctcataataccctgaataatacagttagtatgttaaaaattaattaaaagaatggtcatcacaactttgaattccatggtacactttccacaaatgcttctgtttgtaccatgttgattagtaatgtgaccctttctttcccatgtttagtgatttagaatctagaagagaagtaaaaaaagaagaaggtgaagcttttgcacgagaacatggactcatcttcatggaaacgtctgctaagactgcttccaatgtagaagaggtaaataagaggccctttaaaatcttcatctttatacttaatagaaatgttttatatatcttcattttacttattatttaagtttttagtcggatggtctttgaacatcataaagtaggaaagtttcttccctttgaaatcccttgtaacattcaccttctgtcagactctta

SEQ ID NO: 129915 - DNA, 1023 bp, Homo sapiens
ttttcttacatttttgtacgtattttcactccctccctttttctaaacaatttcctatagtttctgagagttatattttaatcacattcatagaaagtcagtctggccaatggaggagaatagtgtagtcctattctttcaaattatgttgagcaaaatggcttctctgggaacccactgtactcaaagatataaggtattggacttcttcgtgttgcatggtagggaaatcttttttgtgttgcatgggagggaaacaaggaaccacactaatgaaatttggaaatgtttcaagacagcagaacgtttgtagctatttatatccacttctgcttatttttttaattttatttatttttttaactgtcaatatattaccacatcaccacttctgcttaaagtattctattattgctgtgtaacattttacaaagcatgagaattctgtttcatctattgatgaaatttgtattatttcagttatttccattgatgaacctgaactattggaacttttctgaacacagtgtattcttttatgctctatgtgtttgtgtttggaggtagtatgtatatacatattataaatagatgattacgtagttgatcctttctaaggtaaatgtattactatactgttattttataaaaagaggtaatgaagctaagaaaagtagtagtttatccaaagtaatacttagttcccgatttctagataagaacagcttataagagcaactacagaaagtagttctaaaaaacaaatgagttaagaatcactgccgtaaggataacagaggtcagggtcctgggcaacagctagcatgtgccttcaatgtagtaagcagtcagtaaatatttattaagaatgatacttggagctcttctgattaacccttgaacctaaaaattgactacagtaattctacagcattggtattttcaccgaagaattctttcttaggtaaaatattatacagtcatgtgttgcttgacaaaggagatacattctgagaaatatgt

SEQ ID NO: 129916 - DNA, 1041 bp, Homo sapiens
cgagaccagcttgaccaatatggtgaaacctcatctgtactaaaaatacaaaaattagccgggcgtggtggcttgcgcctgtagtcccagctactcaggaggctgagacaggagaattacttgaatcagggaggcggaagttgcagtgagctcaaattgcaccactgcactccagcctgggtgacagagtgagactccgtcttagaaaacaaacaaacaaacaaaaatgcttcatttcagtgacaccctgagctgggagggagtaaagactcataggcaaaagggactaatacatgtatataaaatgcttcatttcagtgataccctgagcaaggagggagtaaagactaggaagtactgttaggaagtgacaccacttttatttttggagctgtctctgacctgtgaatcctacagtgaatactcttaaatattttagtatctgtccagatgatattggtacccagatcctttaactatacctctgatattccaactgttttgctcttacctgaatttatgctgcctatcttgaactaggatcttaaatttaaaatggcacccaagacaacactttgaagtttatttccaaagagcataagaataaaatgccctagtcttcctaaactaggtgttacttagcgggaagaatttctcaagacaggatcatagagagagagagtactatcatatactacattaataacactaatatacaaccacatagatatttattgtatacacaagtaatacttggaaaatctggattaagtaaaagtcgacaaatttttctaacagttgcccaagctatacctgggcctttttgagctgcagctagagctggagtggctgagatacacaagcagtgtcctgaggcaacacaggtggtggggccgtggcctgacctacaaaactgttcttccctcttagggcctccaggcctgtgatgggttgggctcctggaaagtctctgaaatgcctaaaattggaattggcgggggatgcgtaacatctcttaacataccatggactgatgtctgt

SEQ ID NO: 129917 - DNA, 1392 bp, Homo sapiens
tctctttatcgtaagcgtcctttgattttgctttcttaaactatatactaaataatacattatcatggcaaaaaaggccctgagtggaactgtattatccagaagtaagctagtttttacatggaggattatgcagtttacataattgaaatgtgtttttctctgtgtgctgttctcatattccaatattcttttttcctctcatggtcatgatgttttcttttgagatataattcacataccataaaattgatgcttttaaactatacaattcgttagctgggtgtggcagcacacacctgtagtcccagctactcaggaggctgaagtgagaggatcacttgaactgggaggcagaggttgcagtgaaccgagattgcgccgctgcactccatcctaggcgacagggtgagcccctgtctcaaaaataaataaataaacaattcagtggtttttagtctattcacaaagttacacaaccatcaccactatctaattccagaacattttagttaccccaaaaagaaacctcatactcattagcattctctcccctttttctcttccatctagcttctggcaaccagtaatctactttctgtctccatggatttgcctattctagacatttcgtacaaatggagttgtagtattgtggcgttttgtgtctgccttctttcatttagcacagtgttttcaaggttcatccacattgtagcatgaatcagtacttcattcctttttatggccaaataatattctactaattgaatatctcaaattttgttttttattgactgaacatttctgtagtttgcacttgttggctgttgtgaataatgctgtttgtaatgctaattagcatgtgcgtacatcctttgttcttaatcttaggggaaaggctttcagccttcatcttcgaatatgatgttagatgtagtttttcttagatgccattctttagatcaggttgaggagttcccttctatttcgacttgagtgtttttatcatgaaatgttggattttgtcaaatgctttttctatgtctattgatgatcatgagggcttgtttattaatataatgtattacatcgattgttctttattaatatgttattaatatctttgttctttattaatatgtattacgtcgattgactttcatatgttgaatgttatgatattctatagagcatatataatgttattttactgctttggttttatataatatgaaccaatttctctatatttcaggcatttattaatacagcaaaagaaatttatgaaaaaattcaagaaggagtctttgacattaataatgaggtatatacatataaatattgttggtcaatattaatttagagttcacttttgattactattttata

SEQ ID NO: 129918 - DNA, 1312 bp, Homo sapiens
ttctgcattatgagaatttcctgaaaagcagcattatccaataactgtttaccccgtacctggtatgataaagaattattttcagaaacatttccacagtgtttttaaaaggaaggaacatcccttaggagatattgttttaattgttgctaaaatctacttgctgtatttttctcagttgtttgataaaattgtatcataaagaattaaatgagttttttaagaattagttaaactatattgtctggtcatatttattgttctgttctcttttatttcaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttctttta

SEQ ID NO: 129919 - DNA, 1018 bp, Homo sapiens
cgcggggggggggggcgggggcggcggcggcggcggctcccgggcgggggtgggggcgctggtcgggaggctctggggaaggagccgccggccccgagcagccatcattaccgagccgcctttctccggatggctctgcctcgaggagcccggagccgtgggagcgcaccccaaactcccggccggccgcccgctttgtgagcgcccccgtgaagcgagcggcgcggagagtgctcctgctatgggtcggactcttttcctggaggtcacttttagagactgctcacgccttggtttaaactagtttttttccccctcttctgaacagacaatggacaaaagaaaagtagcaacccacatggagagagtttccttttgaattgctagaattagatacactatccagcgctccacttgctaagtatactttttagtttcccattgtatattatctagcaatcgatttaaataacttatcttaaaaagtgtcccttttgggggcttaatttctggaatacattacatgtcttaatttatttttaaaggattttgtgaggccctgattttttattttctaaaaattttaatttaagccgtctttgcagtgggcgatacctttctaaggggttaagtgttatttcaccccagttctctctcggtaagggagggagtactcagtatacgtagtaatcgaagaggaaacaaaatacgtgtctttatttcttcactgatcttgtctgacgatgacaaaaaatatcttagtgactgtgaccttagcagcatggctacctgatttatcccagttataattatatttagattgcagtaatgtctaagtacaaggtaattcctatttcagaaataacttgagcagtgattttacgaagttgaatccttctcccagcccccagagtacatctgtcgcgcagtgtttttgtcttgctgttgcacaacagaagccctccagtctttaccctaaaatggcagctttcatttgactgaggcccattcattgaca

SEQ ID NO: 129920 - DNA, 1727 bp, Homo sapiens
ttatgagaaaatacactgtaaatgcttctgtgtgcctgctgtgtaacccataaaagccatgtaagtgccaagttagtgtagttctttcaaacctaagattacagcattgtattccatatgcttgaaaaagtttgcttgccacacagtcaccatgcctttagttaactttgattcagcaaaccttggcaagccttccatggttaaaacaataaaaggcagtactttcctttagggagtgtaccatctaatagagagcagttctataggtaagcaaatattcacatttgacttttaagataaacttataagtaatagttatctttcatctttcattaactaaatacaaccttttgggtttgatagcagacaccatggccatcttagaaacatcgaatataaatgtggcattgcaagaataaaaatgtttagtcaggtctgagcaaatggctcttaaaacttcaactttgtaagacagtgattctttttcagtaaatgatttctacatgtaaaaagtaagcacatagtcacatagctaaaatcaccaaaaaggatggagaaggaacatcttaggtgatattaagatgatgtcagcaatatattggctctgtgggaccctttcaattgtcttgttcactcatgtgggcatatttgtgtatcttaaaaaaatctgttcttttcatgcgattggaaattcagaatttagcatttttctagacaggtttccaaaaccattatggtttcattagttcaggagatactattttcccctttctctataaaactttattatttagtctttaaaaaaattgttgacattcaaaggtgactaatgttaaaatataaaagaaattgagatcaataatcgcttggtttttctacaaaaaatacaaagatggaatgatttatttcaatttgggtatcactcaggttgcagtgatggcagaggtccatagctgattatggtggttgttaagagctaggaaggtaatttaaaacatcatgactatgtgtccatattttacttttgtcaatagattaaaaattgtaaatgaaatcacatctgcatgataaaaagaagaaatagaaacaggaagttgtaatgatgttgtcaaataaaaattcattttatccttattagagaatgattggatatttagagtgtgaggaccttagagagctagttgaactttctcattttacagattaagaaactaaagtccagagagattaattaaatgaactgcctctgactggccacccactgttgcagagcttatctcagttacagttgtgttcctggtgcctagcatcgtgccagtgcaggaggggtgctggtcttgtctttgttggctctggaagagtacagctcttgctcatgttctgactcaaaggtacctttaggctttagaatcctacagcataggacaacataactcttaaagatgttcctaaaccaacaataatttgcttctgtttttggaggttttttttttttaactatgattatccatttaggaaaaatgcagagataattatttcaagatttgacaactgttttcactttagatgcatgtattgatcaccatagctagattcctgttgcattttaactaatgttaggtgactgactgcaaacatgattgttttttcagagaaggatttttttggggtttctgttctgcttttactttgaaaattagaaatgtctttttaaaagtaaaaaataa

SEQ ID NO: 129921 - DNA, 1517 bp, Homo sapiens
gcttgtttacctatgctaatgtggaatctaaggcactttttaaagtgaccctttgagccttgcttcctctgtgcatgtcaggattggctttcacggccacagaatctggactgtgattagtcttcctgtttcatctgtggttttgctcattgattcggctgtttgttgggtacctgctacctgaaagatgcaatgctatgaattgtcaatatagtgatgacatgagaagacatggtaaactcacacaaaaactagagctactgtaaggtcataggtgtgatgcagtcggtgccaggaggagtgagagcttaggacttggggattccgtcagttgggtggggtattaccccttaggaagtggctttagcattaccatctgaatgatggtagaagaaggggtgagggcacttcaggcagtgcccctcacctgcagggaggctgtgtgtttgaggcattcaactgcaagatgagactcgaggcaggcagtatccaacttggtcagggctttcaggatatcaaatttgggatttttgaaaaaagcagtaggaaccactgatgagtgttaagcagcctttgacacgagcagagtagtgttttgaagaagattgaattggtgggtgcagagaggacaataggttgtagacaatatcctgcctgcttttgttgtggtctgtgggatggggaaatcacaatgatttggactagattggtggtggccatggggatggagagaaatggacagatttgagagatatttaacagtttcaacgaataggacttggggatagatgcgctctcaagagggagatctcagggcatataggtttctagcatgttccctgcttggctggttggctactgatcctattcacagaggcaagaatcagatctgctgaagatttgagaaggaagctcatgagttcttgtagcatatgactgaggtagctgataatggaccatgatgacattgttttatcctttgcattgctagtggcattccagaactttaaaaaaagtaatctgctagctttaaccaaaagatattggacgtggggagttcatcaaggaatgtgaatgggttcagtgaaatgggagaggggagggaagccttacttgctgaatacatagcactttgcttgttacttgcctgatacatagcactttgtaggagtttgctcattccaggttgagcgtagaatcctgtggtaaccagaccttggcacattttgttcttctgtatgtccccttacggaggctgctttctgttgctagtcacatattagggcaaggtctttgggttcccggcacgtgggtggcaggtcccccatgttctcggggctgcagtctccctcggagagagttgtattttagaagttggttgtagtcatacagaagcaaggaaggagtgaatacattatttaaataaatgtggagaagaataccaatgtttatcagaatacttacctggtttttagtggagtatgtataaaccagtttaataagtaaattaccttcaa

SEQ ID NO: 129922 - DNA, 1041 bp, Homo sapiens
ttcctcagtcccttcctcccaagttctctttaccatgtaaagaggagacaagatggtatctgaaatgggagtaggcttgggttggggtcagggatgtgagtagcaactagaacataagaaggttcttaggagagggaaggctctggggtagcctacttagaatctcactgctacccagattggcagggaaatggaagagatggagtatagacaattttcattttattctattctatttctttacttgaaaatgacttggaataacaaaataagtgagtcaaaaagtaaataactggtaacgtgtggatttatgggagatccttgtactattctaactttactgcaagtttgcaaatgtatcaatatcaaaagttttaaaagaacagtagctccaaggggttgatgtcagtagctaacatttatggagcataaagtttgtgtcagttagcattttgctaagctatttacatgaactatttctgctgaatcctaaagtaggattagtcaaaatgctgaggtaggaataataattgctattttacaggtgaagaggttgtttaataaatttgtctaagatcatagtttttaatgagtagtgttgggactcaaagcaggacaggctcatttaacagcctgtagcattaactgctctgcagaaattgctttggatagtcccatcaaaataacctaggtcttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttctctcagtgtttatccaagatgtaattcacttagcatctttatctcgctgcacaggacta

SEQ ID NO: 129923 - DNA, 1052 bp, Homo sapiens
ggacaacagactgtcttccgcagtcatacactcagtcatattctcaaataggtatacagttcaaatgtataaatcagtagtcttacatgttacagagtgggtggatgttcctttgccaggggattaaaaaaaaaaaaatcccaagtcttaatactgctttctcccacacgaatagtctatgatggtgtatttttggattttgtacatgtttatagtttttttcttttcacaattttgaataaactgttgactagcttgagtatggtaagcctctacttaaaatgtaaattttgctatttttggtgcatttaatattttaatatttgtcttgattgtgttaattttcagagctgtgtttatcaccagatttagtatgttaacttttcaatgttcccacttattaaaaaaaataaaaaaaataaacatctgggctggtgtatgaagcaaacctccagttttatagggaactttgtggctactctggggtgctgagagccttccatttagctgctaaaggccagcaggataaggaaaactgtcttatatgctgtcaaatacattaataaggacacaattcaaggacataagtaatttccccacactgtggagcacacaggtggtgatactgctgtagctgaattgctggctggcagtcagtgccactgccatagcaccacaattttcatttttgttgttgttttactgttgtctcggtatggtgaatggttgggctatgggagtggcacagaaacccaggccgtacctagcagaatggttgacagtcgccgactccctgtcattttctgcagctcagtattttcaggtcagggagctgcccatgtcatttgcatctttctttctttctttctttttgacggagtcctgctctgtctcacaggctggagtgcagtggcgtgatctcggctcactgcccacctccacctcctgggttcaagcaattcttgtgcctcagcctcctgagtagctgggattacaggtgtgtgccaccactcctggctaatttttatatttttagtagagatggggtttcg

SEQ ID NO: 129924 - DNA, 1004 bp, Homo sapiens
actctctgatactgtatatggaaggaaggactctgacagtttttcagtaattttgtggtatagacaggaaaatctttttttaggtaccataattttccataattttaaccagcgatatatctgaaacaatactttcaaattttgcatgttttttttttttcttttctagattgcttggcagttttggctttttttaatctcaaagaaattttgttttacagtaagttacgtttaattggaacctcccccactttttttttaaagtttcctgaaatcaaggaacataagaataatttttaaaaattttctgtaggtgagatctgaatttgattaatattaactgcacatttagctctcagatttcagaccgatttagtgttagcttctgtgcatctcacctaattgttaaaatatgtgagcatgattttgatatttgggaggtggaagagaagcctcttgagacttttgaactaaagttaaacagtttattctgtcttggagttagttggtgtaggttagtaggaagactttaacatctggagctctttcaccttggaattgtatctttctcatggaagaaacacatttgagctgcagacagcctggaaaagctttcaggctatattttcttcacaggagggcaatagctttgcacttataataaaatagcttcaaagtttttgtctccttgacattatgttacctttaatttaccctcaaacattattatatcttctatagcaaacagaggaggataagaaaaggaaaaacagagacaaattgttaacattatccccaaaataataaatgggttgttggtaacataagacttgaaaaccatagaatccagaatatatgcaacttcattttattactgtattgcattaaatttaagatggtgtcagttgtaagatgtattctatttctgatacattgaaatgccaaaaaaaagtcgtggaattgatgaaatctagtagttaaataaaaaaccacaaaaacctcag

SEQ ID NO: 129925 - DNA, 1088 bp, Homo sapiens
tgtcctttccgactttacagaacaactggaatctatgtagtcccttaagtaaataaagcttttaatgctaagactgtcaagcaataagcctgtgagaaggtggagactgtgatcttggttgtaaacttaaaaacgaaatctcttacaccagtcttttccctgttacagctttctagttgctggtgaataaaatgcaaaagtgacaaagaatttgcatatattcttagggaccaatagcttcgttttcatagtgaatcttattatcttttgctgtgtaacaaactacactgaaacttggtggcttaaaagagaagccatctatttagcacatacttttgtgggttggcagtttggattggtttcagctggactcacccctgcatctctggtcagctggtggctgatagttagctggggccatatgtttgcatgtgagagagagtgagcgagagagcgccacatattccagcagattggcccaggcttgttgacatggtggcagaaaagaaggccgctctggtgctcaagcacttttcatatctgtttgcctgaagtttgctattgtctctctggccaaagcaagttacatggccaggcagtgtagaagggaatacttcagggaggcccaacatatttggccaccactgcgaccatcttctacagagaatgtacgtcactctctctttctcctcctccttcctttttcttattgtggtaaaatacacatcttaactatttttaagtgtacagttcagtgatactaaatgcatattcataatgttacgcatccatcaccagcatccatctccataactcttgtaaaactgaaattttatacacatttcacttccccacatgtgcatatctcttaattcttctgtagaatgcctttgaccagtgattggtcatatagcaccagaatgaaaggcctggggaagaacatgttaaaattcatcgctttctcttcctcttattggtcaaggtagggttatggataggaaatgagagaagaaaacaaaacaaaaacagaagactacttgtgctttcattttccactctccccccaccacccaactgaaaaaccaaat

SEQ ID NO: 129926 - DNA, 1047 bp, Homo sapiens
attttacactcacttgcttcctctagtcccttgtgtagtgaagggactgttcaatcacatgccttactccggcagcccctggccagtcaccaacatgtaggctttctagctttctttctcacctggttaggataggaatctcatctgcataggagctctgaatgtgatataaaatctgatccaattgagaggtgagctataaaggaatatataggaaggagagagtaaagggtagttgatggtataagagtcctgaaaggtagataagtgtggagtctaaaagtgagggaataggtctcggcctggaagagcatagttgtcctggaaacaaggaggcaggaggaatggatgggtacagatgttagtgaacttgcgcgtttggctttaggaactcccacagttagctatcagaggggctcctattttctctgcaaagtaggaaatgaaattacttgtttatgtcttgcttctttaaccaaagtataaattcactgaggacaaaaaggtatgaatgcataaacatgcttatttgttctttcacagtactcgtttgatacttaatgttggatttcattgaaaattggactcattgaaaaatcagacttgttacttagggttaaataagacattgcatctaaaaaatgactcacccagtttgtaaaaatattaaacactgtaaataggtgccatattaaattattgctaactacttcctgaatgttaccagtttaatttatgattagatatccataaataaatcttattgagtaaaaatggcagaatttgtgctaacagtttggtgcctgggctttagagaaatgcacaccacctgtactttgagatttaaaaataaagtataaagataatggtgatgcatgtagaagagaaacagggagaaaagtgaactacttggaataatagatttttatatcaactcctatgaattgattaacattatataatagaataagtcacatttatactgtgttttattgcttaccaggcattttaatacatgctggcacaaataatccatatagaaaaggt

SEQ ID NO: 129927 - DNA, 1054 bp, Homo sapiens
tgaaacccctcagtggaaatattttgctatttaaaaaagttgacatgctggaagttagttttcatatatgaaaaaaggaagttattttaacattgcttagtaatctacaaagatctttttaaaatatatatatatttattatactttaagttctaggatacatgtgcacaacatgcaggtttgttacatatgtatacatgtgccatgttggtgtgccgcacccattaactcgtcatttacattaggtatatctcctaatgctattcctccctgctccccccaccccacgacaggccccggtgtgtgatgttccccttcctgtgtccaagtgttcccattgttcatttcccacctatgagtgagaacatgcagtaatctacaaagatcttttaaaataacatattaagttaacataaaatgacactattaagattctgtgtagaagctctgaatatgatataaaatctgataaatattagtaagaaacaccttttgatgctgtctggtatggtcttggaacttgcttattcatgcatccacagaggctgaaatatgcaaatattgacaaaactagatttattgatagtgatttcaattacagtagtgtgatcctctacatccagcagtctcccttgactggcagctcttctgtggaaaggaatttgcttgctttccctgagtgctcttctgtggtcctgctagatttggagattgtcatttactgtctgacctagttcacacacgtgttccctgtgaaccaacttagatgtctgtcttaatgtaactgatagctcatttacttactaatggattggataaataaaaagtttacaagttacccttgtataagaacctactttgagggattttaatagtaactgggaagaattgatgaccagaattgggtaactattaatagatgaccagcacttgtttacttttaatttatagcatcaagtccaatctgacacatcctatgtacatttaagtttttaaatagaaatttaaactgtatttgagggtaaaagaaatctttagttataatttattcata

SEQ ID NO: 129928 - DNA, 1075 bp, Homo sapiens
taggactttggtgtaaaatgagacagcagatgttaaagtaccttccgagaccattgtttccagaaccttcatcacattgtggtattagaaaccttggagtcctccttgactctttcacaagctacattgaatttgttctcaaagcctctggctctgcctttaaagtatatgcagagtctgataccttttctctccacttctaccacccgggtccaagtggccttttttccttgccggtgttactgcagtagctcccctactgctctccctgctgttgcctgtgttgcctgcagtctttccaatgttagcagtcaaagtcatctctcagagccagagctggatcatgtccctcctctgctgaaagcagttcgtgattcatcctcttgaggcaaaacctcagccctcacagaagtaccctctgctccagcctcccccatccagaatctcatgggacaccacactttgtccttgctgtcctttagatgctcaggtgccagttcccctctcagtcttccacagttgctctgatctcctcagacactgtcagggcctcgtagggcctgctgggctgactcctcagttccttcccgatcatacataactatcttccctgtgaggcagtcccttaccacccaatttaaaattgcacctccttcctccaaccggtccctctgctgtgatttggtttttctctcttactttccttttagttatttacttatttattttgtttgactctctccacaaacaaagcttaattaagctgcatgaaggaatcgttgtccataatgtttactgatgcatctccagtgcctaggacagtgtttgacagatgataggtgcacaatacatatttgttgcttaaaattatatgggagctaatcattggagggaaaaatgtcttcggttctctgtagcacactttttggcatagtatagccgatgaaactttgtaagcaagatagcaaatattgttacactatagtggctttcagaaattgaagacagtgtttctctttgagacagtcctgattagcaaattacacatttttcccctcttgttacatctacctta

SEQ ID NO: 129929 - DNA, 1028 bp, Homo sapiens
tctctgaaagcagtctcagggattattcccattgctgccgcttaccagcagtggctccttggcaggctacttaacctttgagccttcagtttcctttcctctaatgggggtaacaaggattaaatgaacgagtgcatctgaagccttagcacagggcctggcatgtgagtaaatgtccaggaaatgcttgccaccatcagcagcagcacctgtgtgggaaattactttcccttctcccttttctatgggagtcccttagagccctgctcagcagcctggatcctcatcagttctgggattccgttggcggctgctgcttttccaagtggacacttttctctttgtcattccatgtcaagggctgtgaagtgaggtcccggaccagcaacatcaacttaggcatggagcctgggcattttccttctggttggtcttatggattgaattgtgtcactctctcccacccaaactcatatgttgaagcccctaatccccaaggcaattgtatttggagatagggcctttagggaggtaattaagattacatgaggttataaagtggtcataaggtaggatcctgatctgacaggactagtggtcttaatacgaagaggaaaagagagagctggctctcccagttgacaaaaaagaggccatgtgtgcacacagtgagatggtggctgcctataagccaagagaagaggcctcagaatgaatcctgccttgccagcaccttcgtcttggacttccagtctccagaactgtgaaaaataagtttccgtttaagccacccaggctgtagagtttgttatggaactctggcagactgagattgttggagaaccacagtcctggtggttgagtgcctgcctcaggcattattgtttttaggccagtggtttgtgcatcaaaatgcttggtaaagcagactgccagggcttactccaagaatttcagatttaggattgacatgagaagtcacatttctaaccagttccccagcggtgctgatgctgccgatgctgcca

SEQ ID NO: 129930 - DNA, 1035 bp, Homo sapiens
tggattatttgtttaaaagaactgttatcttttactccttcaacaagtgcattcatgtacctcctttatcctagtcacagcgataagccctggggataaagaggggcgggaacacctagcccagggcctctcagagccacagggctcccagctagcagcttgagttcctaaactctggatttcagatgtgtggaaatgcactgatggcaggttgttagggatggagatgtcttaaaggaatgttcggttatctctcctgaagggttttaaaaattgtggaagtcaagatcaaggatgaagatgaaatttcttgtggtttcttcatgagagatctcttctatctgtatagtccggaattctgagtagtatcccaaagtgtaccatcaagacagatgatagcagagagttgaatttttatatatattttatattgctaagcatattttttgttagggatttgaagtagttaagtcatcctcacagcatccctgggaatgacagttgacattaagctattttattgttggaaaaggaaattatggaggttacttctcactcatattttttcagcaaggaattgggaaatggaaagaatatattaagcatctgcattataggatgcccttgcagttacattctgaacccttgaattgttattttgatggaagggttacagttgtgtggcagagagcttatattgttggtgattagggagagattgtgtgctgccagacctgtttaggagtaaagggtagtgagagatttcactcttctgagaaatttgcttcagctgactcgcttgttttaggaccaacacactccaggcttatgggactggatctgggaggtacctgagccgttttcctggaggtggtgctggcaggcatcccagtgccaacttcacttcctttaggtggggagcagggggatttcctccaatgagaacaagcaaatgtgttctgagaagtgatggtttacaacagttggcatcagaagtacacaagtttactaccaaaaccagggaggagcagttac

SEQ ID NO: 129931 - DNA, 1050 bp, Homo sapiens
tgactgtaggaaatccagccctttattaaatgaagattccagagagctctgtccagtggaattttctgggatgatagaagtcttctttttggtgtccagtatggtagcctgtaggcccttgtggttaggaagcacttgaaatggggctagtatgacagaggaactgaattttaaattttaattttaaccaacttaaacagccatatttggctactgactactattggacagtgcaattctagaatcataattggtagagaagtagtcttcaaacttttttgtctcctaagagaattttaaaaaaaattctctttttcagtttgaatacatgcattaaaatgtgtttgtcttcatgacaattatctcactaaacaggcatttgtcacctggatgaaatgaaggactgccctcttgatatttattaactctctgctttgctgccaagtgactcttcctaaagaggttggtgtcccagaggtttttatactccagggcaacacactgtaataatatttgggatgagtgaaagccattttggtaaagagaagtgattgtaaaaaggaaggtggaaagggggacttttagaaaatagataccaaagatgacagtgttagttctgatagaatgtattttgagccactctgatttgatacttagataccagaactattctagttaataaaatgaggcatgattagtataagaaagaacacttaaccttcctgctactaaggcaggtgggggcattcatccagattatttaatatgtgagacaaatatgttcaggtaactgcttgtctgtttataattgttttatttaaagtaatagttctcaaatgttttagttttgaaatcctgatgctcttaaatattgagaaccccaaagagcttttgtttattctggttttatctgttgttatttaccatatcagaaatgaaaactaggaaatttaaaaaatacatttattcatttaaaaataataataacccccttattggttcattgaattatgccaatcttctgatttttgtatacatttttttttgagg

SEQ ID NO: 129932 - DNA, 1051 bp, Homo sapiens
cagtgactggtgtacttggatggggtggctgcagccctgcaataccatgggctgcccagtgttagggccatctgggccagcaccgctcagaccctgccctccaacttgtattagtttggtccttcctcattgagataaattcgttctgcatgttgtttcctgtttgccagctgtccctggggattgtgggggtggtgacagattcaaaaacctgtgagattgctcctcaagtaattgctatttacatttctgaatttgctgtagtagaaactgaagagaaaatctttaggctcttggtcagtactggactagatatcagacgactattacattttggtactacagagttcattcaaataattttgaataataacgttaagctaccatgaaaaaaaaaacctgcactcctttgtttgcaataattcatacataaatactgctaaaacaccccatcttatgtgactaagtacattcttattcatcaccccaaattgtattttaaatgagaatatcagaacattaagtatttgtattttaggctgaaatgaagatattctgtcataagtcatctaaagtaatatgttttcaaagtagggatgaatctttgatataaagaagttgaaatagaaaaaaacctcaagtataaatccttttgtaatagcatctctgtagcatttttcaaagcgttcaggtatttccaaataaactcatgtttaagaactctaactaaggctgctgaatagatgctaaggccaggctaaatcacacagccgtttaaactgaaacagctcagttcagagggtactgctgttttataaccatatttaaaaatgtgttcctcttttactccctcaaactgggttcagggatataatggatcccattataggtaaaaggtctgtgactcagccatcgagctactcaaactcttggctgttttaattgccaccattaaagctttagtacttttatctcataaaaatagatatcattgatgtaaaatgtgtgcctattgaagatacgtgtgtacctctgcccttatagttagcta

SEQ ID NO: 129933 - DNA, 1023 bp, Homo sapiens
tatatgttttatgctttttctaattcattactgtgtgctggggaatctctcattagaagctggtgttctgttactggagcaaatgccatgcagattaaagaaaggtaaacatacctggtattaattctccattctaagttttaatcattgtttagactttcctcttttcctctctttccagaaacagctttttctttcatttcctgaaaaatagcttgtcccaaataagtttgatctccgtgtcctgtgcaaaaaagatagggctttttcctttttaattacattaaggaataatatgtacaaactaactcaacttatgcaaactaaatataaaacagttaaatcaggtccattgatacttaggtagtgataatttggacagtgcctctgttgatgtgtaagagtgtttgtgaggaaaggatagaggggcagagggtaactttggcagtgtttagttagttgtgttatccctgcatggaaatctgctcatgtagatctacatctgtgtattcttcttcaaactttgaccttgcctctgtgtttcctatatatcgttactcttttttcagcctcattctcccttagctatgaccagcaaagggcaataagtattttaagattttttaatgccacaggattttggaagaaactttggaaatcacctatcaatcacctaacccaaaaccttcattttgcagaaaaagaaactaaccccagatgggtgaagtgattttttcccagatgatatagctgacggtagggcctggacttgaattttaatctcttaactcagagttctgggctctttctcttacaccagtgcaattgagtgaaacctgtgagcctttcccagaaagatgctgtgtagaagatgttaggaagaggtggacagaatcagaaagtactagagttaggaaactagattcaaatcttagctccgtcactaactgtgtgacctggggtggccacatcaccttcttggacttttcctttctgaaagttgggggtaaattatcacttttt

SEQ ID NO: 129934 - DNA, 1690 bp, Homo sapiens
gacagtgtcttcagttgagtgagtttttacttcctgaactgatttttttttactgtattaactaaagtgctattttaaaactttctttcttaaaagattctctcttaaacatacattttttttggatgagagaagctgatagattctacaactgtatagttggaaaaatatttgctacctgagtatagaataagtttcagaaacatcagccactaactttcagttcttttctttactgtgaagaatgataaactaatttcaattcctatttgtgtctctcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaaggtaggctgtgggcagaaaaaacaactgcaaaacattgagagtacagaaattagcgccaaatagttacagcctatgaaatgaggggtgggaggggacacaatgatttttgtcatcattgagtttctttccctaatatccaaactaaaaagctaaggcttttacgcattctgaaagttaggacttattgttgtgaactgttgatttacagaccttactggatacaaattaaaaatcaattttttatatttttatgaaaacttatcatttagcaaatggaatgaagttagcagtataattatttataagaatagaccagcaacctcattttcagtgatgatataaaactggataagaaggattatagaagaaaggtcactatatttcactaagcattccagcccttcttcccagaggttgaaccaggattgttaattctctccacttggcggagtaagccttccaggagcagggttgaaatcctagtgagcagcgcaagagaaatcaaatagtacttgtccattggatatgcattcaagagtagcatgaattttaggttctagggaagaccctctttcactccatattccccccatcaattctctgaccgctcccccaatttcttaccccatttattcggtaagaaaaactgagaggagaagacattgaagactaatttttttcatttgtagtgaatgtttcttacaactgttctgaaccagttccagacatctgaatctgtttttcagaatgtggctcatgttagaaaatatagtttccagatggaactatggtcagccttggttaatccgaatctgtttgcaaactccattagaaaacacgcccaccccataccctcatgtgcacgtgtaaacacacacctgtgcatgtacacagtcagttctgcatttgctgtgaactttttgagattgctgccctgtgtgtgcatgcccaagtacacaaacagaggagattaattt

SEQ ID NO: 129935 - DNA, 1020 bp, Homo sapiens
aatttagcacagaactgctgacatctttactctgcagccctgtatgccatatcattgctgtgttgtacaaacaagtgtgctgttctttgagctggaggtaaaggaatcggcccgagggtgctctagctttctctgtgctgtgtcactgtcagggagagagcttggtctgcatcacttacactcaccatggtaaaggacatgtgaaggctggccgttgtcaggggctgattttccttgtgtgtctcctcactgtctggcaccccatcttgttctgtaaaatggcagaagcttgaatttgtgaccattcccagagaactggcctttttgacaactaaaatatgatcatacatgtctttcctctgcaggaggacctaaaagaatctgcccagaaactgttacatagagtgatggtgaagcaggaaaagatgttcagcatcacagaaaaagacatgtaaaaccttgatgagaaaaacgggccacattcctattctctaatcaggctgtatcttttttccctttcccgttttatgttaaatatatattttttgtatcgatttttctagtgttctccccagttgtccttacagctttcaaatattcgttgctaatattgaaaataacagcgaaaacatttgtgggttggagaggataccgttttgcatgtggaaggattcatggagctggaatatgaggatttgcatccttttcaatgcattttctgttgtgcatgcatgtgccttgtgagatgagaaagaatttggaggaagtgcttcctttgaatgactcttgaaggatttaatggtccatttagctatataaagattctttgaatgtacagaaagaagggaacttggccaaagattgtgacttgactactgaagcttaagttaagtagaacaacacagacttgctgctaatgcagtttctaggaatgcctttcattccttgctctatgctctgtccctagtattaaacttagtagaaaactaaaatgttatttttcaattaagagtgaagttt

SEQ ID NO: 129936 - DNA, 1080 bp, Homo sapiens
atagtagcaaaggcaatttaatttacataacttaattttgtccttgatggaaatgttggagggtggacactgaagattttgttgctttttttttgacttcctagggtgttctttgatttgtatattgatggatggaaatgcttagctgtccgttaacaacatgaatagtgaaaggtctgatgagtttagaaatctttccatactcagatctgggataagtgcttcccttatctacaggctttttgtctaaacatttggagagggactgtctgactttcagctatcttggaggttccatacagttcattcttgggaagggcagatggaaaatcattagcacttctctccttcagcaaattgatgtttcctcaaacctgggctctggtcggtttccagatagtaagccttttactcctgtaggaccacgcatgcagggcctggcagccctctaaattaaaccgtgtacatcgctctggtatagagaggtcactgtgaaaagcgcgagctgccaactcactttacctggcagtggttcaactctttgacaggcctacctctgatttaaacaaatttgagaaatatgtaaagttttggaagcagttttgcactgatttgataaaagaaaccacaaaacactgcagcgcaggtgttgagaatgtttgaaagctgattgagggaagcagatggctttagtcagtggcatccagccaaaagagcaggtgctggtcatgtgaccgctggttaccagggtaatctgattgctcttggcgtgcagatgaaaggaaaggggcccagtgttcagctgtagtattgtataatttgtggcagttagagcggaaataaatgctggaaatggaacctcatagtaggggagacttctgtccatgtgtagcgtaaacactaggacagttggatgaggaacggttgtatggatttttttttttaattttaaaaatattatgctttctgtggatctttcggagacagtttttagagcacggccttttttcttttcttttaaataaaaataactttttaaacctaactgccatttgctataatcttgaattgttattttct

SEQ ID NO: 129937 - DNA, 1049 bp, Homo sapiens
tttcttgtttagagttattaagtatatggagaaataaatgtcttttaaatattttaaaacattacaaaacccacaatgtaaagttgccatgaggcagccaaaaataatacatatggcattcaggagagcagttgctaattggctgctgcctgagaaaatggtacacttggcgtctacttaacactgtgggtttggcagaaggccaaatttggggtcaggttgttgtgaatgaagctgcatgtggttagggaggagttaaagtgattcatgtcttagaagctctcgcacgttgagcagaggtgcgtgcatgggcctgagcgtggcagtcttcgtggccctggccacctcccagcacacggtgtgctcatcttacgtgaaggtcctttgctgctcttttcagtcctattttgtgctcatatgggagtaaatcattacttttaaaatattctagtagatggttttaaatacatgcctgaaattttcttttgttgcagaaggaatctggagaggaggtagaaattgaggaattctatgtgaaatacaaaaacttgtaagtaaattgtgattctgtttttaatggggggctatattttccaagtagtaaacgaccatttttttttaaagttgggaaattaagaaactttggtatgatttctttagtcatcatggcctgggaggccattttttaaccaacttttgtatgtttgatattttatgaatttttctggaaaatgtgtaattggtgtaaaagttgactaacttctgtgtataaccaataagtatttttttagagaggataaaaacttctacaataatagaaaaatgaataaagcagtatttccctgtcctctgatcatgaattctaccctgtggggctacacttcgtcccttcacctgtgcatagtgtgcgaggccctagagacaagaactctcctgtggaatgaaagctctagagaaccatgacatcactcaggttctaaaatgcagtgagctatagctttatctgtttttgtttgtttctgatatttatttagtagatttgaattcat

SEQ ID NO: 129938 - DNA, 1068 bp, Homo sapiens
aactaatgcctgatctgaggtgcaaccgtttcattccaaactgccctccaccaaggacccgccccagtccgtggaaaaattgtcttccacgaaactggtccttggtgccaaaaaggttggggcctcatgatttatttgatacacagtatgtttctttagttttggtttgtatttgtattcccttttagcccccgcttgttgatttttattgtttttcaagtttgtgaaatattaatatgttacaaaagtcagaactatacacaaaagaagtgtagtcctccctttccaccccattcctgcttacttccttactaatcccaggtttatcctttctgtaatttttggcatgagcatgcaggtataatttcctcttcgttcttacaaaaaaagaaattggtatactgttagtacatttttgtgctttgctttttttcacactacatcctggaaatcactctacatctgttcataggggtcctcctcattctttgtttcagctgtataatattccattgcatgactgccgtaaccattcaaccagcctcctgtgtatgtgggtgtgtaagtggcttctgatgttttccaattacggataatgctacaatatatattctcatacatatctatatattttcaaattattggaggcatggcttccaggtgaattcccggaagtgagtttactagatacaaaaggcaaacatgtatgtatttttaagagatattgccaaattcccttccttcatgttgtatgaatttatgttcctgtcaacaaagtatgcaaacacctgtttccccacaacctttctaatatagtgtgctgttttactttttaatttttgtaagaaattgtatttcagttgaggttttaattagcattttctcttattgtgaataagaacaccttttcataagattaatggccactttttacatcttgctttgtcagttgtctgtgtcttttgctcattttctgtcatgctcaacttttaagagctctttatatataagggatattagttctttatcttgggttatatgttgcaactatcttatctcagtttcgat

SEQ ID NO: 129939 - DNA, 1029 bp, Homo sapiens
tggaaactacaagttgaaagtagaaaataaaatacttgcagtcctagcacccagaaataataaatacaggttgagtatcccttatctggaatggttgagatcagaagtgttttggattttggattttttcaaattcagaatatttgcattatgctttaatggttaagcatcccaaatctgaaatccaaaatgctccattgagcatttccttcaagttcatgttggtgctcaaaaagtttcgagttttagagcattttgaatttcagattttcagatttggaacctgtattagcattttgatgcaatttcatctagtctgttttctgtgtgtgtatgtacagcatttatatcagttcatagctatgtaagtcatatgtatttaaaatccttttttccctcaattatagaaggactaaatgagtcctatctttgcaaatcatattagacatgattatcagttatgtgctacttaatatcataagcatttcctatatcatgaatcatttttgaaaaatttttaatggttgtataatttttgtttttactttttcttgttttaaacttctgacttctgtgaactaaagcacaatttctaagagtactagtatgttgattctgaaaggggtatatatattcaagatataatttctttttaatattgtcatcagaaagagaaataagaggctctcaaggctgtttgaggggcagggagagggtgatgggacaaaagaatattgaagaactaagcaaaagaatgtcagagttgccataaaacattaactgtgtacctgtgagtgttggagaagaaaagggaagtgcatatgtattccagttcaggtgagggaagacaccatgcatactcagaggaggggatggggagtcttgaggggagggggtttgcccagtgcaggtatagatgatagcaagggaaacattcacaggggaccaaggaatatcattgcagaaatcctggaggaacacagtctgggagaccaggaactgataagaagctggtgaggggcatggccc

SEQ ID NO: 129940 - DNA, 1049 bp, Homo sapiens
gctattttaaatttgaattattttaacttgataaaaacctatttctcaatgataagaggttcaaagtataaattcagaattaaggcctccctgtagtgctaattttatattgaagtataatccattcacttatggaaatagcttgttattaggccattctctctcttctctgtctcttttgtctgtctgtctgtctgtctctctctctctctctctctctctctctctctctctctctgtaacaggtaagagagctggaggcttaggacagaaggcaaattttaggcactaatattgattttctcttcttattctaaacagtggtgggtatattaaatgttgctcagcagccttaatgggtaattaagcaggttattttaattatctgtgtagttgacttttttgaataagacataataaaggattaattatattctacatatttcaaggatattgttttgttctttcagctcttatcttcattgtcagtgggcatctatagaagatctggaaaaagataagagaattcagcaaaaaattaaacgatttaaggcaaagcagggccagaacaagttcctttcagaggtacgacatacctgcttacttttccaaagtatttactttgttaaaatgttctaaatttaaaattttagttccatgaattaagaaaaactagttagtctcatttggtgctgtcaacttgcatattggtaactggttcttgctaacaaatttgtaaacaggaaatttctcattcttcctgttgcttaggctagaagatatgggtccttatgatattatgtggaaatagcggtgatggtatgataaaaatcgtgtaatgaaagtacagttagcagatgatgaaattaagtaagtggacagaagttctattgagatttagcaggttaagaaatctacaatgttaagtacaagttctaagatacaaaagcttgacttctgttggggaaagtatgtggcaaatttcttttgttgaagtcaatgcctaattacagagagttcactaaactcattttcgcaaatgctgtgct

SEQ ID NO: 129941 - DNA, 1021 bp, Homo sapiens
cccccatccctaaatcctggtcctgtttattaagtttatttgtattctctctcctgtagtcacactgtctttaggaaattgtgcctagccctagctacacataccaaggttgaatgtacattatttacctggtaacttggcagctagaaatcttagtttctgtcctgagtgggagttagcagagaaggatagcaatccccttcctccctctcttttatacatgaaagtgcacacgcccccgtttgtttcatcccatacatgatcatggcttcaggtgttccatggctgtactgctttgagattttcagtttcagctgcttttacattctttgtttctccttaggctgccttacaagcctgctgcaactaaaaatgtctattcaaaaacatcatttagactggaaatttcgtcacatgtgtgatgccgcagattactcacttaaagggtagaaatgtgtaggaaaagttaaggattttaattcagcactgactgtgaaagcttatgtttaagaacaagttttcctaaagagagtttttgccatccaaacctagttttgggaaagtttaagtgtttctgctgtacatggataacacgtgtgtttacctacgtctagaagcttttgaaaagccagtgcattaatacactaatactttatattaattgaacatttcaatggatttttttttgccttactaatctacctctgtgtaaaagcctgagatacttgagacatatgtttgtgtttctgctttttgtttcataattcatggttcaaagcttcccaactgggtgttttaagagggccgaatagccagagaaagtttgttgttcttgagcagatgatgactgaactgcttatcttttccacctgcaattcaagggataagaatggtgtctaagtgacttctagtttaccttttgcaaaatattttaatgcagttatgttattgataagttaattgagaggtgcacataataaaatgtgtcttttgttttctaacatctgaaacttgtctgacc

SEQ ID NO: 129942 - DNA, 1084 bp, Homo sapiens
ggtgaagtggtgttcacttccttatgaagacagcacgtgggagcggaggcaggacatagatcaagcaaagatcgaggagtttgagaaactaatgtccagggagccggaaacagagcgtgtggtaagaattggctgatggtagagaatttaatttgaaaatagcatagtggtgtggtctttgggaaaccactaatgggatttactatatttgaaacaggagcgacctcctgctgatgattggaagaaatcggagagttccagggagtataaaaacaataacaaactcagggaataccagttggagggagtaaactggctacttttcaattggtacaacatgtatgtaaaacaagtttttcttcacttttaaatatatctgtagttcctttcctttagttattgaaaataataaaaaagaacttaatgttttaactctaataagagctttttcaaaaaacaagcattgaaaatatatgtaatatttaataaatattaatacagagattgatataagtgtgtaaaaataatttttattctttgagaattttgtttgaaaatatattttgttgaatctaagagaacatctaaagcctttgggtatgcatttgtgggtacaatggtatatattttgtgaaatgacagcagtgtgtcatatccatactcattaaacttttgtacttcattttcctcctaaaggcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccaggtaaaccttcacaggttgtattctttgtacttactctgtgcattttaaggtgttaaaaaaaaatcaaagtcttggtgacttgggaaggtctaaattttgccaaattgagaaatttgctttagatatctgactcaatttacattt

SEQ ID NO: 129943 - DNA, 3020 bp, Homo sapiens
gagaaaaaatattgaaatctgtgtttatctttagatttgggaaattattataaattctgtcctacgtgaatgtgtgactagaatgggtacgcttagtggtaattgatgcatgtgctctgttaggaaattagatccaaaatttactgacagttttctcatttgttttccaattctgttttaccatatcgtttaaaactgccaaaataacttgaaaacagaatgtatgtcacctaaaataaagagatctccaaagggataaatacgtatgttttatgctatttattcatccttaaagttatttatgtaaccattaatgcttaataataattcagagttgttcttatagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggtcagtgaccatattggtgattgcactgaacctgaatagaattgttgctgacttgatagtcccgttgctcagaatttgatgcctgtaaacagtatttgaaaagcttgtcaaatattgtgatatattctctggcactttcagttattcaaaagttgttgccttttggattcttacattgttggctagtgtctgttaaacagttgtattatagcagagtgtaatcatgatagtttcactaaagtgagtttcaagtatttgttttaccctttgttcataaatacaggttgatcataccaaatacaaaaatcccagaatccaaaacgttttgagtacccacataatgctaaaaggaaatgctcattggagcattttggattttggattttctcatttgggatgttcaacccgtaagtataaatgcagatattccaaaatctaaaaatatctgaaatctgaaacactctggtcccaagaattttggataagggatacttaacctgtactgccatttcattaactgttgggccaagctttacttcagtgatgatagtccagttatttttcagtgctcataggttttgccatactgtggccagcaggacttgtagatgcaagttctcaatgagttgggtaggatatctggggttggtttagttcgcacagatgcttagaagtttggggcattacagtgcctcagatttgatctggagttttacaccacacttatcccatagtcttccagcttcccaagagatgatcaggtcttcctgattagattttctagatttttttttcagcaggagcatcatggaataacatatcgtaggagtagaaggatttgatttattttctgtctgatactgctgtgtgtgatttcctagtgggaattgcaacatgacctgtcatcctcaggcttcttttcactccatagtttatatagtggttatgatcacttatattttatttttaatgtacatttggaaagcaaagctcctgtcatttagcatgccttggatgatttgatgagtttcacggaagtacaaaaagggtttcaaagtatttttaatgctaatttctgcaggctaatttgatcttttgttaactgagagtttgagatgagaaggagtgttctgtatattcatggccatatgtttttagctgaagactggtattaccaaaaaacacctaaaagctttttgttgcagctgattctctgaaagagcagcttattttattcttaaagagattagaattgccagctatgcttttagtttaaaacaaacaaaatctagttttgcttaaaggaaaaagtctgactgaattatcctatttagggtgggatttcccatttttcttcctaatgaattattattaaagcgatcctaagatctgtctcaaagcagttgactattatttggtggccaatacacaaaacaagtgagagcgcttagaaacagtgaatagtctcagggaccttggtaagcatatggaaaagagaaactctgtgtttgtatttgttcactccaggtgatacttaagcattaaaatgaagtaaacttgtatttgcaggtaaacactaatgcttgtgatataacctaaatatatattctcagtagggatccaccttcatagttttctactaagagacagttatgtcaccatttcctgaaggcttaaacagtcatctgactgaacttatctgagttgtgttctattattagttcatgtgttcccagatagtaaattcttactgtaaaacattatttcattggtgagtacacattaatttaactccatcaagatcaaacaatctgattgtcattgggctatttttttttttaatttaagttctagggtacatatgcagaatgtgcaggtttgttacataggtatacatgtgccatgttggtttgctgcacccatcaacttatcatttacattaggtatttctcctaatgctatccctcccccagccccccacaatctttgggctatttcaaagagttttctattatttatactaacatttgataaatggattagaatctgttatccaaataattttcctattacatattgcagtgttcttaagctttttcacataatggcacgtatagaaaatgatagtagttgaatgccacactcaggtaaaaagagaaggctgcccactgccacgggacaccaccagtcctgggtgtcctgaccttccccaaggacttataacctgtactcatccttgactcaccaactgggaagctctgattagcacatgaacaaaatatttatttttctaatgatgaagaatttttatttgagaagaaatgttttcaagatggaacacattattgttcagaatataattatgtttgtccaattctgaacagctcgttgtctggtctttaaatccttacttaaaataagcatcttgagaacttagccactttctactttttattctttcctagaataagtcacagtcaaaatagtggttagtaac

SEQ ID NO: 129944 - DNA, 1049 bp, Homo sapiens
aaagaagggtttaagcatagaagtcttatgtcaaacacttaaaggtttgtttgtttttaattttaaaagatttggatagttcaagatagaatttttgtatcttaggaaaaattaccagatgggaatgaatgtggagggagatttagagattacaatagttgtatgcttaggtcccccacaaatattccaggaaattgtcctggaaataaattcctctttttgtagttcctttgcctatattaatatgcaattatagacccaaactactattgctcttacgctgtaattgttaggactctattcctttgttttttcatttcggaacagattttgttgtttgtgtttatgttcagctagtaaacatttcttcatttctttagcaatttaggttccaaattttctgtaggtatctggcccttggcttgtttctgccacttctggcttgacagtctgttgttgaaattccgtttttacagacagcaaacatttgtttgttgaaaaatgtggttttccccctgaatgcctcaatgtgttgtgcttaaaacttttaccccttttgtacatccacagttttgtatagacccaactatgagtaagtggatggattcttgttcataagcaggagtttggtgttctggttcctacagtttgcaatgggttttgaaagcaagtgcattgtttttagtaataaaaaccttttacagtattcacgttatgctgtccaatctctgcaggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtgaggaccaccatatcagaataataaaaaggaaatctaaaattaccttcccaggggtccaagcagtccacctaaaagtggaatctatgataaaggggctagaa

SEQ ID NO: 129945 - DNA, 1054 bp, Homo sapiens
tcccaactggtagagaaaaactatatttgtgtttgaatttgtgtgacacccctttgcacagtcaaatgaatgcttctgcagtaactttacagggctttgaagccatttggttaacataatctaagttgttcagatgcttctggttcagaggtcacctgaagttaaggtgcttgtgtataccttaaggaattatgccagatctagagttacatgttgattattaataattaagaacaaagtgtcaaaattatgtaatcttttctcactttacaagctttgcataaaatttatgactgtcgtaagcttttaatatttctcttataaaaaattgtcaaaggcagtaatctcacttgttaaattcttccttgcaactcatatgaaacatgaatggtcatttgaactttgtgaaagtgttgtatttttcctgctggactataagtttctgaaagggaggatccatgtccaatttatctctgaatcactgtgatgcccaaagtggtactttgaatggcagggtgctcagtaaatatctgaattggtcaataagagttctctagcagattgtgggactacaggcaactcctgttaaaaaaaaaactgcagctagagtaacctttctacagatctgatgacgtcctgtcttggatgatttcttccaatgaattaccattagtttcagagtaaacacaaacatatgctgacatggcatccagagctcttctgggaccttgtcttctgttggttctttcccatgggtagtccaagcttctgttaggacagacggcttcatctccttcagtgcgccacgctccatctcatctgtgtctttgcacaagctcttcccactgcctagaggaccccccacttgcacctccgctgggaggtgacctacctcccttctgctctccgtgggtgtccgacgcaggcatcagcttgtgctctgcaactgagtctggcctgcacttcccatcacactcatcatgttgtttacaatttttgagtcgcctccctctttcagtttgcagctccttgaggatggaagctccttcattgt

SEQ ID NO: 129946 - DNA, 1049 bp, Homo sapiens
actttcctggtgagtccagtagacctcggcagcaagatctcaactggataaggcaggatgtaaataagtatgcatttctctttgtaaaagtagcagcaacaaagtctgagcacataatactggcagcatgccaagcgctttgtatggattatctgtttgaattgtctaagattagtatgatttttatccccatttaactgacaagaaaactgagactaaagttgagtaacctcctcaaggaccctcagccagttagggggcagaaccaggtttgaacccgagtagatgagggcagcctcagcttggaagtcttccctgctccttggggctgtggtgaggctctgaggtgtcttcagaaccattacctccaacccttttggtatctcagaaacttggtggttactgctgtggcataagagtgctccctaaaatccgaccccacttacactcttagaaaatatctggtcagtatggtacagtcaatgtttaatctcatgagttaacaagagaaaaaaatctaaagaaatagaaatgagttatccaaagtgagtctcttcagggatttataagctcacacttggcctatccagaacccatgctggccgtgagtaggctcgtggttgggggagggcctgttgaggagcatctgttgatgtgtgattgggagttgtctgttctggtgaatcctagttgttattttgaagttttagggacagtttccataccctgagaacagcatggtgtagtagagcctgaagacctagttccagttgtgccatgtgcaaggtaactctggccttagatttgtcacttatcttctgctaccatcagttttcccatttgaaaacggaaattataacttgccctgcttcatcatagggttatcgtgaagatcaaaagggctagtataagtgtgagacattgattgtaaagtgctgtacaagtacatgatgggattattcagctggggaaatagcatttgtattaccatgtactcatggccaagaaggctgcgattcacgtatcagtcctgaatgcacaccagggct

SEQ ID NO: 129947 - DNA, 1019 bp, Homo sapiens
atggatgaacagcagcagctgccaaaagccactgttggcaaacagtcctgaagttaagaactttttcccccctctgtcttcctctccagggtcctgctgcgtgtccgcatgctgtactacctaagacaagaagtgataggagaccaggcggataagatcttagagggtgctgactcaaggttagtgcgagctcacatttgttctcaacctcagtgagataatctgggtagccggaaaacatcatggattgtgtttcagaaccttcataaaccactagtaacccatctccttttttgcatcttgaatgcagtatttgtccttcgtgcttggggatgtgatgagaatcaggaaaaggctgtttgcatttatgtttgtagtgtaaagagatgtgaactaaagcactggtgttctgagatgacccttaaaatgggataccatgtgataaagttcatttctggtcatggcagagggctactgactcatgccctttcttttaaccttgctgatacctccccaccatgctcagatgtttatcgtgggagagagggcatgtgagctatgtatcacattcattacttggaattcttttttaatactaatatttcttataaatgttgtctttcagtgaagccgatgtgtggatccctgaacctttccatgctgaagttcctgcagattggtgggataaggaagcagacaaatccctcttaattggagtgttcaaacatggtaagtgacgtttctgtttgaatacatctcaactgtatggcttggtctttatttagaactctttacatactcttttccaaagtcataatattaatgaggatagttccaaaggactcttggcgtctaccatttttctgtactaaaaatctaatatgaactgtaaatatcagatgctgtttttgaatgtttgttgagcatttgagaagaaaacatttctttcttggctgtaaataaaacccaaaccatatttgttttaataatagccaagttgtactatagctctccctaaa

SEQ ID NO: 129948 - DNA, 1034 bp, Homo sapiens
ggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaaggtaaggccttaccactggcccctctcctgaccctgcagcagctggttgtgagatgcgttgctttctggcagcacggcacctgctctttttcacgagtacttagtgtacattttcttctgtgaagggataatttcaagttatgcttatatctgtgttttgctctcgcaccttatagcacctaaccatggtattttgaagaacataaactctaagaagggttgcatggacacattagcaatttctggtttaaggatggaagttaacttgtagtgagtgacagtgtattaagaattctatgtgattttaattttgacaaatgtgagggaaggtggtcattcactgagtaaatattgttaatcattttgaaacaactggtgcttgttatgttttgattcagaagtaaagagtgggaatagaatctaaaaataaccaattttttaagtcacagtacggttgctgaaactggcccagaataaaaatagagcacg

SEQ ID NO: 129949 - DNA, 1002 bp, Homo sapiens
atctatgttaaagggctgttgtaagctttagacaacagtgcccaataccattctagccatgtagtaggtactcaataaaatggagctgattagtattcacatttttaatcatgtcctttctaaacttcagtttccctgatactgtggttgtgagtaatgcacattaactcatttctcagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggttggcaggtttttgttgctgttgttttgctgaccaaaaaggattagggtagaggaaatctttctagcttgatttttcaagtaattttaaggtaaacttttgacacagtatatgaagactatagatttttcttatacttttaaagaatgatctgaaaaagcccaaagaaaaaaattgtagaacacttttctaataggatgggaaatgtgatgtgaaagaaagataataagaaatagaagtgtgtatatggattgatctttggctccatgtggcttttaggttacttacccccgttgtctagcataatgtatggattatcactgtgttttaaaatttttttgtgaaataaagccttcagatttaagacaactttatagttttggaaacctaccagcttcttgacttggaagagggtgtactgttgacccatttgcttttgacgcattatgagataattccaaatgtagttatctgtaaccaaaagcaaaatggaaattacttttttggctaaatagtataattttataataattccctgtgtaatttaggtctgtttttcagggtgaggaaataatcatcctaatcaccataacagggctgtctggtttaaaacaacacaaaaaatgagcttcagtcagcctaccccccaggctcgtctttcc

SEQ ID NO: 129950 - DNA, 1132 bp, Homo sapiens
agcacataaatcataatgtgtcctggttgttcatgtgtgccacgaccaagggatgtctagggtactttgtgagcccaaaggaagcctgggagtggagggaagaggatatggggagaaacagatgaagaagtttccctatggatggctgtacttcaattaagttttgaagatcatgtagtagttggtcattttaaaagggttggcagagaacatgtgtaagaggagagagcctcttgggtttgaagaactgaggaatttgctgaggaagtgagcttcagcagagatgagcttgcagagaaggcaggatgcaaatcatggagggccttgatgccattcggaagaacttggattttgtcctggaggtaatagggatgcaattattgaaaaaaataggagagtgatgtgacataattttttgaactgggaagggctgcattttagaaaactgactccagcgtagtggtgtggaggttggattgaagataggtgggattagaatcagggagaccatttaggaatattgcaataacctgggtgggaagtgacaaaagcctgggccatggtagagctgtggggaaggagaaatgggtgtctggaggttgaaataactgtagacttcagttagtggtggtctttccaatgttgccacacatgtctgagacaaagtgtcccactaccaacaaaattatattgtgcacagagtgcccataagttacatatagactggcttttagaaattcctttagtataaattatctttaatatcattatccggggatctccaagagagactgagaggccgcctttcatgcatatcagctcagactataccccccatgttgtattcccagtggctggcttaggatttcagagcatggaaccttagtggactataaattttttacctaattactagttctacagtgtgaagaatgatataaaagtttcgtcttcttctttttatttttatttttttgagacgaagtctcactctgttgcctaggctggagtgcagtggcacagtctctgctcactgcaacctctacctcctgatttcaagtgattctcctgccccagcctcccaggtagctgggattacaggcaagtgccaccatgcctggctaatttttgt

SEQ ID NO: 129951 - DNA, 2084 bp, Homo sapiens
gccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaattatagaatgtagtatatagggaaactggtgttcactctattttttttgtattcgcaatagatgcaaatacagcattctggcttttgtacagtttcttgatatatcctcttatactagattagcttttggtaagacactaaactgtctcgaagactagacaggaaggaaaaccttgaattactctcacataattccactccagatatctcaacagaaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaacca

SEQ ID NO: 129952 - DNA, 1006 bp, Homo sapiens
tccagtgaaattcattcttggtagtagatcttgaatctacctaagtattttattttctttctttctttctttctttttttttttgttgttgttgttgagacggagtctcgctgtctcccaggctggagtgtagtggcacaatctcagctcactgcaagccccgcctcccactttcacgccattctcctgcctcagcttccttagtagctgggactacaggcgcctgccaccacgcccagctaattttttttgtatttttagtagagacggggtttcatcgtgttagccaggatggtcttgatctcctgatgcttgtgatccacctgcctctgcctctgcctcccaaaatgctgggattacaggcgtgagtaaagtattttcaattcagtcagatactaatgggtatgatcgtgtgcctagcatggaggaagcactgaggtgccaagggttctcctggcattgctccctgatggaagttctgttcttccctgaggaggctgaggcccgggagttggcatcatccccagcagtaagtgcaggaacaggacttgaactcaggtggtctgactgcagaagtctgtgtatgtgctcctaaaatactgtgcttttaggtctctgaaagaaaattatgacataaggataactgaaagttcgctgtttattccccttcataacatcttaagtttgaggttgggaattaagagaaagtcttgaattagagacttagctctggctaaggaaatgaatcccacctacctcatttaaatttggatttattttgccccacaagtatttctattttataaagaaatcaagtctttaaaaagaatttgtccaaataagttacagagagagtaaattgccagcctggtatttgaaccccaattgatgtaactccaaagcccaggctcctaaccactatgctagtgtaattaacattcatcagcaacattgggtgctgtgtgctagaggctgtgctgggaatatagaaatgaaagcaaacaga

SEQ ID NO: 129953 - DNA, 1046 bp, Homo sapiens
cattgggtctggtgcttcggaaaattgggatctgaataattttttattttatctgtcacctatcaacttccccatcacaggacatactgcagagatgtgatggtccagcagaagcgcagccttccccttatgcattcacatgctggagctggaaaaaagctggaggaatccaacccattcaagttatgaggaagaaccaactcttttcagtccacccagctggtgagaagcaggtactaacacttgggtatgctttctctcaccccagttcttccaccagcacacaaaatgcccttccccccactgtcacaaggttgaaatgtagttaatcatcaagaacaaggatggtgtggaaggaaatgaaaggggcagatacagcctagataataagtaacactatattgggtacttttctcttaagactcatatcaattcaaaaaaaacatagattataatagctaacactattaatccttgctatatgcattttacatggattatctcatttaatccctgcaaaagcctatgatatggatgttattgtcattcctattttatagatgagaaaacgggcttcaaaatgtcaaataacttccctatgatgccactagccagtggcagagaaaggattcaaatcaagaactctctgatacataaatccgtgtccttaaccattagcctatccatgggcaattttcttacctccattttacagctatggactcggcatagcccagtgtggcagagttcttagatacaagttatggcaaccaactctggttcacttacacagaaagagagttggttcatttatgcaggaagaggaaacctagcaagctcaccaactccaggttgcaagaaccttgcggttctctgaggcaccccatctatgctcctattgtccactgcagagcagaactccatttcctctttcttagcagacggattacttcagtcaaaacccataccatcccccacacaccacacactttcttttttctttttctttctttctttccttttttttttttttttgagacagagtc

SEQ ID NO: 129954 - DNA, 1022 bp, Homo sapiens
gaagaaactgaaggcttggaagaggatgataaagaaaatgataaggctgaagaaatgccaaatgattcagtccttgaaaacaagtctcttcaagaaaatgaagaggaggagattgggaacctagagcttgcctgggatacactggatttagcaaagatcgtttttaaaaggcaagaaacaaaagcccagctttatgttgcccaggcacatcttaaactcggagaagttggtgttgaatctgaaaactatgtgcaagctgtggaggagttccagtcctgcctaaacctgtaggaacagtacctggaagcctacgaccatctccttgcagagacccactaccagctgggcttggcttatgggtacaactttcagtatgatgaggcagtggcacagttcagcaaatctattgaagtcattgagaagagaatggctgtactaaacgagcaggtgaaggaggctgaaggatcgtctgctgaatacaagaaagaaattgaggaactgaaggaactgctacccgaaattacagaaaagacagaagatgcaaaggagtctcagactactgggaatgtagctgaactggctctgaaagctactctggtggagagctctacttcaggtttcactcctagtggaggaggctcttcagtctcctgattgccagtagaaagccaacagatggtgcttcctcatcaaattgtgtgactgatatttctcactttgtcagaaagaagaggaaaccggaggaacagagtccctggaaagatgatgcaaagaaagtcaaacaagagctggaggtgaacggaggcagtggagatgctgtccccagtggaaatgaagttttggaaaacatggaggaggaggctgagaatcgggttgaaagccgggcggcagtggaggggacagtggaggctggagctacagctgaaagcactgcatgtaaagagagggcacagccctcctcccaagggaaagtgtttttgtatataatgtattttttcacttttggaggattctttttgtat

SEQ ID NO: 129955 - DNA, 1041 bp, Homo sapiens
ctactacctccgagggcagatcgctttccagatatacttaagagtttcacatcctcctcctcttcatcttctgactctgcatcttcctccacagctactaagtgctgtccactaatatgcactggccctgaaccacacttcaaccttaagactactggtggtgttgtttcaaagcccccaagggaaaccgttggctgtacagacattttcaaagttgccagtgttactttaattgggctgccttcgtaattcattgcctctgcttcaacaatgtgcaattcatcctttgcaccagcccctaaactgaccgttcttaaagacaactggcgctcattttcatcattatccaccttaaagtgacaatctttgtcagcctttagttcacaaccaaaaagatagttctggggcctcagggagctcatgtccacgtccatcagatcttccatcgggaggcagcacgcacttaggtaggagagaaggcggacgaagataaacgaatgctgctccagagaacagccacacaggatggaatcacaccaggggacattcttaaatatctgctagccatgataaagaaatcaatgtactttatgttcttagctcctacaacttagcctaaatatttgccctggcatgcttataatggtccaagcaagcattaggacataacctgttcctcttccttatttaaaggtgtttttacctttctcagcattccacaagttacttcctccttcctttgttttcctctacctttgcctcttttaaaaagttctaagttgctagccaatcgggtcaaatacagaatgttagatcccattccagccgatggaaaccagacacagcagtagggtggatctgtcaggttataaatgaccctgtctcctttgtttggtgtactctcatggcaaaactgctggcgagtgtaccctttctgcagaaagtataaaaatggccttgctgagtaaattaaatttatgttctagtgctatttctttacggcagtggggaacaagcatttcaaacagacacttgttagag

SEQ ID NO: 129956 - DNA, 1033 bp, Homo sapiens
tgatttcttttgaatgagtagttggggactccatttctaaggagactaggtaaataaaatgacctttgacatttcatcctgcatttctagtcttctcttacttcagtacttgcatatttagccatccatatgggtcatgctccatgattgaatatttaccctctcagcaacaaccatggtctttctccacatctttaatggttgcaggagggttgtgggggcaagggtaaatggtttgatagcacttttctttgctgtagtgacccagttgaggcaactggaatggattcattaatcactgacatgtgattttcatgagacatctcctctgcagacacatgctgcactaatgggcttttgagctgcctgtggtaactcacattgctcagatgaaataatcgtatttcacgtccatgtgtcttcctttaacgtcagctcatgacagtcagctagtgacctgacaagagatgtgacatcaaaataattttttgcaggatatcatcaaaataagcaaactttgcaaatacccagacctatgagaacatgctcttaggctgaacaattcgatgctggtgatgaggtcaaaggaaataattcagtaagaatggaaattactggagatactattgtctcagggctttgtactacatgaaacttgacagtggtgtctgtacagtttaactctgatacatttacttggaaatgcacttaattttcaaaaactggagagggtccctgtgtgatacctcagaaaaattcttgtcctaatgcagtgtgtccatcaaatttagtctttattttttcaatttactacaataaatatgaaaggagggagaatcttttttacataaatgccttgcatcatcctccagtcccctcactgggggaaaaaaaaagcatctctcaagtctttgtccaactttggctgctcagaccgatggctggtgacagtcactgcaggggttcaggagtggaggaccttgtgtcaagcagaacacacgtgtctgcatgggtcagttgtgcatgtgcttcc

SEQ ID NO: 129957 - DNA, 1045 bp, Homo sapiens
gctgatattcatcgtggatgtgtggcatccggaactgacaccacagcagagacgcagccttccagcaatttagcatgaattcatgcaagcttgggaaactctggagagaggctgcctttctggttccatctccttgggtgtgaggatagaatttcgaacaccaagagtcaattcccttgacttgcagcccgagtaattcaaagcctcctcctagggtcagaagacactaaagggaatatttgcctcgctgcaattcatttaggaaacaccctgctgtgtgtcatctcatgacagcactggtcttctgccagtatttaaggtgaacatttgatagcttctaccttaccagccaaagatattttttccacatagaataggtctaattcaatgtataatgagaacatatgtagaaactgtgaatggattgctttagtttgtaatttttctatgcagttatatttttctagtgtagctagactattttgtcatcatgtaccactacatttttgtttattttaatgacaagctgtataaatgctttacttctagctatttaatggtagcattactggggaactcagacttccctcttttaattcttcttagtaaaagatactcatgaaaaaagcagttttattttcctaacaaaaaagaaagagctcattatgtcagtgtctatgaactgtacccatcccaactctcaaatcgtttggttttttttatcttgattgagatcctcttctcactatgctagtggtggagatattgacaaaatcctatttctttcaaagaggaacttttcacaccgaaaaaagagcatggaattattttatattgttataaaaatcccagatgcaaatttttttaatgccaattattagagcttctggggaaaaagtatagttcacggaaataaaactatgttctttcagggttgggtggataggtggctgctagggtgtctggctcctggcggctttgccatccatgaggcaagggctgggaacacagtgtctttgcctatggtagatccatgtgaatgtca

SEQ ID NO: 129958 - DNA, 1021 bp, Homo sapiens
atataacaactatttacatagaagttacattgtattgggtataataagtaatctagtgatgatttaaattatacaggaggatatggataggcaatatgcaaatactataccattttatatcaggaacctgagcatctgcagactgaggtattgcagtgcggcagtgatggtggtggtcttggaactaatctccagtatataactaaggatgactgtatatccttatgtcacagtagaaaattgagatttaggcttcaagcaatatcttttatctctatgctattatgcttcaatgtgttattgctattaatattaatgtggcatacagcaaaatttagccatggtaaattaaattttaatagagtaatttaaaggaaacttcaagttcatagtagttttaaaaataaaaattcaacagaagatgggttttataggaagaaattatgactttcattctttgttagcagattaaacaattactttggaatattccaacaaatttttaaaattttgcaacattaagtcatatataaactatagtatctctcatttctaaagtagcactgatattgtctttttcttcatatcaccaaaattaattttgatcaagttccctgaacattggacacaaaatattaaaatataaactcaattcactttattatctttcacaaaccattaatgcctttgaggcagaaaatgacacatctcataggaagattggttgggtgaattagttagagtcaacaaaaggctttgcgatgttaacatcctgtaacaaatattcagtttcagtttagcttgttttatctacagatgctacactgataaaaatcaatctgcagacttttcagtgcaagtgcctatcagttttattcaagagcttataaagaattatgtgccattttagtagtgatatttttccaattctgcaagttgtaaatgttaatacttcattaaaacaaagggccctggggcaccagagaggggacaaggcatacagattatactatctctctcc

SEQ ID NO: 129959 - DNA, 1082 bp, Homo sapiens
tccttgaagaggtccttcacatcctttgtaagttgtattcctaggtgttgaattctctttgaagcaatcgtgaacgggagttcactcatgatttggctctctgcttgtctattattggtatataggaatgcttgtgatttttgcacattgattttgtatcctgagactttgctgaagttgcttatcagcttaaggagttttaggggtgagacgatggggttttctaaatatacaatcatgtcatctgcaaacagagacaatttgacttcctctctttctatttgaatacgctttatttctttctcttgcctgattaccctggccagaacttccaatactacgtcgaataggagtggtgagagagggcctccttgtgccaacagtctggttgttttttgtaaagtttgctttggttactgagtggaaaatggattatggaggcaaaagtagatgcaaaaagaatagaaggctattgcaagtgtacacaagagatgctggtggcttggactgcgttcacggccatggagatgagggaagtgggcagttggtggagctgaaaggacttgaggatggattagatgtaaaaacatcagaggaagaggactcaaggctgacccctgagtttttggttcggccagctgagtggaggataatgccagttactgaccaggaagagcaagtctggagtgatgcagaagtcaagagttcaagagtttgctgttggtcttattaagtgtgtgatgcctatgagacattcaggtggacatgtcaagtagaccattggattcacagagcctggaacttggaggaaaagccagggcaggatatcaaaatatgccaggaagtaaagctccaacagctctgcctagaggtcaagattgtcaaccctgctgggaaatggtagattcagagtgcagaaattttccagacagaggagatgctgacagcacccctatggagaaggtccatgcagacatttgtacaggacacacacaggaactaactcagctgtagataaaacaagtgaattttgttctgaactgaagatggtgaccacttgagatccagatgctcagtatctt

SEQ ID NO: 129960 - DNA, 1049 bp, Homo sapiens
ctaaacgaagaaattctgttttatttgacttccttgagaggagccttccattttcatctttatctgtatcagaaaaagttgtggacatattcaaaaaaactattttaaacaatcttttggacatagccaagaagtagattatgagagtttaggagtcatacccaccatttacatcccagaaaccaagccagtatcctggagagtttcagtatactatccacccactctcccaagaacacattgtagcagataggtaagggctgcattgccttccttggcagtcactgacttcatcacaccatctaggggaggaaatggaaggcgagcctgcagtgtgccttctcctgcaggtctttggtggagaccagcatcaggtttcccactacttgtaaattgttatgcttaataactatttctagtcaaaaaacgttaaaaataaaaatctcttttttctttcagttaagaaaaagaagcctaaacttttaaataaatttgataagactattaaagctgaacttgatgctgcagaaaaactccgtaaaagggtaggttgatattttttgtgcaatggttttgttgttaaataaactcaggcattactcttgatttgttaaaaaaaaaaaaaatagtaagtgtaaaagaaacaacagttgaatagagtggatttttccccaggcacatgaacattccacatgaaatgaatcagatggaagagaattgctaccacatggccaaagagaaatagaactttccttcaggccagccgatgcgggtgtcagcctacctccatcacattctagttatgcagctttggggaaaccacttggctcttctgggcgttagttttcttacagacatgataatgataaatattctttctacctcctaattgagttttttaaagatcaatttaaagatcaaatgagaatttttttttttttttttttggacagagcctccacccaggctgaagtgcagtggcacagtctcggctaactggaacctctgcttcctgagtttaagcagttctcctcctgagtagctgggat

SEQ ID NO: 129961 - DNA, 1010 bp, Homo sapiens
atctcacattagtttagtagagggagcagatgaaaacaattgccctttatatactatttactgggttgtataagttagcatctctcagtgaaaaatatttgttaactgtttggtttaagctttgaatattgacctcctgctggtatatagttgataattaattctgaaaaaacagaagtccattattcttagctgtaggaggcaagaaagagtgtgccatccttggtaagagagtctttcaagagttgcccaaatttacttcttcttctggtaatacctatagagtagatcgtgttagagaaaaaaagcctcagaaggggctatttttggatcaaacacattagcttttctttctcacatggtgataatacaaacaaaggctcctgccagaagcacctccatggctgtctgcatattgggtttctcaacagcaaatagcatgtctctcaatatgagagcagatttatttcagaccccagtgtgaggcatcacagtagggaataccttgcacaattcccacttttaaatgaaagagaaaataactgagggcgcctacccacatcccccgcctgtaggaacactcgtagattcaggtttgcttttcctgtgattagcagataacgtttcatcaaaaatcctaacatgggattcttgaattcttgaatgttttcttcttttttaccctttgccttaatttatagatttacctcactgtcaagacaaatgtagagtgatgtttcttttattgaaatctatcagtgattttaaaaagaaaagcagaattagcttccaatcctaataaaggaagattaaaataagcaggggtcctatcttgggttaactgttaattgctatgaataatattgcagtaaggttgctttatgtgatgactttgaaacttcacaccacatctcagtcagatacagagcacctttttctttaatatcttattttggtcttacttttccttcccttaaattgttttgctttttagattatttttcatcaaa

SEQ ID NO: 129962 - DNA, 1086 bp, Homo sapiens
gaaacactaggtattcctcattgacaacagcctgcctagatgttgcagcacaggctggtggttcagttccagctaaccactatgcctagtaatttttccatgttgttgaagagcaatgtagcaatagcataataaaccaactcaaggaaaagctttgaaaaaacagtctcccgtccacccttgcagctgtgaaaagagattatgagataactgctcttaaagatttattgtagtcattacattcaacagctacagtagttttagtggttcctaaaatacaccagcagttattgtctgattacttccacagataagttaattatacaagatttctgactctcatacaagtctgatttagagagaagtttaattatggcaattttagtgattgaaataagctcagcatatatcatcagtcttagcaagtatagtagaggtttttagctgtgttaaaatacacattctctttgtttttatttttcatttcatgatttctaaccatagtgtagtacatgtgataatttaggacacctgttttcaccagagtgcatcttcagtcaaacacaccacaggacaacaatagcaaattcttcattatcattaaaatcccattctaatgctgcccatggagcactccacattttacaaagctaatttgtataatgattgtgacaatgtgagcaggaaagtaaaatacttttcttaaggaaaaaaaaatcaggtattggtatgttttaaaatgactgttaagattgtaatttttttaatgatggaagatgtgacactccttcaaatcaggcaatgcacttcattgtttatgaacacattgtctatttctatactgaggcaaattaaagattaactttaaccacatatgcttaaattaacttaaaattaagctttcaaaaaatgtgccataaaaagacagtgctgtgagtagttgaatatattcatttatttaaacaagacttcaaattggtgagtacattagtttgaaaaatgctttactgaaaattaccttagtctgagccctgcagacctcttccccatagcacttttcattcttctaatataatggtaggtcca

SEQ ID NO: 129963 - DNA, 2363 bp, Homo sapiens
tttaatttttaaagcaatatattttaaatgcagcttatagtgtccagttgatccttgaaactgcttcttgtatttatttttcaaataccatactagatttctgtttctttttaatagagtgaaaatattgaagaaagaaatttaatgctgtgtttcttaaaagattgagattattcagttcagttttaattctcaagtgctcgaaagaacctgagattttcatcagcagctttgcaagccatccccaggggcttctttcggtagttgattattctgttaccaagttgtccttaaaaacaaacaccaaaaaaaaaaaattactttgttggtgggttttttaaaaagtagaatgaaaatgaagcagtttcacagtctgtgtctggttggtcctttaatttagatttccccttatttttgcagatacttaaagcttcaaaaagactgcccctaccaccacaggaggaccagcctaaccatacgctccaaaagatggctgtgatagatcttgtgaagcaattactgagcagatcaagatctttgggaaggaacactaaagatgttttgaatgaattatagtccactggcattttagtgtatttttttttctttttagaaacacacatttctaaaaatgtcatgttacattcctgcatgtcccttttgatagcattagtggatccattggatttcttttttctttttgtgagacagcttttagtcttacctgaatttatgtgtgtttttccgacagtggttaataattatattggtgatgtagcagcaattgtgttggcagggttttcatatattattagtaattaacactaactgttggactgacttgtgtacactgtgttaaacatgatttaaaagctattaagagtactttgtgttagcactcttaaaaacgctaacagagatcatcattagctgtgaagatttgagttgtatatacctgcactgatattcttatcaaaaatttctacattagctttaagtgttcagattaacacttttgaaatttttgtagcttttagctgattaattagaaaaatttaatatttcagtgaaagttttaaattatcatttatttatttttttaaatgagaggggaaagctgaaattccttgttaagacacaaggaaaaagaatggccctactattatcatgcaaaaatgctttgttggcacctcagattaatcatataatagctatagtctcttcagcatttgtttaaattttagaaaacctgtataaattactggtgcataacttaaagattattctgcctttggctaattgagtaattcccctccagcactagagaccgctcagtgctcttactagatgaactcagtaacgccttgagctgggttgattgaggatgtgtgaaaagctcacagagcccgatgcctgctgctatttcacggcaatgagcctttttctttctacactgaagattttcttcttatttaatgtggtttattttgggctcagaaataattgctctgttgaaaataatcctttgtcagaaaagaaggtagctaccacatcattttgaaaggaccatgagcaactataagcaaagccataagaagtggtttgatcgatatattaggggtagctcttgattttgttaacattaagataaggtgactttttccccctgcttttaggattaaaatcaaagatacttctatatttttatcactatagatcatagttattatacaatgtagtgagtcctgcatgggtactcgatgtgtaatgaaacctgaaataataagataataagaaaagcaataattttctaaagctgtgctgtcggtgatacagagatgatactcaaattataataaaactcttcattttgtgaattatagaagctactttttataaagccatatttttttagggaaactaaggagtgacatagaactgatgaatgagtaaaagtaagttttgctggatttttgtagaactctggacgttgaggattcattatgctgtggttaactttaaatatttttgaattccaaatatctgaattaatgagccttgtctttacaaatatgtgccattgtgcaacatcggtggattttctaaaaataatgtaaatgtcttctattaaatgttgagtgcaataaaatacagaagaattctctatattgtcattatttttgaagtataaggtatttttaatttgttacataataaaatcagttcattttatccttactagtattttagaagattatagcatttttgataactaaaatcacaaaggaataccttcagccagttaacgtatttctaacagataatgcttattttgcatttactatcatgctacattgccagga

SEQ ID NO: 129964 - DNA, 1055 bp, Homo sapiens
caaaggagatgagtttcaagaaagggatgttcagtggtgccctgcgctactgagaaccatgtgagatgagtgctgaaaacctgccctgatctggcgctgcagtggcctcaacgggtgactttagctggaactgtttcagtggacggataggacagatatgatagtttaaaccaagggtggtggcaatgatggaggagggaagtgggcaaagttgagaaatgcttagaaggtaaaattggcaggtcttcatgcatgggtgtagctggggggagacaacaaggtgccaagagccacatacactcttctgcttctgcagcctggtgacagggggtgctcttttcctaacgtgggagagactggagtcaagcacggggcaggggctcatgagtccagttctttacatgatgatagtgagatttctttgaggcatctgagaggagagatcaaatgagccatttggtggtgtttgactctcagaagagaagtctacttcgtgattgtgagtgtgggaaccatcagagtagttacgtggtcatcaggaccaagctctgagatcccttaaggagagcagattgagggagacatgaggtggttctatggctggactttgaagaaagccagcatttaaggacggctaagaaaaagatgaagtgaaaaagaagattgagtgggagaaacgaaaaaccaaaggggagagtatggtcaccctgaagtccaggggcaacagtgtttggagaagaatggtgttgctaaaaatatagcgagggctggcgagtgtccatcatatcaaatgaggcactggagggggtctcagcaggagccttttcagggatggggtcagggtctgaagacaggcgggagtgagttgaggggagaggaagagatgagccatgagatgtaaatgactgaagaaattagattgttcaatggaagaaagagagggtgacgagaagcaagcttaagaaagagtggtattgcatttttaagttcttagaagcttgagcatgtttaaatgctgacactgctcagggcaacagagtgagcacacattcact

SEQ ID NO: 129965 - DNA, 1036 bp, Homo sapiens
agtagtagaagatgaaagattgcaccatgatacaggtattagatgagcattttcattagatttaaaatattaccttagatttttcaatcacatgctgtgtttacatggtgatttttcttttaaaggcatcaaagaagtaatttcgacatctaatgcatgagattttgttttataacaaagttagactgttataagaatatcaggctttcatatttcacctcatcaactaaccattccataacaaaacaggatgtcaaattttaatgctgtttttgtgtatcaaattcctctgtgccaatttgagaaattttaatgaaaataatttacctgccttttaattgcttttgggcagaggcatttattattgactgagcagacattaatatttgaaggagtagagttctgtgtttacgattaagtagtattttgttttaactgaacaattgtatagaatgactcagttaatacttattttgcttttattctcttttttttttcagatgatgtaacataccaagtctatgaggaacaaggtttgcaaatgctttcttttttttttttttctttttttttttgagatggagtttcgctcttgttgcccaggctgcagtgcagtggcacaatcttggcccactacaacctccgcctcctgggtacaagcgattctcttgcctcagcctcctgagtagctgggattacaggcatgtgccaccacgcttagctaattttgtatttttagtattttagggtttatctcaaactcccgatctcaggtgatcctcccgccttggcctcccaaagtgctaggactacaggcatgagccactgcgcccggcctgcaaatgctttctaaccttaagccaccttcttgttttaaaatatacctatagtttgactacaagatgtggaacattatgctttaaactataaactttgcaacttaaaacatccagatgaacggtagcgttcaaagaattcacttggggagactgtttacccattccacggcttctgccattgcctaaataatttctta

SEQ ID NO: 129966 - DNA, 1018 bp, Homo sapiens
gtgacggacagatagctcttctgctatctggggtgtatgggttaagtgttcaacacatttacccttcagctccctaagggtataaagcctcttcagctgtttttctctgttcccatccatagttgctgtactttcgctctagaaaatggtaggacaggtcgaggagatagcacattctagtgggttgtgaagtggattagaaatgaacggctttcctggtctggcctgtgtcactctaagttgtcctctctctttagtccagggggtggtggttgtcagccttgtggggatgagtggactgagaaggagaatgtgtgagacatcccacagtgtacttctagtgaaatataaaagtgttaagcagacttttaattgatagtcccattttttaattttttaaataaaattaatgataagcatagattcagagtacatatacgggatatatacataccattttgtaaaagcagtaaatatcaatctaatttttttttttccagaaaccgagcatagttaccacgtggaagagacaggtgagattttaatttaattctgttcttaattagagtgagtcttcctttaaaagggcatcataaaatacataatatctattattaatgatatatttaaattaatatatgcaagatatgcaattaataattttattacgtcttatatttatggtatttctttgtgaatatacttttttgtgttttgatgcctagttcctgaggataaattttcagtaggattactagttcaaaagatacaattgaattgcatgttttgtacctttcaattacagagtcaacgaaaggtctaaatcatgttttgtcacatgccagcgcccttaaagggcatggccacaggaggtgggcgcatcatctgtcagcactttactgttttgcggtttgagtgtaaaccagttgatgacaggccccccttactcatctttgcatttggcatttaacacacttaatacctatttgtttcaggagtgaacatgtttgaatatcat

SEQ ID NO: 129967 - DNA, 1381 bp, Homo sapiens
tctttgacctgaggataattgaagaggcaaatatattagtaataattatgaattcatttattcattcatcaaatatttattgagtgcttcctttagctagacatggccctaggtgactgggaatatataatggataaaatatataagcttcctgtcctgatgtgtaacatcctaatgagaggaaacctgtcccccaccacatatacttaggcagattagcacttggccagaggaagaaaatagctgtggagtggacaatggtgtcttcagcggccgaaaggaggggcaggggaagccccagcagcaggagcaggtgtgtggcagcccttcacaaggggctttcatgtctcagttgtatgttgccagtgtcactttgttcattgtcatagttgagggagaagacttgcaacaagaagatggacccacaggagaaccacaacaagaggatgatgagtttcttatggcgactgatgtagatgatagatttgagaccctggaacctgaagtatctcatgaaggtagaacacttttttttcaagttttaggataaaatataatcaatgacttctaattactgaagtttttcttaaacccctttaaaactgatatttaacttttgcttagatttttaaaagttgaagcttaaagcttcaattaaagcaaattttttcttaaaatagataccttgattttggttcaaagcacttttcagggaaactcagaatatacaaatttcttataaatagtgagtcaaatacttgaggaaactagttttactatattcttctgcttagggtgctatttgttaaataaaattcaaacaactgatgaaatattggacttgataatctatcacaggctcatgttcacacatgaactctgtaattacagtgagcaaaacacaattcttagcttctgtaccaggcattggcaaacttttttttgtaaatagccagagagtaaatatttcaggttttctggatcgtacagactctgttcagctactcaactctgccatcacagcgtaaaagcagcctttgatagttcctaagtgggtcagtgtagctgtgtttttatacaacttatttgtaaaatcctacccaacatggctggtaagtgcagcggcttgaacacagctcactccagccttgacctcccatgctcaagcagtcctctcacctcagcctctcaagtagctggaaccacaggcatatgctaccatgccctgccaatttttaaattttttatagtggcaaggtctccttatgttgcccaagctggtctcaaactcctggcctcaagcaattctcctgcctcagctttccaaagtgttgggattgcaggcatgagccattgtgtgtccagttagcaaacacttttt

SEQ ID NO: 129968 - DNA, 1017 bp, Homo sapiens
aaaaataggcatttttatgctttggaaatgattttgtagtgtgattagcatagtagatattacatttaaactcttttccttcctgaagtctaaattaactttctattttttgtcatggaagattagctctttgacaacaaccgatgtcactggcattatctcacatgacagcatttatgataccaagtgtagtgctacttctattcactgaacatagattatatttattagagaacttagtatcaatgtagttatagcttcttgttcattgtgtgatgttgcagttaagtctaataatctgataagcaccacagtgtttttggaatgtcatcatttatgttcacttttgtaattcaatttatttgaatttatggatctcagtgtcagatgtggttctccaaagctgaaaggattgtcagttacaatgtaaggttttctactgacacttcctgacaaacctgagtgagagcagtcggctacctctgagtattcagtcctctcacctgcaggagtgccctttctcctctcagggaagataggtaatggttgaccagatacttcaatctgtattgaccttgtcttccacatttctgtctttatttccaactatttccctttatgaaagctttgttcttcccactttattttatcattattgcgaattttattaattagaaacaagtcattttgcttttaataaggctcttttttaaatacaaatctgagcctgagttttctttaaaaatcttattgaaagtattttaatgcttaagtctgttgacagaataaaacaaattttacatatctaccatgtttgccaacacagaacaaaaaaatgtaagctgatagagaaggcatgcagagttgcttagtcaaatatattcattttaatgtgtatgtaccaatgtcatatttgagtgttaggggtccatgttgatgtttgagcttttctacttagctatgttttgcaattattttagaaccccagaatatcgaagatgaagcaaaagaacaaat

SEQ ID NO: 129969 - DNA, 1109 bp, Homo sapiens
atacatgagctgcacagagctgcttaagattagaatactgcccttcacatcaccttgaccttcctgccgcaggctgtccatgcacagtgactactcttggtaggagattcttaatgaggtcaggaggagtccaggatcagcaaacggaatctttgaactcttgaatttagctgttttctaaatacttggatttaattgaggacctattttaatgttccacatacaaaatatcaaataacttcaaataactaagttaatataatagattttagactggccttgactttaaaatcagtttcatgttaacataccctgctgtcttattaggacttgtaaaagggagaagaacttttaaattttcatatgttttagctgttatagaataatatgattacttgtaggggtttcctttagatgataataaatagttatgtatgatttctttttctttttaactgtttttcaagtagaataaataattatataagtgaaaacatcgagtgtacctgaataacagaaaattcaagtgcattttagttgcctcattgctgaattcaaactgcaggacttaggaattaatcgcttatgaaaacaaaaggagcttgaactcatattgaacttttggcaggtttagacatgactgttttagagattcatgaacatttaaacaatgattttgttttaatttgaagtgaaaagctaactaagacaaagagatatattcaaggctcatgtgaagttgaagagcaaactgttttcctacctcactttttaagcatacaattttagaaactattaattagcagcactattaattaaatgtttgaaaatattatttttcctggtttaatgtgacagaaaaccccacaaaaactcaagttaactttgtgaataaaaaaatgcaggacttaaagagagatctacttcagagccagcagtcccgccagaagaggctgagccacacactgagcccgaggagcaggttcctgtggaggcaggtaagcttgtcctcatcctcgagtctcgcccaggtgtgccagagcctgacaggtatccgcatttacagaatcacgttttacctggaatttgtttcacatcatttacagaat

SEQ ID NO: 129970 - DNA, 1185 bp, Homo sapiens
gactacttaagttaattctgtaggtggttgctttattgagaatattttgtattatgacctgcttagctatgcaagtttgtaacttcagaggtcctcataatgatacttggataataaagattccccatagacacttccattgaaaaagaaaagaagtaaacaagtgtcatttgtaatttgaaatgttttaagttaactgtcatgttactgtccatgaaatggatctggtgacttaggctctatctcctgacattgatttctttctcctgtgtcctcaattatttcttctcctgttaatgcccactggtaataattctcaaaatcgattgctcagaatattccattgtaaaatgcaccttggaaatggttgttttcctcatttgtaaattgaagacaatgcctattcctcaaggtggttgtgagaaccagtcaatgttgcatatgtgtaaacagccagcacatggttgggcattcagtttccctttatcattggtagaataagaatagtaatactcaaccaaaacgtctcagtcaggggttaaaaacttggaagcactgaaactgtgcttcctattcctacttaggtcaacagattgcaaaacaaatatttcagtcctttatcctttgtaatgaatgtgtctttgtgaaatgagtatagtggagcctgatttattctattgagatcattgagggggcaaatgcaaataattataaatgttgcacatgagtgaagccgtaagaatgcttaatttttaaaagaatattgtgacaacctgaaaacacaagatatgaaggctagaaaaaaagttatgaaataaactatagccttaagtatatggtacaatcgagaagcctaataaccagcctaattgtgaaaaacttatgtttgttttgtattcagaacacatttttccatagatgagattttatggtcttcagagattttttttttactctggtccacaaaaattgatttaattctaatatccatttctgcaactctcattgtaactatgtttctatggaaaatgcatttatcattctgccttgggatattaggaatatatttagttttacttctgaatgttctccagaatttctttggttacatccatggtgttaaatccattcagataccttacatggacaaaaatcatggattggctcacataattgtaaagccca

SEQ ID NO: 129971 - DNA, 1044 bp, Homo sapiens
ccagttggcctggttaggcctggtgaacatctgggaccatttttgtagttgaggatggtgattcttcccaggcgcacacctgtgcacaaagctttggaatgggagttgagtgggtcccactcaaacttcatcaaatgtagggcttctgggacaagaaagtgaggctttgaaaactggacagaagaagaagcagaacatgtcccccaggcatatgaaagttacacgattctcaaaccatatccccgtgttagatcttttctcctgagataaatggaatgtttttttaaaacttatgtacaaaattttaagtgctgtcttcactaaagattttttgttctctcttgaagaagggcaaacaattataagtgaatttgttgagagcattctggtaatttttaccttagtttttaagttcaatggctatgtggcagaaaatacataaatactaaattctaaacaaatgagtgaaaatattttggaataacctaatcatcaaaagcacataagaattgtctattgctatttagtaaagtactttgaaatgttttggctatctcattgatttttcctttgactgttagctcaagaattgaaacacctcaactaaaacatttaaagatcctttaaaagcacttgtagactagaacttgatttattttttcccatctctcttcttttccccttctcttttctttctttttgtaaatgtttcaactaacttttattgaagttgaagtcacactttatccaactgcgtaatatttaagcttcaactaaaaacaagctttcagtcatgattagagggttaaaatcatgcattgcactctcagttttacactttttattcagtaggttgttatttctgtattgtttgcttcatattgttttctaagtataattaaaaccagaaaggttacctttttaaataagccagctacaacgggacaaaaaattcacaatactaggtagttgggagtcagaagctgttttcgggaagacctgaaaagggaaaattaagtactaaaaatgtaagtttattttgcc

SEQ ID NO: 129972 - DNA, 2832 bp, Homo sapiens
cttaaatgtggcattgcaaacaccttaccttatgatttccttatgagagtacaaacagatgaaattcagagcttttgctaactgctttattaccatgtaaagcaagttgaaagcaataccttccatgagatttggaattagctgtgtgtttcatttaattgctctctcaacccaatgaactagaagacgtgtgttagcttgagttgctctacatgaattaacagggaaacatacttaaaggaatactgatttcatgatgaatataagcagaaagagaattctaatttttccttttaaatactacagataatgatttaaaaatgtcatacacatgacaattttttcctagttaactaataaaatgaaattatatttaattttatttacatatatttgtcttcaaagaagcacgtgtattttaaggacatatgtttttgagctaaacattttaaattatctttgtatatattcttacaaattatgaaaaatttgttcttacgttgccagtgttcctttaattatagttacaaagtgtgagttaatactttgtgcaaagcactgccttcgtggtgccctcaattttataatattgcatgttaatgttttaagacaagtcatactatatttcaagatggaaaatatgacaagcttctagcattttttaatagttgatatttgatagagatttgcacctatttttagccaccataaagactagtgaattaaagtaactttctgaatgtgcatttcctgtgtgtggagagataaaaagagaataccttttcactaacttcctgttctgtgattaagagatcctgtcaataaacattttttcctttaattggaaaatctgaaagttaaagaactcactaaagaagagctcaagaaggagaaagagaaacctgagtcaaggaaggaaagtaagaatgaagagagaaaaaaggggaagaaagaggatgtccgaaaggataagaaaattgctgatgcagacctatccaggaaggagtctcctaagggtaaaaaggacagagaaaaagagaaagtggacctagaaaaaagtgctaaaaccaaggaaaataggaaaaaatcaacaaatatgaaggatgtttctagtaaaatggcatcccgagacaaagatgacagaaaggaaagtagaagttctaccagatatgcacacttaacaaagggaaatacccagaaaagaaacggctaaagctctggcatcatcatcccagaacatggtcatgttccagattgcagtttgttacaaaaaagcatggaaaatgtaatattgctctgattggtgagggtgtgtaaattagccattgaatgtatcattggtgcttagcaagtaaattacctgaaatttaaatataccgtctcatacttctaaatgtaaaaacattttaaaaatgtcatagaatatgatgtaataacttctatttattgatcatgtattcagataaatgtatatgtatcatgaatttttatggattaatatattgaatactttcattgacgttaaataagaatattaagattttaaatgttatttctgtgcataatgccttgtaactttttcaagtatgctaaatactcagggagatggatttgctcgttgttttcttccctccttccccttcctgcttccctgtttttctctttcgtggacacctccccaggctcatgtgccaccaccttccctcctctccagccctcccagccctcccgcagcctttcagggggccgttcctcaggcttttcatgggttctccttccccttttccctcttatctccccttttctagtctccctccccaagtcttttactctctcctttccttcactcctcacctcaccgctgcccctcactcctgcatgcttctcactcctgacctccctacaacaacctcacccttctcccatcatccagtacatacttagtgcttaccatgtgccacatacactgctccgagaactgtggccatagccatgaataaaggggagaattgtatttagaagaacagtttcagaacacttttatttatgatacctttatagtcttagaataactatagaaaggttttaattatttcagattagaatgtactttcattttatatcacactttttttccattattttggttgaatggcatacatttttcatatttgattgtgtcattattatttaccatttctaaggaattgcaaatgtaatctcttcactagagatcagaatttagcaccttagaaaacatttaatataaaagtgaagttttagtgagaaattaattctacaaatggtttgtactattctgtgcctcaaatattaaatatctaattgtgactactgtgaaatgcagttagttgataatgataaaatctctgtggtagcatttttgattctcttaatgttaaccttattaacaacagaatcaaaaatgctaccactaagattttattttttaaaacatatttatttacttttttatgaagatcttaaaaacgagatttttgatctaattaaagatatttcaactcagaaatgagtatgtttaagtgtaaatatttctaaatgtattgtacacctttttcttaggttaacgccttttactatttaaagtcaaatactttacgacatttagttgacagaaacttcaactcaatagaattatacaacagagaagaaatcctagagaatatctaatatctccaatataatcctgttattttattgcttaaaaattaaggcctgaagatattgtaacctgataacttcgagttttatgttttgattagtcaggattttgccatttttacacattacaag

SEQ ID NO: 129973 - DNA, 1073 bp, Homo sapiens
tgattcaaatgtgtagttttcagtaaaatgaaaacttggatgtaaatgtataaccctacattacattgacatagaatttactgtgtttgatattttaattcattaaaaattattgtccgggcacggtggctcacgcctgtaatcccagccctttgggaagctgaggcgggtggatcacgaggtcaggaattcgagactagcctgagcaatatggtgaaaccctgtctcaactgaaaatacaaaaattggctggacttggtggcaggcacctgtaatcccacctactcaggaggctgaggcagaagaatcgcttgaacccgggaggcagaggttgcagtgagctgagattgtgccattgcactccagcctgggcaacagagtgagactctcaaaataataataataataataaataagttattatacctgtcagccatttgtagactaacagctcagtattacagcctgactttatatgccagtggttattcttgttcatatgttagtagtcatattctttgtgggtagaggcatgggggatgtgcatgcctctatataagcctgtttttctttataagcctgtgatattcttgtggtcatttcacgggcttggcatattgtttgtagtttgtttttttggtgaaatatgaacagatgagacttactatgtgattcacagggttttgtgatttatattttaagatcaggaacttttaatggtttaacctcctatctcttctgaataatttctggggatgaaaacaattttcaccatcttatttttatataaataatgatgaaacaaatggacaataaaatattttacttcttgatctagagaagcaaattaaacattaaagactgaattttttaaaagcagttttcagaataagacatgatagcattgcacatccattttacacttttgcaatgccagtatctatgttactgtccaaacgcattgaagtagaatgaagactcagcatgatcctgaatgaatactattctgtattcttaaaagactgtaataaggttttttaggaagaactgaagaatctcctggttgatcacca

SEQ ID NO: 129974 - DNA, 1072 bp, Homo sapiens
aataatttttaaacacatgggaataagtactggttatggttacctatgtatttcatataagtggacaaatataaccatggtcacgtttccatttttatgttgtcagtggtaagagatactaataacatttttgaagaatattgatatttcaaccaaaataaattaccattctcgaatggatgacctcaattgatagatacaaattgctatcaatagtgaaaggggaggtttgaacaatataatagaacagacatctaatactgaaagtagaagttttgagaaacgtacaaagtgggttttacaatttacagctgcaaaaatgtcagatggctttggggactttcttgtgaccacaccttagaccttcgttctttagtgacaggctaaaggccacccttcctgaggagatgaacactacattgcacctccaaccctaatgtgcctaagaaatggattggaactttacaaagtttgccaatacatagcataaaccagcctttatgtgactgagagagagaattgggaagatcagttcattgggatgctaagtacagcctggttggaataagagttagaggtatattgttagagactcaaaaataaatctattatcagaactttcatttgccaagagaggaaatagaaagctattgcaaagtttttagagtgggtgaaaaatgtaaaatgtatgtacataatactgtcattcttacttgcttgtataattttttaaaagacagtgcgaactggtggaagagcagtgattgttcaaacagtaaagatgaactctatcaaaatatgctatccttttttggatggcaagtgtgattgagtagtgaagtaaggtccttggtccttcactctagtatttttaattgatcatctgtgacccaagcggaagtctaccactgagtagaaaatgcaatttccagtggcaattaagtatttctaatgccaacaattcttaaagatctaagccaaattgtgaagttggttaaatcataggctgattataatgcatttatatgttaaagatagtgaaaggaaagctttaaagtgacaaataagagag

SEQ ID NO: 129975 - DNA, 1108 bp, Homo sapiens
actaatcttggattaccactgacccctttctccattactgtatttcccattgttgctgggaaaaaaaaatctgttataaagttacctgtactgagcctctgtcgggggcatgctgctccaacagtttcccttgttagcagtcattctaaacttttccacaaccttccttcttccagggtcattttattcctctgtagagatgattttgctttctgctttcctaagataatctagtgtggcttcattccattattttcttctctcttccctttacaacattactatctcaggatttttttgagctattgtttcttgtctcattcactcacctttttttttcagacactgcatcctctggtttccaaagctagccctttcccttgagcctgtacatcctcctgacctcatcacctctctcctgttatgaacttagcttctttttcttacagacatgcctgcgtttcctcgaccttcaaaacaaaacccggataaaattcttcaaactttttccttttctgttcccctcagaatctagggaaattccatgtatgatcagttttcttctaaggaaatgaggaaggctgatgtgagcaccctagatttttggtcacctttccttccacctatgttttctcatcactgtggcatgactgccttctctactgcttgtaaaactgtattctgaagaaccttagaggatatttagtaagtaacataataaaatagtgccctcatcctaaacctttgttcatgtcttccttcctaaaactgatcatttcactttaaaaaaaaaacaaacaaacacatttccttttttaaaaaatttaatttcattttattttaagttctgggatacaaaaaaaaatttttttttctttactctctttttgtttcattgttacttagggactcttgttaactgtttttggtggtatacttttttcatgtctatatacttttcttcagaaactgaatgtaataattgtttaaattattagcttggtcctttttatgtcaaaaatattgaaaaattattggctatgtttttaagttcagaaaagcataagatgatcctttggagttttatatcatgcattgcactttgttc

SEQ ID NO: 129976 - DNA, 1009 bp, Homo sapiens
tttcagagttgagaaactctgtggaacaggcttcgtgttgagatatagtgttgtctcctcagagtcactgttctggcttattcggatgtgctgacatttgtccgattgcaaagacgctgggttctccggagtttggcacgaaaacaagacagcagcactctggggattcttttcagccctttagcttccttcagcctgccttgctttgggacatgagtggtgggtataagtcagtaggggaagtgtcttctgggtgccaattttacccagtcctgaggcctggctgtcagcctgctgccctggggatcctgcagacgcctcggtgctgaggacatatggaatagtgggctgtcctgcattttcatcttgtccttgattctttctttattctagaaattacctccctgtcttatagagctgtatccagacatgaaagagggactattttctgtttgaattatttttatttagttagatagaacagattgtctaccttgatgtttgtgactttggataattatcaaaaaattagatctagcacagccagttattcttaatttggtcacttgacagttaactttttgggaattgatgctccatgaccctttctaaataatccgctgggctagctccttaagtctataaaacatacaagaaattttctgtgatttggctgtggaatctttgatcacaatgcatatttggaatgcttaaagaaactcagtgacccagactttattttcataagttaaatgatggaaccagtattcagaattcactgcctttgttatttgttgagatgaccctgtaatacttaggagttagatattaagtagtttgtggactccttgaaactaggaaccagatcttcggttttatttgaattctccttcaatgctaagccttgcatgtgatattcattaatatcatatgaataatgtcatatgctggtgtgggtcctgaaggatgaggagttactccttgcataataaaatactgagtttttttt

SEQ ID NO: 129977 - DNA, 1109 bp, Homo sapiens
ttttgaaggagtgatgttccgtggttttaaatctcttccagcttctctaggattttgcttagtgttagtttgtcagagagctaaaaatttgaaaatgcttgcacttcctcacgttttatttaactataatttctacttttcaaatatttcttgtcttctatatctaatcaaattactttcaataagtgtatcattcatccatttattctgaggggactatgacaaatttaaattgttatgaattactcttgtaggctgtcataataacagcctgaaagtagcagcctcaagtcagcatgggacatccattccctctgcccaccatttacctgtgtcagcaaatactgtccaatttgctaatcttattaaaaagcaaacattctgtagctacttttggatgtggatatacacactggacaataatctcttaaagtttaaatgactattaaagtgactattaaagctcttgtttgtcttgcctgcactaatgggcaaatatgttttattctgttaatgcagaagatagtctgttaaagcttctgtttccaaatattcaaggacttcagttaagctgtcacttagtagcatgttctgcaacaaatgagtatcattcagtaatgttccttctgaaaatttattcaatctttgtatttattgtgtcttctgctttcatacttgggtactatgaaatatcaaagtttattaggtttaaattctaaaggaatcttcagccccactcaatgaaattcacccagcctaatttccgggatatactttttaaaggaatcttatttgttaacgtgttgttactactaacactagaagatattcgattaattgataagaagtaaatgattaaattttgtgttaaaaatatttgaaattactaatttttcatcaggctttatttgccctactaatgcatattttatgtacagaaattaattatgctttatttttgtaagtgaaaaacaagaatgtgggataaaaatttgctacttattttgtaccacctctcattagttcctctgaaagcctctgatgaaggtgacacccaggtagctgacgaacccctgacttctgtgacttccgtcaacttgtgcctaagg

SEQ ID NO: 129978 - DNA, 1462 bp, Homo sapiens
taatagtgttaaaatttaagtgttaaaattatctgagttacataatttgagtgtatttttgcccacctatggatgctataaatggtaatactgctaattatattaactccagaatttcctaagtcagctccaggtcttaagtggggtggtggtggggggaggggagaagtttgaggaaataaacctttctagtttgaatgaacaaatgaacgaatgtgtgtataatcaactctcgataaaatctggttggtaaatgagcaaatctggaggttgtcagagtatatatctttttttccctgatactgcttttactcactcttccttttactgtcaactgatttttccattactgtccattgatttttgatgataaaattttgtctttcaactcaacactctaatgagagaaaggtaaacctgggtaggggctggtaggagtggtgaggcttggtcaaattgtggctttcttttgacatttgattgagagttgattgtaaggtgtgcattttaatggacttctttattttccaaataccgtttctgtaaacctctctgaccttgatgcacctcgcttttgagatcacccttcctccacttcttttttccacctaactgctctccttattttctctctctcttcctttattcttatgtaggcctgaccaaagatggcagtaatgaaaatattgattctcttgaggaagtccttaatattttagcagaggaaagttcagattggttttatggtttcctctcatttctctatgatataatgactccttttgaaatgctagaagaagaagaagaagaaagcgaaaccgcagatggtgttgatggtacgtcacagaatgaaggggttcagggaaagacttgtgtcatattggatttacataaccagtaaccttgattcagggactgaagtcattggctaatgaacacctgaagcagcctcctttttcttttctttccttggcttatgcagggcttaatgtgcagtggggtggttgtgatcttaccgtgcaagtcaaccatgtgatcttgcccagtacagctactagctagtcccttgctcgctcagctcccccaacttctattgaagaaaatggtactcctcattcttgtagtcagctacaaagtacactgaaaatgatgttcttggtggtataattggtttctgtatcgttttgtttcaactcatgtattcactgaactaaatttggacacttaacagcaaattgtgttgtggttaacccttgatgcttgtctttctaacacactattaattatgatgattctaatggatttcattataaaaatatttctggcatgatttttaagttaaatgcttctctgttctttaacatgactgatgtataaaatgatggttctttactaagctgatattttttattgtaatttgtttaggtttgtcagataggttcatacaaatttctatgtaaaa

SEQ ID NO: 129979 - DNA, 1140 bp, Homo sapiens
ttattgaaaactaccttgtttgaaaatacattctttaaaaacttattttccaaataaaatcaacaggaaaatgacccaagaactaaatgatgcgaggactaaatccttagagtgacaccacctaaggatcatgtggttgtccttttgtcctatggctagcacctagctggcatcgtatcaggtatgggtggaaagcaaaagggaagccagtcagcacttgctacatcctggaaaatcatttgtagactgatagatgcatgagtgagctgatgggaggagaagaccagatcttgccaagccaaaggcattccctttggttgagccctgttcttagaggttcagaaggaatcacatgccgagagtatatatttttctctctggactagtacttttgtcttgagaaccacaggaaggttgcttggctgggtaaacagttttgttcaaatgcttttgcatattcgttgcatatggtcatctgtcatactgaaggatggaaaagttttatatgtaatacttggaagtacttataatatattggcaaatggagaaaagtaaagatgtttatactaaatatgcagctatagtgttttaaggcaggaagaagaaactgttattcccatagggacttagttgggattatagatctttgttcacagcatttgtctgctgctaaattcagtgaaaacattctaggcttgtcaaaaagtaatttaaataccaactgcaatttgcgtttttcctaccaaaaacatgaacaatgacataatatagttcttttgagtaaagcagagaaaattcactataatctttaaaacttttaaattagttgtcgtcttatcctttatctgcctatcttgattgctggtagttatactacatggagacattgtgtgttgccaaagccttaaatgactgaattacgtggttccaaccagaaaagctcagtggtcatggatgttcacatttcttacagtcagaacaccccaccctgttattcctcctcaaaattaagggcttggtatacagcttggtagattctgatacctactagagctaagaaacctttgctacccagagccagttcttcacaggaaaaaaacaaatgatgaaaacaatatatactttgatttatttctatcc

SEQ ID NO: 129980 - DNA, 1043 bp, Homo sapiens
taataaataacaatgtggtattcccttatttgttttaaagtgctgtcttgctggaaagaatggtgttaatttcaatatgcaaattttatataatctggcctggtgagacttcctttgcttttgtatgtagcataatatatgttaaaactttttatataagagtctttagaaaaataatggatatggcatgatattatacactaagcttataaaataatgacccaaacaaattcttcttagttaacattgttttgtgtatatttattagatatgaaaacatggtaggatgccacatctgtaactagtgaaactgcttttagtagattaattccacctccttatgaaataaagttccaaatatgaaaatagagttttagttgtgattaaaggtaataaaccttcctaatgttgacctgtgttggtgttttttgttttttttttttttttattattgcccattgggaattagtgtttgtgcattgaaacttattatgaaatttcttttcttgtcttaactttaatgaaattttcaatgtagtcctgtcattgtgtatctatatttgagtttctctaaatatattaaatcctcagatgactataatcttaggcatgtaaaagaaacaaaattatgtagaacttatcagaatgatgttaatttgcttgcctataaatggtttattacttcattatattactttaaatgacacattctgaatagcaaagctttttattttaaagataaaataaaatgtgggccaagttccctcatttttagaaataatattactctcatctactgcattttattgatttttatttgtttgtttgtttttgcttaaaaccagctatgtggtctgtcaggaaatgccattagaaattaaaatgtggtatttctttgataaaacacactgatttctatagcaaactattaccttaacttgatttttagtgtatttgagatttcaaaaggtcatcccctttaagttttttaacctaccattaagaagctaattaattgtaactttgaatattgctgtttgcag

SEQ ID NO: 129981 - DNA, 1293 bp, Homo sapiens
gggggagatattttcttctgtgtgttaacagagtttttaagattctgcagaaatgaaatgggacggagaaaaggatttggctacatttttatgtgatttcattaagttgtttatgtgctctgcctttggaaagaggtaatattcaggtcattttgatgagtaacttggatggaatatacatattatactaaatctttaaaaaaattcaggagtttatttcctgcactacttcaaagttagtgttgcatctaaacaatcttttctgttttcagaaatattttgtgtgacgtgttttgagaatttaactggaaactgtttttgaaatgatctatcattgtacataatcccaaattattggagaaataattgtgagaataagtgttcagtaaaatgttttcttcttatgatatcttacatttatttctaaacagagacaaagcatggaggacacaagaatgggaggaaaggcggactctcaggaacttcattcttcacgtggtttatggtgattgcattgctgggcgtctggacatctgtagctgtcgtttggtttgatcttgttgactatgaggaagttctaggtaagaattttgatatccttatgtgaatttgtaagagagtaagtgacatctcttaggagtcttgaatatttgttatcatctttctggtactggtaatttctatagcctttcagtggttctcaatagagtgaggctgaaaggggatatgaagaaggttaccttggagtattgtcttttgaactctttaaatgtgacctgtaggtttttgaaaaaaggctttatattgtatgtctgtcacacagggagaagttttatcaaacagtactcattctcactatatgcagtactttttgatttctattcaattttgttatattataaattttaaaaatacttgatcatgagccattacatttatttaaggacttgctaatggatcataaccacacaatatgcaaaactcttccttagagagggttttcaaagtacacccttctgtgtctctgttgggatgggatgagtacgtgtgcacacatataggtactggatgggtgtgctgagataggcgtttgtagatattattgtgtgtgtgtaggtgtgatctgtgtgctgttctgaggaagttgctgtggtccttctgatagtgtcctttctccacctttttccttttctgtaatcactgaagtttttcatgattttttacattaatgattctttgttatttttggagtcacattctccttcacttccccaaaaatctttttttaaactg

SEQ ID NO: 129982 - DNA, 1829 bp, Homo sapiens
attactagtagtattcaaagcttttaaatttttaatttgcttgtgaagctttaaatttgagtgaaaaatttagtcttataaacaacttagaaaggttgctgcctgctctagatactatttgtgctaaattaatttagtatactaatcagaactctaatgaattctgtgaactgctaatgttagatcagtgaataaatggctgattttatttcccagaagagaatgtttggagatgaggttggggagaagttgaaaaaaaaaatcagaatgtggttgtgtaatcttttcctagttccctttcaagatgatctttcccaggtcattattcttactcctgaagatttttctttccctctcctcacctcccagccttccttctatttctttccttcccaccagtcctctgtccctccttttctagtgaaacattttatgttggtgctttatttttgctgttggaggaattattcctgggatggtgtctgtgagtaagaattctagagcattgattaatttcttactatgtatggttttgtttcattcaagcaatctaatggtctttccttgtagccattttattagattctgaagggccaaatcaaactgtttctgggcttggggccatattttatagcaagacttgtttgagttttcaatgaattggtgcttaagctaaagccgttaaagcctgcttccaagaaaacaaaactggcagcacagtttgttccatttcattttttttcagcatgcttgattttttaggggttggagttagctaggaccaactgggaaaagaatcccgtaagtgggagaaaggctgtggtgttgttagggagtgcacttcagcctaagtggtgattagcagcatttagcctctaaaaataactggtgagcagagtttgtagtcaggtccaatttcagttctagaggcccttacagtgcagggattggccagtctcaagctctggtaggcaagtgcatgcagtgtgcctaaaacctgccagcagtacttttgagtttttttttttgttttgttttactttagcatttattattcatggattgaagaaatcaaaatggctgaagataaaggtatatttttgttatttaggctaaaagtggctttagatctagctgacagcttttcactttattttcagtggtgctctgttaaaatatttttggctaagtgctttgactgtactgtctacattttctattttgaactcctggagatactgacttttcatagtagctgaatatttcattgaataatctgtctttaatccgaatatgttttagtgtcttaatttagatgaccttttagtatgttgtactactggaggctgcattttacaaatttcaaaaaatgtacaagctctcttcttattcttataagttaattacaatgaatttaaagaattatctatatttagattttatataaaattataggagatataaattcagtctcatattaatgaacagacttacctggttcaagcaaggacttaccatttatggaaagtgacctacttttatgtgaagcagacaataaatgcaaagaaaaaacacaagggttttattttgattttaaattgactctttaactttgaagtattctttaactatgtattgaatttaatgttttgtatatatttgcttttgctttactttgtaaattaagatagtctttccattaattgaaagactgcattcactcattatgttgaagatttataaaagaaaagaatagatgtatgaaaactgcttctaactctcagctgtctaatcagcaactgaaaggattctttgattaggatagagaa

SEQ ID NO: 129983 - DNA, 1003 bp, Homo sapiens
cttttgaggtaactccagccactgttttaatatcatgaaaatatgcagcttagtttgtggcttggatacttccatatcacctctaaatggcttgacttcattctgtaccaaggtacaaaaatgtttttcaaatgaacttctctttaataaaccctgtatgtacatataacctatgtacaccccacctaaacctccggggaaaagcctcagccatctatcgggaaatgtggaggtgcaagggctgcttgcttcattatctgctgccagtgtctgctctgcactgcacatgtgggtgtgatgagtttctctggttcggtcctgcagctctggccatttttattagaggactaaggattcaggatgttcttttcttccctgtgtaccactgtgggagtatagtctggaggccagtgctttaacttttttttaattatactttcttctggtactgctgggagccaagatggtattttcttgttagtcattatttttaaaattttagtattttattcccctgatgtgagggatgcttcaggcttttgtcctgcatttgatctttgtttttcagggatgtgtcttggttacctttggctgatgtggttatcttttaacggcaaatcactgaatgtaattcagttcctatcaaattggccacagctgaggacaaatttggtttagataacctattagactcaaaggaaatgttgagctcccttggtgaataactctttttaaaaagaaaatcatcttttgaaggatctgggctattcggccccctgtgagattcaggtcacttgcctagtcatgtgactgtcatcatctgccgtagatactatgtgtgctccagagcggagagcattggtgaattgacttggttgaggggtggggggctggggggtgggagtggttgctgtccagttatagtcaggtttccaagggcagccactatctctgtacttggagaaatgccagcacttctctcctacatgtgtgcccacacgtt

SEQ ID NO: 129984 - DNA, 1010 bp, Homo sapiens
gcaggttttaattattatttaatccgtctgtatatactcaaaactattgatagataagcacttaaaaactcttagctactttttaactctctcaaggtgtctcagtagattgagcagcctttttgtttaggcttaattagaatgaaatatattcctgtactgcctgtaaaacattaacagcttcatttgatgagtatttgtcatttagaaacacacttctgagtttagtttagcttcctttttctttctactttgagtgtctcttagattactaagtaactgagggattcaatacactgctgattgcattgtggagcccttgaatgaagaggccctagcaaaattttctttctttagccaaagaccatcagagccaattgcttaatcctccattactcattctaagatgaaaacataggaggaccataattcttccactgcaagaaccgtcagctattttgtgttcagttcaacagcattttgtccatcctgaccaaatcatatgaaaccaagcactaaataatgttctgagggagtttatgaacacattttccagagaccagttaacctctggtggtctgtggaagtgaaagttctatattttggactatattttagtcttgctttaaaataatctgtctcatagagattattagaaaatgaatgtatgacattttcattttcagccagttatcaacagaggaacttggataaaggctcatagggtctatccatcttgttgttagttaatatcagatacttagcccctgagctctctggttccaatagaaaaacccttttctccagaaagctagtgcagtttgggagaaggaatatgatgacctggatcatatctgtgtaagaatcagaaccaagaatcgctaaaaatctctgttcccagcctccttaaatgtaaagaattattatctactttcttttcagagttttgatatcactaatgctgatttcatatggctttgtgtttctcagttgtttccgttaaagtacgt

SEQ ID NO: 129985 - DNA, 1034 bp, Homo sapiens
attatgtaaacattttcacctcggactctttgagtttgttattcctcagcccagggtgtgctttctcgcagagggccaccagactctttactcgtcaccctcttagtttagcccttcagccctgcagtgcctctccagctgcagaagttttggtgagaactgtatgtgttggtatgaaatggttagccattaaaacactgggcagctgcaggtgagagcttatgtttgacagtaacaaggaagaagacatataaagtcaatgtcttgttaacagaagggtaacaagtagtacttttttacaagtagtactcgaccgaaaaggattattttcttaaaaataggtagagatagcccatttatcatttatcccatcatacaaatgcaggcagccgtgaatagctgaagtaagaaatcaaaaagcaagcataggaagaaaatgaacattgtatggatctgtgcagtaatcacttagggaatatggtagcttgacgtagataaagaactacatttaaggaatacctacttaaaatgtgaaacctaaccaatgttaaacagataggctgccaactctctgcaattatgatagcttcacaaaatcgatgtgacttcaaatcagaacagcataagacagagaagatcatctatgaatgacataaaactaggaggggagacagcagaaaaaaaaagatgtgttccattagctaagtttgactgggtctttttgttgttttctatttccaagttaggagaggttggatctaatgccagaattatggtcaatcttatttgtagttggttggacatgtgtgcatgaacaataagaacttggtaaatttcacataagttgttgtacactgtcagtttatatttcatctaatccttaaaaaaaggaagttaagtcttgagttaaaaggatcatttcaagtattaaagatctccaagtggactcattaggctcaaattcaggtctgctcaaattcaaggttagactcaaattagactcaaattcaaggttctgcttactgagaaagagc

SEQ ID NO: 129986 - DNA, 1051 bp, Homo sapiens
ccgagccctggagccgcgagcggcggccgcggggccgaggagcctgggccgggccgggcggggactactccggagtcaggaggcagcagcggcggaggacgaggatctctggcagtcagcgccgctcggacgccgccggcaccatgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgcaggagggcgcggtctcacccccggtcccatgcgctggggttcgccgcgctcccgccgggcgtcgccacgcggtccaggggccaggagccggcggagtgagggattttcccgccccttgatccgatacctggtttagcaccctccgcgttcgtgctgaagttacacggggacttgcgggctctttcttcttaggatgatttccaggaatgttgcttaattacactgtgtgggaatgcccaggttctgaggagacagaagctgcctcaactctgttagtgaagagtgaggtggttctaaccttaagcaggttgaaaagtgatggttaaggagtctgggacctccaggaaggagatcaggctgtgtgcttcagcccctgcccttccagttccgctttggattttgttgaaatgttgcatgttcaggcggcgacagactgacagctgtcatcaaggagagaacagagtgaaccggctccattggcgcggtgccttgcagagggagtgtgtgtaatgggaagttagaaactagagtggggaaaaaaggccctttcagagcagagcaaatgctcctcttaatccctttggatcctggactggctctgtggtctattccatggtcacttgaggtcaaggccacagaccttttgagtcag

SEQ ID NO: 129987 - DNA, 1013 bp, Homo sapiens
tggctgactagagaaacttgggcaccttccttattactccttccccacttggttctcaagcttccttagtggttcccaagtcttggtacctgctaactggtgattctaccctatgttattggtctgggcctatggatataataagatgcagttggagtttacttggcactgaagttagctacagctactgcttatgctctatgtcaagctcttactactgagaaagatacaagcacagaggcttctattccaatttttatgatacagcatcctcaccctgcaggaccctagctgcagcttgatctgtccagctgtccattgtgatggtaaaattacaacatcacggtgcatgtgccactgctcctgggactgtagcctggctgcgtcacaccatgaatctttctcactagccacatgttttgtgaatgtgacactctcatgaagactcttggaggtcacctagagcaatgttttatgatctgaccttttccacccatatggctgagaaaggagccatgtgatatttccaacatggccactttcttgacctaagaaaagagtgatatcagaagcatacagctcatggcagcacatcatggatgaaacaggtacataaaaggtgccattacagaaaaggagtttggcattaattttaagtcagtgtataagtgatgtattcttaactgtctactgcccaaatcattatttaaaactgctacctcgggcttgagagtacacgtatccttctttctactacttctttgcttttctcttcatcgtaaagccatgaaagtgactattctataattaatctcttctacaaactgccaggcataatcaaattctgtaaacacttttgtctaaacaagatgtgttgtgatgcttatggaagaatatttgggaaattatttctttgaagatctgtagaatagagtagattggggaaacttttgtccaaaaaggtagatacagccattattggaggcaaagaaataaactgagcagctttcagt

SEQ ID NO: 129988 - DNA, 1093 bp, Homo sapiens
tgctcccggcctataatttcttatatttaacatcacaacccactctgatcttcaagaagatatattagaaatttctgagtaatcaaaataaagacaatcataactaaaacaggacagtaacagttcactctgctaacagtgaacacgctacagtttattgctgcaagacaccatgtccaaatactacctatgtgaataatctccctattgaggcttgtaacgtgtttgttttgtcaccattctcacttggaaacttttaaattactaccatgtactttcagtcatgccataccattgatactagagattcaacagcttacatgaaatctgcctatgcaatggaagttcttgcagaactgccaaagctctagttttcatgttacttgcttattttgtggtttagatttgcttttatttttattttatttatttttacaaaagtttattcttaaatgtgcggcaggctctaagatgacacttcattctaactataggtggcaaaggatgttacagcaggaaattcagatgtttaaatagggatggaattcagggtcaccatggcctccggcacaagaaacagcttgctttttaccagatttcttaattccacctttgcccaggggccccttccctgcagcctctgcttttagtttcttgagtttcttctgttcctctttctgcttctgcttgaaaatgttatctcctcgttcatctcctcagcctgcttcttgggctgtttggggggcttcttgccagcttcgtggccagacatggtgcctgcacccctctcccaccagttttacccttaagttagtgtccatgtttgtatgtggaaaatgatgtataaggatggaattccatctcaatttgtctccatctgcacaaacatagatggtggcatagtcttgacatccaactccacaactattaatgttcccctgatttttataagttctgtgtttcccacatccaaactctttctgctccctttgctctcctcctgcttgcctttcttcctggctttgccacagtagcacaagacagctgatccacaggtttctggcagatgccgtagcgccgactccagggcaat

SEQ ID NO: 129989 - DNA, 1019 bp, Homo sapiens
agaggggagatttgttttttttaaatcaaaatgaggaaaggcacatctgaagaagagacaaatatgtacatttttctgaaggtaactattacacatattcactttttttttgaattgtggaattgttcatgagtatgtaaacatagagagagtaatatgaaccctgggtgtctatctatcagctttgacaattgtcaacagctctgtttcccttcttgttttatgtctgcttttaaacttctaaaaaatattttaaaaatttataccacaaagtcatcagtcattccatagactgagagagagacacagtttaggcagtttaggcagggtgtaaaaggataccagaagtgctgccatacttcattctcatatgaataagtcattatgggaggacaggaaagcatgctacaagacgggagaaagagacccactgcggaagaaacttgtatcaccaataaaatgtgcatctgacttttggacagggatagattcctcagctcagcttctactttgctatgagtatctcgaaaagcaaatcgtcctacagattgtaaaaggttgctaatcagtgaaatacgttacagggaattttcacattgattatgaatggaaattattttgtgtctgagagaatatgtacaattttaccttgtctgataaggtgaattataaaatgttttacataagaaataaaccaatttcattataagtaacattttaaaccattcttagtacttactaatttgtgttcttcttacaggatataagtatccagtatatggtgtccagtggcatccagagaaagcaccttatgagtggaagaatttggatggcatttcccatgcacctaatgctgtgaaaaccgcattttatttagcagagttttttgttaatgaaggtaatatgagggtacataattttgttattctggggtagttttgaagaaaattgcccttatctgaacttttgcctacccttttgctctataaatgttttgtaagttctataggtttaacttt

SEQ ID NO: 129990 - DNA, 1049 bp, Homo sapiens
attgaaatggtaatcaagagcctctcaacacagaaaagcccaagaccagctggcttcactggtgaattctaccaaacatctaaagcagaattgataccagtccttctcaaactcatccaaaaaattgaagacagtacaattccaagaatgaaccccagtgtaaactaggtcttgggcaattatgatgtgtcagtgtatttttatcaactgttacagtgtaccacccaagatgttaatggaggaagctatacatgttttggggcaggggttataaaggaaatacttaaccttctcttaattttgctgtgaacctgaaattactctaaaaaataaagtctttaaaaaaataaaacaaaatgcctaaaggcaggtagaccagtttagaggtagttgcagtagtctaggtgtgaagtgttgagggcttggcttacactggtggtgtgggaatgataggtaagtgttgtttaaaaaaatcaccagtacatgatgactaataaaagggcacagggaggaagaaatatataaggatgatggaagttttgaaatcatgggagttttgaaagtggatgactttgcagaatattggtatttatgagagatgctgagaacacgactgtcagcatacaggtttatttccaaattgggttctcagagttcacttaaggtatattggaatcatgtgatcttgtagaaacagtgtaatacatatggggtgagttcatagactagcctgtgaaggattacctgatgcaaaataagactggatcatgatgatgttaggttcatttctgaattttggatgctgggagtcaacttctgtggtttagaagtgaaaaggaagagatgggagacctgggaagcattctgaaatagatgcagaaatttgtctttggtttccttctgccttctttctgccccttctgtctcaggcgcttggtgctctcaggttgtcataaatgcccaatgtgggactagtggaaaagagaatgtcctgcttcctcagaggtagcatacaggagcccatggactgctgcttttggtttaaaaac

SEQ ID NO: 129991 - DNA, 1081 bp, Homo sapiens
gcgcctgtagtcccagctacttgggaggctgaggcaggagaatggcgtgaacccgggaggcggagcttgcagtgagccgagatcccgccactgcactccagcctgggtgacagagcgagactccgtctcaaaaaaaaaaaaaaaaaaaaaaaaaaaaactggaccctgcctgttttctaaaaaacactttaaagtattttaaaataaaagcatactatttaaaattgtataattaaaaataataaaagaacaaaatcacttaaaaagaataaacagtgtcaataacaaaaaacctctggcttacccaacttttgtttctagaagatttatatcaatcaccagttccacttcatttatttttgtttatttcaaacactttcttatgactctgtggaggagtgattagtttagtacccaaataaaggataacattttaaaatgtcctttaaattagatttttttggtgataggttccatagtaaatagaattaagataagtcagttaatctaggcatattttatgatggaactttgaagtgtttataaatgaaacaattcactgaagaacattaaaagaaaattgaaatgaatggtcaaattaataaagtgtcaaagcaaataattgtctaattgtctatattactttagtgattatgccagaagtgccttttaaaaggttaactgtattatgtgctcattgtgttactcaactgcacgtaatttatttgttttaatattgtttgaaagaaaataaacatctttcacataaaccatagtgtacaagttattttttaattttaaaatgtaaatatgaggcattctttttcaaaaactgcttttccttacagaaaaaaaaatcttagcacatctatttgtccatcactccagtgtcagttttttcttcataagtttaatgacaggctggtattccagctgcttagttcaacaccgtatttctctaatgtctttcgctgtacataaaggggaccacaaactaattactaagccatggatagtcaagaagttaaaagttttaagcaaaaaatgccatagtttgccacttaatcagataattttattt

SEQ ID NO: 129992 - DNA, 1036 bp, Homo sapiens
caatcctcctgcctcagcccaccaagtatctgggactacagtcctgcaccaccacgcccagctaatttttgtattttttttgtaccagccatgttgcccaggctggtgttgaactcctgagctcaagtaatccacctgccttggcctctcaaagtgttgggattacaggcatgagccactgcacccggctgtctcttaactttatactaactaacagtatccatcgactgtaccatataaattgtttctcatagatttaattgtgtgctcagatatatgcttctacttaatatgaattagtaccagctagtacatttttatcgtgtatagaatagtcccaaggtattagtttggtaagaatcacttgcacataagggaatagaatttataaaataactttatttaatctttaaaaatttacttatgaaagaggaaaataactttttataaattttatgcagttataagaatgcaaatccaagaaacagtaaggttattagatccacagtaatacaacctaaacataagtaaaattattagattcataaccagaggaataaaggatgtggtatctatttatacactccattttagaagttattagaataccttgttttatgaggttgattttccactggaaatgcatctaatgcggtttccttctaaagtgttttggctatttcagattcacatgcatgggaacaactacaaacaaagcttgcttcagcatttcccagacattcttcctctggaatatggtggtgaagaattctccatggaggacatttgtcaggaatggacaaattttataatgaagtctgaagattatctcagcagcatttctgagagcattcaatgagaagttatgtcatgtgaatggcttcctaactaaaaatacatgagtgatatccaacctggttaaatgaatgaaagaaaaggagcaaatcttttaaactaatgcttgcctgaactttaaaaatgtagaaatcttctgacatgagcaacacaggtgtttggaaagattttttacttttta

SEQ ID NO: 129993 - DNA, 5066 bp, Homo sapiens
ccacggctttgggcagccgccgaaggctcctgctaggcccggctggctcaccgggaagttccctgcctccgtcccgtcagcctccaggagggcgccgccggccgccgtgacttcagcaaggcactactatctccgtcagccgccgcctcggccatcttcctgcccggagtgcaacaaaatccggctctggccagccttccagctgacgccactctgccagggccctgcagcctcggagcgggatagaaggaagccgcagaaaagacgctgaaagttggcgctcgctgacgccccgacgcgctccctccatgacgcatgcgcccaccggccgtgagcgcgggtccggtctccggtgacgtggcggtgaggaggcggagccaagatcagcggcgggagggtgggggaggaagagcgaggtgagcgcggacgtcagagtggagagcggaaggtcagggaggctcggagcggaagtgagactagggagtctgtccgccattgtggacccgagaagcagagagcgagagggggaagaggagcgtgcaagcggaaaagacgggcctcttcctccgactcccgagcgcgaggccctcattttgggttctcagcgaacggcggcagcggcggcggctggaacaatcactcggccaagggcgacagccaactgctgtgagtgcacggggagaggcccaggcagcggcggcggcggcggctctcgggttgcggtgaagaatgtcagccactagcgtggatcaggtgagggagcagaggccccaggcttggcgaaggcccgagccccggagctccaccctcgcgcggggcttcggctcctccccgtcgccgccgctgccggccccataacggtgccccgggcgcaagttgctgcggtgtagctacccgggccggggcgtgcgccctggccccgtagcttgcgggcgggcgggcgcggtgccgcggcgggtgggggcaaggaccggtcttaggggccttaggacagatcctgagggcggcagacatggggcggagaccgggcgagctctgggagacggattccgagtggcgggtgggaggtttaaaggctgggggtggttgggaaattggtggctgtggaggatatggtgggtttttactcctacgcggatagtctaaaataacttgtctttgataatgcctttgattaacacactttttcttttcttcctttttctcctctttaccgcatctttcgtcttgcaacacagagacctaaagggcaaggaaataaaggtgagtttggatttttttttttcttattgctcaatgttgccttaatgttacttttaaactctgtgagggtattttgtttgtttttgctccctcttgggaaaaaatgtaggattagggaaaatattcatcatggctaaggtagccaagttctatccagaacttcggtagttcgttgctttgaagccactttatagaaaccaaagtagtacgagaaacagtttccttgtcagttaagcaggtattggtgtgaacctggtggtatttctttggttttccagtttttctgtgttatgtaacttatgccacaaaaaatttctacatgtgtatatagacaagtatattcttaaagtggacattttgtttgacatgtctggattacactggaaaatggaagtctacatagtattccatcacattaatgaaaattgtactgttaatcactgattctattgaagtcagttgtaatgaggcaacaacatgagagaggttagaactgagtaggcatgccatcttgctctattgttctgattgcaaggtgtgactctatctggtattttataaagggctgagaagaaaatagtttgtgacattttttccaggattttataattttctctttagtaaaagtaccattgaaagtaaagtgtttttttaaaaagtgtgttttgtattaatatggaacagtgcagtcagctgactgaaacattatgacattagtcatgtgacatttagttaagtatagaacaataactgctttcttgggatagtgccaattaaataacatcagagcaaattatatataacattttgtagtgcttgaaattacactaaaattatgctttctgttgatttcagtaacacagtgttagaaattaagatctataatagccttttagatatagattgtctttggtgccctttaaattcttgttagggtatttatttgctattgcaaatttggtgaatttaataggttttggatatgtagattagtttcctctgaattatggaatttgtacataccagttacatggcaccatattaggtaacattttgtttgttttcattaaagatgttttcttgcagtatgtaaatatttagacattttaatttttaaaatttcatttctagaattttttttgttgtaagcataaacctgaaataaaaattggatattgatttattttaaatgagtttttaaaaatttgtgaattttaaaaagaatgatccattaatttcttcttttgctagtctacccattaggaactatgtagacttggagattgtgaaattgtggtcattattgcctagcataaattattttatcctagatctgtggggaggtggcactttgcaaagctatttgaaatgctaagtgttttatgttacccgctttaaggtaagtacacaagttctatgaggtacttgtttgttaaaacaaaatagagcctctacagcactgtaagtcagtaaaataagtttgatttatgagtggtcatttcacttaggtaggcactggtggcatctttgatattagatatgagttgagttatctataaactgcataatacatccactgtttgcaaataagtattttttggttatttcaaaaatttttatccatcagtatcgcttctgttagttgtattcagacacatacacaaagtgtttattttgatagttctttattctcaagaaattttctttctttcccccttgttgttcagtttaataatttcatctaaggttagaataatggattgggattccttggagtcctgagttctaatactgcctttggctactgacttgccaagtgagcttgaaaacattttacctgtctgtcagaatctcccctctataaaataaaaataactctagtcataattcccataattcctatagtatgttgttaggattcttgtaattacagtagttcactgctctagtagcaattatatttgctggatttcttttcactttcctcacttaatctatttttaaggtgcaggaagactcctttgcatggagccttggcaggaggggaaaaatgctactggcctgaaagtattgctaattatttaagtttcttaaaaatggcagatgctacaagtgcacaaataacaaatatacgttacttgtatttttatgactgcagggagaattacaaggcaaaggcaacactaccagtgaacctgatataagtagctatgtgtgtatttgagaaaagcttttctgccttagcttgttcccagctcgtaaaattgttttacaattctgtttactttcatgaagttatttttcttgaactgcaacctcagtattctaaatatgagtaatcttgaattctgaacttagcaagcttatgaaaaatagtatgtccttgagaagttggtgtcagttaaagttttgaacacgtaatccttttcagtcaacttactataatttcagagatcctgtttcttttctgaattgtctttagttgacagctttagcctaacacctagttttagtgtctttgattttctatatatccttaattacttaattcattacagaagccaaaaggaattctaaataattgtctttgatatggcaaaaatgttttttgtagaataagtaataattcaaggtttacttgttttataagtttgaattcttttttaattaagtctgtccctgtgttaaatatcagaactctttattatccttggcaagagtagtaccaaaggatagtagaaatttaaggataattatttgcctattggttcataatttaacacttcgtattttatttttttattaagtagaatttttgcttattggaataaaggtgtgcagtacttttatttgggagtactatggttggaagtgtcagatgccatacttacagtcttaggccttactgcctcctttctcctctaagtttataaatagcaaattcatggaacaggatttatctttttcctcctctccgctctcttccaacggagagacgtatgcattgttttatacaactgtaatttaaaataattaggttaaatttggctaagttttaattttcgaaaagtagtggaaaatgccttatattttggcaatattctgttgtattctctcctcgtcctcccgagaaatgatttcaaagcactttactatcattattttaggcttcattttatcaatcctcacaacatccttgtaaggagatagcgggtatatggtattgtcgctgtttttgtaggtggggaaacatgatgcacagatctgttgactttcctaacttgatgtagtcaggaccagagcaaagaatcacctggctcctaaggcccatgttctatcttgatttgactctgtttcatagagcagaggaaacaggcgaagaatcatgtaagtcatctgttctttttacccctgaagaaattttacagactatggaactagcttggatttcatttctatttaatggttttcagactccaagacattagcttgtcattaagtaaatattcaaaaacgaaagtctttaagatagttttctttaagatacacttccaaaacttaagggctagtttaatgcaaattgcttctcggtatatgtgaagtacttttaattaaacattttttaaagtagattgactttttgtactatattttaagactttatagacatttatgcatcatttaaaaatgaccgtagactgtatttataatagtatatgggttgttctcaggcctagcctcttagaagagaaataatagaacaaaaaaaataagaataacaggattatatttatatatatata

SEQ ID NO: 129994 - DNA, 2898 bp, Homo sapiens
gataaattttaagtaagtactttttcctttttttttttttaaatagaggcagagtctcactctgtaccccaggctggagtgcagtggcataatcatagctcagtgtaacctggaatgccttggctcaagtgatcctccttagactcctgagtaactaggactataggcacatgccaccactcctggctaatttctaaacatttttcgtaaaggtgggatcttgctgtgttgcccaggctggtcttgagctcctggcctggcactttttgtatttgtatgaactagattttcgagaacctagtggatatgagagatagttagtcataatttttaagttgttagctgtttcaaatactgactaacatgtatgagtgtaatagtgaagaattttttttcaagaagtaatagaccatgcatacttacctttgatttaggagcagtaaagccagtgtcagaggagaacaggtatgtcagaatctcttggactgaaatgaataacccagccttataatggcactagaagtaacctaaggcaccctctttattttggtttctagtggctattacatatttaaattccatggagcatatttagctcaatcctagttctgatgcagtccttatcagacatagttaaattatgttagtggagccaggatcaagttgaccttcaggttgcttcttgtggcctctgaggggcagtgtggtgtagtaagaagtctactttgaatgctttacacagtaacatcatatctttgatctttgccactcattggatggcaaagatttaagggattttgtatatctttgctcccaagccactgttaactcataatattacattttaggtgctctacactcatgggaaaatttaaggataataaaaatgttatattacagaggaatacgcaatttaaacccgtcaccctcctaacttcataaaatttggtgatgttgtacctttgagcagtaaatctttagatactgagttctttttgtttctaatttgtagacatccatcggaaactttcaactttatcttcactagtatagaatagtatatttacatagtgccacctcatcaagtattagcttagtaacacttctgtttaaatggttctaaagtcatattagtcctatttggatcttgtaatatttaatgtgattacatttaagattattgaacactgtcatttaataatcagatgagatgaggtaggtactattcatacataaccttctgaaacagcgaacagtcaaaggttagagagtttaaatccctaactggagatcatctcctcagtgctggacttgagattcaaattcgggaccttacttctgagtctgctcaaaagcactctgaaacagcatccagagaataacaactttagagtgtttatggagatgacctttgaacaaaattattctctgacttgtttctcatgtattgcaaggataattatggctatcttttgtgtcttaattttgtttgtagtttcatgtgaaagtcttcattctggggggcttagaattaaagccctctttatttagatatttcataattataagtctattcattgtgatattgtttcaagttaattttagcctaaactttactggagacatttaagacatttactataacaaattagatcgaaaatagttatttcattctttattatactaaataatttagagatttaaacaaaggtagagaacattcagaaatcttttttattgcctacaacgctacttgaaatagttattttacattcaaatatagcattagggaactctttccaacattcttatgtaacaatttactcactacagtgttgagattgggatatttacttaaagtttttggtaaggggaagtgtatatatggcttgtgtttatgtaatcttgggcttatgtatcaaaagacttttaagtttttgtggcacatgaatatttgtatctaaaatagtttatccttaagagggttcttaaaaataactcagtattattttttctgattactttttttggcttgaaaaatattaaaaacattaggttgtgctgcgagtttcataaagataactacaacacttctaatacaaacatttttttagtttcagtacaaaacggttcgattcatcaaaaagatgctgtaaatgatgatgattttgagccatacttaagtagccagacaaatcaggtaagtcttctgacagtttcagattttaggaaattaaccttttattagtattagttgatttttcaaatagattatttaatgagattaaccataacatggattcattcatctagtgtacctatatagtaagtgagtagtgagtagcagttgcagatttatggcacaggagagttcttcttcagaaagtataggcaccagaaactaggttatgaaatatagaataaagatttgaaggtgaccattatttgtatatattatggttaggttttttgtgtgtgtgtattgaaggaacttaatcttttaatgtcactgctatatcttcatagcttaagctaattataaaaggcttaattagctagaaatttgggtatttggaggagggattagttacctgaaattgcctgcaattttgggtcaaatgtagtgttttctttttttaagacattgcagattgaattcattgataactattgaaaattttaacataccttggtaatgtcggtgatagaattaaggagtttataaacatacttgctttataaacacagttacttctgtattgtagacatggacagttttatcaaatcaagtaattggtaactggtggctttgagtatttgtgtacaagcgtaattccaatttaaacattgaagaacaatgctattaggtatctgtatgccatttctgcatccatttct

SEQ ID NO: 129995 - DNA, 1060 bp, Homo sapiens
caggcacatgccaccacgcctggctactttttgtattttttagtagaggtagagtttcaccatgttggccaggctggtcttgaactcctgacctcaagtaatctgcctgcctcagcctcccaaagtgctgggattacaagcatgagccaccgtgcccagcctaaaattcagattttaattggcacgttaaagatgccagttagtttgtgtgtgtaaatttgaagagtaaattggaaaactgaatgaagtttgacttgtctgcttgcatatatggagaaaatgaaaaacgtactctaaaattttaacctagatttttgaaactctgaaagaacaaggaaccaaatcttactacagaactgaacagtttgtacagtagagttatagggaaaatttgaacaaaaagtagttcccaatttgtgggatgcaggattatttttaggattatggagagtggtggttgtgttcaacctcatctacctcttggttacttccccttaaccaccccttcctatctactgagcaacattcctagcatacatgggaggagaagaaataaatgggaaagaaaaaaactttacgatctcagcaaaattacttttccacgtaaagattatgaaagtagatcatttgttgtgaaatgtagtgcaagttttaaaataagcgtgattttactatattctggctcacatagtaatctcagttaacgcttatggcagtatggcagtattttccaactttgctgagaaatcttaatattaggaggtgtaataaatattccttcaaaaagatgtccatgtttagatagatttgagaaattttggaggctaaacagttgaactgttttttttgctacttgatttcatagtttataaattataattgaaaatgaagttcttaagatgaagatatagtataaaaaatcctgacttgttcaaactcttattttttttttttttttgaaacggagtctcgctctgttgcctaggctggagtgcagtggcataatcttggctcactgcaacctctgtcgcccaggttcaagaaattttcctgcctcagc

SEQ ID NO: 129996 - DNA, 1043 bp, Homo sapiens
gtcttaaaatcccaagtctgattgtgtcactgtaatgttaagtaattactatagcttctcaacagtggatgcatttattatatgaatgcccttaaagtggttccacttccttttctagctcatcttctgccaactttctccatctgattggcaaaatagaacttaccattattttatgaaagtataaatattttcttaatatttctttcacgatctcaatttttgtatgtatgttttatacagacgtgtacacacacctatggcatttcctacagaaagtcttttctgattttccagttacttactccctcttctttgtacttaagtgttttgttttgctttctttgtaattcatttagagtagctatcacattatagggtaaataagtcttcctcacgatacctgtgaagtgctcccagttggagaccacgttctttattttttgtctccagtaaccagcacagtatctggcacatatagcattcatgtttattaagtgaatggatggattaggttatctaatagaattagagaatgaagaattacggttggtgaaatactcaggttgaatattattatgacatttttcttatgacatgattagatatgcataaattatacttttagaaaattataataggagaaagtacatagcataatacaagcattaaaattagaatgaacatcacttttggttgttaaatcggaagtcatgtcaggagtttgaagcacttcaatttttgtgtgtgtggttttttttaaattttttttttaagagggttttattctgtagcccatgctggagtgcagtagtgtgatcatagttcactgcagcctcgaactcctgggcccaagcgatcctcccacctcacctcccaagtagctgagtctacaggcgtgcaccaccatgcctggctaatttttttttttttttttttttttttaatgagatagtctcttgtgcaggctggtcttgaactcctggactcaattgatccaccttttccagcctcctgagtagctgggattacaagcacaagcc

SEQ ID NO: 129997 - DNA, 2700 bp, Homo sapiens
aactatgataaggaatttgttttatgtctttttttgaaatgaacaaggcaaagcaaaacaaaaagaaatttgcatcatgctataaacgtaatcttgaatcttctcaagactgtgagcatttctccattttttccttaatgaaagtacaaaatctaatggttgaactggattccatcatatagataagctgtaattcctctattattcggcagagttgtctagtttatttaatccttgtgtgtaagtgattgcatacatcaattgattaaagtacagctggctgtaaatggtaattttgtgtccacaaagtttatatattagccttttgtagaaattatgatatttttaaattgtgacagagggcctggctcttcaaacaaaaataatactcattatacccccactctcatccctgaaaaaagccatataggttagtttgtaagaaatattttaagatgtgactactcatcagcaaatttttctgttgataaaactggatttgaaattttaattttgtttatctagaataggtacatcttttattttcatttacttaaaacttcttgattttaatctttcagatttctttttttgctcttttaagaggacatttcgctactgattgtgatattttgttttgcagagtaacagctatccaccaatgtcaatccatacatgcctagttactatgctccatccattggatttccatattctcttggggaagcagcgtggtccacagctggagaccagcctatgccatatctgacaacctatggacaaatgagtaatggagaacatcactatataccagatggtgtatttagtcaacctggggcattaggaaatacccctccatttcttggtcaacatggatttaacttttttcctggtaatgctgatttctctacatgggggacaagtggatctcagggacaatcaacacaaagttctgcttatagtagcagttatggctatccacctagttctcttgggagagctattactgatggacaggctggatttggcaatgatactttgagtaaggtgcctggcattagcagtattgagcaaggcatgactggactgaaaattggtggtgacctgacagctgcagtgacaaaaactgtaggtacagctttgagcagcagtggtatgactagcattgcaaccaatagtgtgcccccagttagcagtgcagcacctaaaccaacctcctgggctgccattgccagaaagcctgccaaacctcaaccgaaacttaaacccaagggcaatgtgggaattgggggttctgctgtaccaccacctcctataaaacacaacatgaatattggaacttgggatgaaaaagggtcagtggtaaaggctccaccaacccaaccagttctgcctcctcaaactataatccagcagcctcagccattaattcaaccaccaccattggtgcaaagccaactgcctcaacagcagcctcaaccaccacaaccacagcagcaacaaggacctcagccacaggcccagcctcaccaagtgcagcctcaacagcagcagctgcagaatcgctgggtagctcctcgtaacaggggagcaggcttcaaccagaacaatggagcgggcagtgaaaactttggtttaggtgttgtacctgtcagtgcttcaccttctagtgtagaagtgcatcccgtgctggaaaagctaaaggccataaacaactataatcccaaagactttgattggaatctgaagaatggacgtgtgtttataattaaaagctactctgaggatgacatacatcgttccattaaatactctatctggtgtagtactgagcatggtaataagcgtttggatgcagcttaccgttccctgaatgggaaaggcccactctatttactcttcagtgtgaatggcagtggacatttttgtggagtggctgaaatgaagtctgttgtggactataatgcgtatgctggtgtctggtctcaggataagtggaagggcaaatttgaagttaaatggatctttgtcaaagatgttcccaataaccaattacggcatattcgcttagaaaataatgacaacaaaccggttaccaattcaagggacactcaagaggtacccctagaaaaagctaagcaagtgcttaaaataattgctactttcaagcataccacctcaatctttgatgactttgcacattatgaaaagcgtcaagaagaggaggaagccatgcgtagggtaagaatatagtaattttttgtttggggtctttgtattgctggtggggtgcatggatgggtatattctgagtttaagaactttctgtgaaggaaaccaactacttaagaaacaactctacaaacacccttgaaggtatctatgtgtgtcctatatgaaccatttcttctttcctttcccagggtaactcacgctgagttagcctcttgctcattcttcatactccctagatgataaaggccattgggcctcagtgtttatcatcaaagctgaatgaattttggcatttgtaactaaacagacttcatgaactaaccaggggctctaatcattaatattattaatcatactaacataggagaaaatatatttagagtttgaaacaactttttttttgagatgacatcttgctgtgttgcccaggctggagtgcagtggctattcacaggtgcagttatg

SEQ ID NO: 129998 - DNA, 1897 bp, Homo sapiens
ttctcttgcctcagcctcccgagtagctgggattacaggcacacgccaccatgcctgccaaatttttgtatttttaatagagacgagtttcaccatgttggccaggctggtcttgaactgctgacctcgtgatccgtgcgcctcggcctcccaaagtgctgggattacaggcatgagccactgtgcctggcaaaatatgtttttaaaacataaaactcttgaagtatttttataatttttatacttaaagcacttgtacaaaatagaggctttgcagaatttgattcctaattctgttatataccctctgtaagattgagggagacattcctgaaataaaacatgctgtttatccttgtattatattggccagaatatttttatttttattttttaaaaatatcctattgagtggcccatatggggattagccccccaaatattggctagactttgatcacagggccacaagagtcagttcaactagggaaagttttctcttccaaactgtaacgtaaaattggggtcctatttttaggtggaaagagaaaatggatgggcttttctataggggatacatttaaatttcttttgaaacttagtaggggtaaagttagaagctcctccagtaaataatgcttgttactatggaaagcatgttcttatggaatgcttgttcctatgtagaaattaagataaagaggtaacttaactctatgtaaaatcagtgattgtttctgtgtgtgaagctgaatatcttgtctttgtggttgtgtgcagcacagggaagtgcttcaacattcctcagagggaaggtgttggaataatgaccctagagcagtagtttccaaaccttaagtcacataagtgttaattggggtgtttattgaaattgcagattctcgagacccatcccttggtatatttgataaaggaacttgcagtgtactttttaagtataaacattccaggtgattctggtgctagttattgattgctgtgttggattgttggaaactttgctttggagtaattaatacaaatgactttaaggctctgctgaaccttttagatgggttgctgaatataattgtgttttctcccacttaaatatgagaaatgagagaaatgggatcaaaagtagctactgagtctttcagtttagcagttaagtaaagtggtcatattgtaactgccattacaagtagcgcatcaggagaaatgatttgaggtatgaaaggtgggatgcaagttaagacttcatttttagattgtgctgattttaagatacctttgagaaatataggcagcaaaatctctgattaggcagttagatgtccgagtcacagatttggggaccttttgttcttaaacagttaatagcatggaagtgggatgagattacttaggacaaaggatacatggcaaggaaataccaacttttctttcgcccaccactgaggagataatcacccttctgtgtctttttttttttctaccaaacttgaaaatttaatcctggttttgttataatgtatttggtatgttaatattatgtagttgtttcaggaaatttttaatgacaggtatatattgtagctgtattattatatatattgtagccatatacacaacagtgatttaaactttaatattacccttatattgtttcattgttttgttaaataaagtttatcctaaagccgcctccttacatattttaagtccagcctaaaggtttttctgtacatggcgaactataacaagtggaggtataaacagaccgcagcctactcttgtgccagtgaccaaattttggctgaatcaaatgtagccaactgttcaaataaggcaaataccaacctgtaatcaatccagctgtttatctcacttccgt

SEQ ID NO: 129999 - DNA, 2922 bp, Homo sapiens
gaaaagttatctatcgtgtgctgaaagagagagtgtaagatactctctttgtgatttaaagttttttttattagtctgaaatcttcattgaatgcaattgtactgcaatttaatgtaacttttaacctttttctcctgcccctacctcagccaatagcttttagtctgtttgacacctcaagatgaaaaactctttgaaaggactgaaaagatgttattatattctcatcataaacaaacaatagggatgtggagaggatctatactctcctgaaataggtctttgtgtttgagagttctttatgtaaaatgttttgtggtaataatctcactatggtatatagaggtaattatcaattgtttttaattacttgaattagtacttgaactttatatggagatgatttacattatatgtgcatatagtttaaatctttaaataatgagagtttttcattgtaattctttttgtgtgtgtgtgttttttttttttcaggagagaaatagaaacaaacaataaccgtatgaagatgtcctgttaaatttacaacactaacgatgtagactctggaaatgcctaataagtcaaagaagacgtattaaagctcttttctgcttaaggtgacatctttgaacactttaacacaaagttgactcttctcgtaatggttttcatcagcgcatctgcccttatactcttcaccaaacacacttgagaactgtaacttcgtcaagcactttctgtcctgaagcttttaccagtatctgctgtcttttgtaattatgcatcctagctaaggcacagaagactgaatgaatgcaaggattcattaactctttgaatttgttaaatactaacagttaaccattagaagtggttcaatgatgtaagagtcacactgcttcaactttttctttgttgtagtttttaaattgtcgatttttagctatttgacagattaaaagcaaaataatcatgccatatttagtcctggagttcaagtctaaatgttgatgtgaaaaattattgtagtaaacttttaatatggcaaagcaaccttaagctctattttagccaaatgaaacataatctgaaattatattagaacatttcccttgtcttcaaactgtttggtgtaacagaatattgatatgcagcttggtggatttcaccagttaatgcacattcttcttccctcctccccccattaatatgtatactgaaaaatgtgcatttgtctgaggaattattttgtttgctaccacttaatgaatctcaaaattttgagtaaatgtacctcagtctaatcagactttttatgacctttataactacatttaaaacccttaattcctatttctgggtgtttgcgagcctgattgctatcatgaagtaaaaatttattactctaggtattcactagctaaataaacatagttcttgtttagcaagcatatgttgttcctcagctcttttctccagcttttgcagtgtcctggcatccttaaaatactttgaaaatatggccttgatccatggattaaatcagtatctaagtgaatgtgttgatgttttattgatcagatctatataagtgggaatacagcatatatctggatattcttatagttatctttttaacatcttatttttttcattaattacatatcaacattaattttgtatcttgaagcaaattgattttgtataattaaatgtgtcaagcatctgtattaattgatttgatggcataaggttatgaaaataatgtactgccccatgtattactgttccaaaaggagaaagctatgtagaaagatacattaagggtgaaaatagcaatacagtagatttgaataccttgatgttttgcattacttcatttatgtttacatcatgtttagaaatgttttcatttactgtggtctttggtcacttcagctcaaagacctagtgatggatatttctttgaggctttcatttatataattttattttgtacaatgttttttttaaatgtgcaaatactgtattcaagtgaaaaaaatacagtatttgtagataaccatagctactacacagttcttcggtagtcccagtgtagttatatcagtgtttactgaagggaacatcaaaatattaatggtatattataaaataaagactttcttaaaggaaaattgcacctattttacctttttaagagtaagccatgaaatcttgtaacatgtctcttaactatttataatgaaaagtggcatttgggtatagtcaccacagcaatgttctacatccctaagattatctaggtaggacatgtcaaagatgactgttgtcattctggaggtcctattagagaatattataaaagggtgaccttgtaggaaggatctgagtcctccccctgaggttctctttttcttggtgctttattagcaactctggatatttttataaaactagttacattataaacggtttcaaacatgtttaatttacattaggtttttatgtaagagtgtcatggaagcactcagcaagcaggctgattgcaatagactcagacatgcgaataaatgtaattgagagtctattcatggtgaggagtacatcccagtgcctttaacctggatttctaatcttaagtgaaatgggtgcagcattcctttggaaaaaaaaatctttttattttcaagtgataattttgtgtttttctcatataagttttctccagagcacccaccttctcttccttcttggtctgtcattatattgcaaaatatttttcctctgaatgaaattatcacaggttgtctcaagcacaaccaactgaatgtctcttaactgtggggaccaaaagggagagagcctggggtctacaagaggagacacatcatcaaatgtttgaatgatcacaaatt

SEQ ID NO: 130000 - DNA, 1478 bp, Homo sapiens
tccaagttctggcttgaatatttcttattaaagctatcttatgtgggtattttattttgaaaggtattatagtttgtatatttaacagtaaggaggaaactgtaaccaaaattagtatttctctatacgtattggtacttgaagattcctttcaaaagaaatccagcgttttcctaattttagtacttaatttctctttttaatttaagtgatctttctaattcgaaagctgtgttctttttgaataccgtgcatgggggttaagctgatgttaaaacagtttgcaataaaaaaaaatgaatcagcttaagtcatttaatcatttcaagtgcattctgcatcctttaaaaataagtttaagaaatttaagagaattgtgttttcattaagttttgcatatcttttgttatgccatgtaaattccctttttcgtatgattaaaggaaggttatgataaaatgattagttcatttacattcacttgtagcaattacatgagaatttgaattttgtcgtgtttgggtttgttcattcctgtgaatgatggtacagttaggtgagattttctgttatggtacccaaactcaccatttggtcctctttaatctttgagggtttcaataaaaattgttcactcatatctgtgttctttccattttatcttcatgaatatgtattgcttgccagaaaacgtaacatttttgcctactctgttatggatttcctgattgacatatctttcacgtacaaatagattatatcactccttctggttgactttaaattaaacagagcagttaatcagagggagggtaacagtttaccttattttttatccattccaaggagcttattgacttacatgcttttaatactaagtttagaacaaaagagaaagagaaggcctgtttgttttttgtagcaggaggaaatagtggcagcagctaataatcctaatcccccactcttggtaccaaggaatgtttttctgacattgtctgcattacctcttgggattgatagtttatgtggataggatcatggcaactctgggtgatgcactgattattgctgggctctctatctaaggtatttgttcagataggaaaattacagaattgttttgtgttgtcaaaaccagcaggctacatataacactactggcctgtgacgcgggcacaagcttaaagaatcactccaggtgcctacactgcagcagcatcagaatcctcccttttactactggtcatctagagagagcaagggtgtatggctcatcagcatattaaaattgaggctagtcagtcatagttggggcctaatttggcttggctttatgttgcttagtgatactggatttactgattctagtctatgaaccaacatattcttgcagtcagaagttaactgaccaaagttgttatctttactttctaatcacagtacttgccattgcataatcttgatgtattctttcc

SEQ ID NO: 130001 - DNA, 1095 bp, Homo sapiens
tgtaatataatggccaagaccttgaattttagagactaattgatctatcctggaatcctaggttcacttcttaactaactctaagcctcaattttctggtcaattaaaaaatatgaaagaatgataacagaacctatttcagaaaggttaaatgaggtaattatcaagtgtttagtacaatgcctggacccatttcaagccctcaaaagttagttgttaactaccttcttttgtttctttgggagaatttagaatttattgattgccattgaagattttttaggattcagtgacagccatgccttttccaagtaaaatatagcaatatagagcttatcctgctagagcagatgacagaaccaaaggtggattggattaaaaggaaagcaaacatgggggaataatggtaagaaaacatataaacaatagaataaaattaaagaaaccaaaggtaaaaattagatgaagatgtattttgatttgcttattacaaatgccccttgatatttagtgtcatttaaatatataagtaaattgtaagtacttcattatgtctggtatcattacagaatggaaacactaatgcagatgtgttacttccatatttcctcagtgaagttgtgtaactttaaagggaagaggtatttggtatacacaaacttagatggcaattctattgtagtaaatattcaaaaggaagattatataagtttacacatgaaatatgaaagctccaacataatgctgttgcatgctaatattaaagctactatccccaacaaatatattgtttgctattactactttgccagattaagtgacttggtgtccgctggaaagcagccagtgctgagagtacaattggtacttgtatctcagctattttctagtttgctcgtgtttgtatgccttcctagagtcatttgtgcttctttctgaacttgttgattccagtcgtacttgttttgttatgaaatttaaatatgtaagttgataaaatgtgacggaaaaagaattgtttctaagaagactaagttgactgctttggaaatacctggtaagggtgagttgtctgattaggtagatgaaaacgat

SEQ ID NO: 130002 - DNA, 2771 bp, Homo sapiens
tctaacagtaacgggtactattattgagaatggagattgtttactccattcttttttttttttttttttcttttaatttttttgagacggagtctcgctctgtcgcccaggctggagtgcagtggcgcgatctcggctcactgcaagctctgcctcccgggttcaggccattctcctgcctcagcctcccaagtagctgagactacaggtgcctgcaaccatgcccagctaatttttttaatttttagtagagatggggtttcaccatgttagccaggacggtctcaatctcctgaccttgtgatctgcccttctcagcctcccaaagtgctgggattacaggcatgagccatcatgcccggccttgtttactccattcttaaagccatggttctttattgaataaacacagtaatgcttcttattctgagtttttcctgtgacatgacttcattctctagacttctgtatcaaattgtacctgtactatggtctcattcaccccaagccagctctcagctagttgtttggatgaacaatcctgattatggcttaatgctaaagcctgctgacatgtttctaagaacccactaatggcttacctgaaggtgaatgcaatggtggtatccaggcatcatattaggaagagcacagttatagaaaatgcagagtggagctttggcatttttaagccagctatatgggtagtctctaattgtactatctgcccatggtttgaattttatctgtccagcatgaagcagagaggagcagtcaaattgttggtgctactgagagtatcacctgcctgcatcagagatagtggatggtcttctaattttaagtgtcaccctctcttatgaattacctctttttaaaggcactctaccatactgccttttattatgcttttattttgaaattgtaagcagcagttgccctgtatcagagttttctgaacacagatttttgaatgaatgaatcaatcaaaccatgacttttcctagagtttgatagtccttccaatcatctaattgtatgtcatttgtttagtgagatatcatcaagctgttttgcttcttgagaagcattcagatggtaagaatcgccgattgacttgattgttccacagacatataaacactgctggcagagttcatatgtctagaagatgcttctggcatctggtactgcaacagtgtgataaggtgatgcatccaggtgagtgaaatacacgtcagaaatagatcccataaaaattcagtgctgcctgtctcctttagttcctttaagccacaagtatgcttggttttagcttttctgtttatttggacactgctttttatcagcaacaggagatgtgttgttttatcttttgttttaaatgtctgttttaaaccttaacccccttttccttcctaagaatgaattaaaggtctatttttgttaatatctaaaattgttatcccaggaaatgagtcagtgaaaatacttttgcataaaatgacaatagcaaaatcttttcttaatgagatgtattgttctagcaagaggtcagatgattctcccatattacccctacaaaaacctttgccaatcaagtcaatatgccagttctaagcctggttagcaagtactttctaaagtacttctaaagtacatcttcagtaagactgttcgggctttccttgtgatgccctgcattgggaaagtatagcttatattccccttgaatctgcctgccctgtgaccatttaaccaacagaatggaatggaattgacatttgcctcagtggctcaaagctttaagatgtctggcagcttttagttttgcagttttggaaaacctgagtggccatataaaaaatctagcttcctgttggagagaccacatgacattacatggaggccaatatcgatctatcctgttgtccaaggaaaggccctgaatgacttcagtctcatcccctcctgactacaaccaagtgagaaaccagcagaatctccctgctaagctcaaactatacaagtatgagagataataaaatgattgttttcttaagtgcctacagttttgttgtggtttgttacatcgcagtagaaaccaaaaccgaaattgtttcttggaagtggagtgtggcttaatggtaaactattacatgagagtttgactttgggataggtagaagctggaagggcctcgaggacaattttagggaagcctgttaggacaggaaggaacttgtcattaggagaaaaggtgactcatgttacttatgacagaaagcttggtagaaagttggaaacatggaaaatagaaaatataactaatacacttatggtcctagctctttgcatatatccactatactcccctgaacagcttgttaagaatgggaacaatattcctattagtgaagtgaggaaatcccaactaaaggaagttaaatgtctgtccagtatcatatctggtaagttgcggagagatacttttaacacaatttggctaaaggaatttttcaggtgaaagaaaaagtaccaatggatttcttttggctgcgcatgaaaaaatagagatgaactaaagaagaaacagtttagtttttgagcagaacttgaaggaaatatttctaagcaggaagctgttagagacttggttggtgtgtctgtatgacaagaaagtgaggaaagttatgttgttggatgtgaaaggcagcaactaggccttctcatatatgattccatgcctcaagccatcacacagactattc

SEQ ID NO: 130003 - DNA, 1068 bp, Homo sapiens
atgaacagcccccaaatctcactcgtttaaaacaacaaagccagtatcttgatcatactacatcctctgtacagattggaagggaggctctgttttggtgtttgaagaagtccagcggagtgaggcttcacctagttatagatgccataattatataatatccaataatatgttagagaaagagaagactaaagattcaagtataaatttttgacccagaagttatagctatagcttccattcacattttattccctagaattagttacacggttatgcagaaaattggaatcttcatgtatctagaagttaaagagaatagacaccggtgaatagtgatgcttaccaaaatatggcttcttgccaacactatcactggtatacagtggctgactacatcatccctaagagtcctggaactcagaaatcaaatgtggctaaaataaaaccttggtccaatgctttttgtattgttttgaaagcagtgaagcatggaggacagggcttaaacagaaagtcaagaaatcttttagaataaaaatagactctctgaattgctgtgtgattttagaatatatcttttatttctgagcccaacttttctcatttgaataatgaaaggatggaattgactatccaaaaatatattccaaaattcagttatttctgataataaaagtaacattaatagcaatagaaatacaacatcgtctagcatatgtagagtaagctgctgaggaaagctcttcatttccactccacatggagagtattggttctaacactgaattctggggatcatcaatttctctcaaggtattcatgatattttgtgaataaaggactctttgggatgcctaggggagcatgcccagcatgcctaagacacatgcacatgatcctcgtcctttgaatagataataatgagacacattctgcccagcttctcacagagttccagcaggatcaagcttaaaacatcaccaattcacaaaacacccttggattttctctacccatccctgccctcactccagtttccctggaaccactcccaaaataaattgc

SEQ ID NO: 130004 - DNA, 1034 bp, Homo sapiens
agtagtagagatgggcatggtcgcacccacctgtaatcccagctactcaggaggctgaggcaggagaattgcttgaatccaggagggagaggttgcagtgagctgagattgcaccactgcactccagcctgggtgacagagtgagactctgtctcaaaaacaaacaaccaaccaaacaacaataccaatatcattactgataattagactactaaatggagtttagggtttcttggcaatttttttcttttgaaatatattccaataaatatgtataatcaaaatactttattctaaactcaattgaaagaacactcctctctctgatataaatttaggtttatttatttccattttcatggcttttttattaagttaattttatgattatgcaacacatatgtttccaaagccatttacaaaatatatatgtataattatttttaaaatgccctttttagaaataaaggttttaaattattttcctaatatatgtcatttagtggctttgatgattatgttggatttttagcttttacatgagtttatcagttagttccaaatatgtcagatcaactaactttatttgctacttcagttatggcctgatccacctgcaggtatgtctccagaccaatgacagttttaatatacaaattcttaaaggaaccaaaatatcatatagagcaaattaatgtactatagtaatataattgtcacaaaagaatcttcaaaaaagttagaacggtactttttaaagctatcaatggtacatataaagattaatttattttagaaagtaacttacctagttggaaacagatcaatgaaatgatccttaaatttcttcctgtaaggcctaaattgacattgttaatcaaggagacagagtcagctttgaaaaatcaaggaatcattatgcctaataaactgaagtaaaaattactagttgttcaacattaacttttcctaaactcaaatgtatttttataaactaatataaataatgtttatgttacaattttaactggttt

SEQ ID NO: 130005 - DNA, 1050 bp, Homo sapiens
actggtcagtaaagctcagttcttaacaactcacaggcagccttatcttaatcacagttgcagttgttggcagcttgcagtgcctggtgtaaattttatctcaaaatatttgcattcttgatggtcatttttcgacaatgcattctaataattagagtcctattacctgctaaatgttagtataaattaacaatccattatacacaataagttttataaaacatttacagatagagatcatctttaattaaaattaacttccatatgaaagccaagtgcattaatgactcacaatgaccttttattacctgcagtcccctgttttggctggatgattgacagcttgctgtttggctaccatgttgaatttcagctgacaagacttttcattttaactcaatttgcccgcctatcacaagctggtggcaggccagacccaagtcacccagctttgcctcagcagcttgctctagttctcattagtacgcatttattcagtggaaattggaagacaaatgcttgaaggcatgtgaactaagtatagcaaattaggtttaaagactgaatatttataagtatatggaaagttttttttttttttttttaattctagagcgaattgagaactgagtgctagctttggtataaaagaaattaagatagaagggggaagattctaagaataacaatactataagctttttctttccactttggaaacatgtaaaatctctctgacaacaccttatcaaataaaaacctggcttctctttcatggagtgcttgcacaaagaagtttagcacctcatgtgtgagaagggggaaaaaatgagggtcatgttcatttgttgcttggttatcccttggtatgttttaaattgccttgtttgttcggcactagcacagaaacagatgttgctctaccgtgcaggataatttactgtacctcctggtgcagcatggaagtcctcccagggcccagctggtctgtcagtggcactggctggtgtctgctcaactatgacaactacaagtagaggctgcaatttt

SEQ ID NO: 130006 - DNA, 1033 bp, Homo sapiens
tgttctagtttggaatcctgtgtcagtcacaagtcaatatgtgaccttgaacatgttattaaatctcccacatccataaaagtgaaaatgctggcattagtggatttttgccagtgttgaattagacatttatttgtgagtacctgctccatacagtatggtcatttatttgagttaaaattgttgtatttgaacaaaactcagatgacacctaagcatgaaaaagctctttatgaagtataaatactcagaaatggaatggcatgttgccaatttgttttctgctttattgagggaaatatatgagaagtatttaagtcaggggattatgagaatatttaaaggatatttaaagtgttcaggtactttagttaaaataaaaattggaagagtaaaccatctttgcaaaggttagtaagaacttcaggatatttaacttcacgtttctagagtgttttccaccatctttcaaaggaaacatgtagtgtaccttcgaatgaaatggatttgtattaaactttttgccttagttattagggtctttctaattttgattaacatattttttaatttgtggtgtttatttctgttttattaacaaacgaactcatattttctctctctttttttttttctaggaaagtacataacatttatcctggaccccttccagtaccagctagtgataaaaaatcataaacaattaagctttcgagtattttctaataaattattagagaaagcatttagcatcagtcagttgcaaaaaaatcatgacatgaatgatgagcttcacctctgctatcaatttttgcaaggcaaatctttggacatactcttggaaagcatgatgcagaatctaaaacaagtttttgaaccccagctgttaaaaaccacaagttgggacacggcagaactgtatccattctgcagctcaataatatttgagatcacatttacaactatatatggaaaagttattgtttgtgacaacaacaaatttattagtgagctaagagatgattttttaaaa

SEQ ID NO: 130007 - DNA, 1849 bp, Homo sapiens
aatgtcggttcatcagctgacaataccagttttgtctcttaattagaaaagagaataaagctgtttaggggtgtcaataaaatgacagatgcatcattagcagacggctatggtggatcagttttgtgcaaatacttggaatggaattaataggaatttctgctagcatatttaaattgaaagcttgggggaagaaagcagtgttttaatgccgtgaactagtcaaagaaaacgggagcaaatgaccatttaatactgaattaagagtgtaagagaaatcaagttgcaatagagaatatattactgagaattttatatattattaatatatcacaaatgagccattatgagtattgtatgattaattcatttaataaatatttattgagggtctactatgtgccaggtggtaaatttaattagagtatacaagtgagtccagacccaatgtcactgtcctgtataattaataggacaaaatttcacttcaaccctaagtatccgaaggggttcttcagaggttttgcattagatggtctcacagtgtataaaacccaggtcatccaatgtgattcagaggttaattccatttagtccatatattctaaatggttggcaaggttgttttagcaagtacaggcaggtgcacatgggtgtgctaacgcgtaagatggtacattgttttatctagtcatcaggaagcactttacacatgagactaaagcactttgtccaattcaataattatattcttagtgcctaaaatagcaccactctggagtaggtaccccataaatatgaatgaatggttgagaaaataattcacataaaactgaagacaagcaataggttaattggacaaatattaagtaagatatgggttgggatactaaaagacctttgttttgtttgaaatctattcatttgtttatttattctgtcgatgcttagaacacttctgctgttccttgcactctgtccggactggggagttaagaaaggaaacacacaggccctgccttcaaggagctctgagtttgtgctgagtgattttgatcctcagagacccccctgggggtgtatggtcctaggatgtagaaaagtgcagaatatcatagacctctaaggactggccttggagctatatacaaaagttggtttttgtgaatctcacaggaaaaatgtatgaacccttagtcaggacctaggtatgtgctattgtgggtatttcaagtgcatcctctaagaaacaaccacgctcccagttcttgctctcaaattccacatttcaaccacgtttgtttcagtgttgtacctgatgtacttgatccccagagtggatttttaatacttcttctatatgacagaatcatttagtgatagttaagtaataattagtaatatgtattttcttaatattttggtttttaaaattaataaagaagaaatttcaatgtatagacattactcaaaatcagtaaaataataataatagcaaaatacttaataagtaatataaaataataaaaaataaaattaataaataataaaataatgcatgaactgaaatgtgtatttaccaaacaaaaatagcacatcttgcagttttcattgttttattatttaaaaattttaaatataaataaaaattccaggggcttataaagaatgaggggattataacacaagttttctttactgttacaatcactgtgctagcatatttatttagaatctactgttgaaatgaaggacctagtagaaggactaggttaggaggaatgaattacattcaaagtgaatttacaccttttgcacagttaagaacttgtacttgaaatgaatgtag

SEQ ID NO: 130008 - DNA, 1018 bp, Homo sapiens
cacatatgtgcacacatatacatacccgcacacacacacggacgcacacatatagaaatgtatacatgtgcatgcacacatgcacacttacacaaatgtgcacacacatcccaagtgcttgacactcagttgtctcccaatagccatggccagacctgcacaatttctgcatgacagtactctgtcatgcagatcatgtctgaacgacatactctggctaggctctgcaagtgaagataatgggacttcctttggagaacagtgattgcaaatgagaccacaaggtcattgccctgagagcaaagaagcaggatgtcttaatgctgggacacttggcaaagcctagtcctgaccagcctcttcagtccatgaggagacagctttgaatgatttgactccaaatatgaaattctggaaatagaaaatggaaaagcatttttcaccctagtaaactggaacatgtggctggaagagttacatgtggctcgagaacagtttggaagaattacagaacctcattcattcatacatacattcaaacatttatagagcatctataatgtaccaggtccagtgcctggtactgggtagacagtagcaagaaaaaataatctgagtatctgctctcataaaaaatatggataattataatacaggtgtggaaatgactccaggagacttttccctcttctgctgtctttgaaggtgtactcaatgtgataaagtcagatgaagctgtggaatccaagcctgagtttattctgacctttacgtaattatacctgtgatcctctcagcccactgtgatctagattctgttctctctccacttctctaagacacactgagaaatgtccatgaccattttctgttgctcttagatagatagctgacctaggcatgtcaagggaagcactctcagaccgggctccatctctgtgcaccggggtctgcttcaacagcttggagtctgaatttgtcagtgaatacagattaaccaccctctcataaactgatg

SEQ ID NO: 130009 - DNA, 1023 bp, Homo sapiens
ctaaaacaagaacttgtgtttgtagcatttgccacaatttcacagcacttttactgctttgtcatcatttatttttcacaaaattccagaaatgtacaagaaacccagaattgagctgttaagtccacagtgactgagagagcattcagaccagaaatttgcatgtatttttacaattattagtttttaacatctcatgttcatctcataaaagaattacctaggaacttgttctgtcagttaaccagtgcttcagaaagtgcttaaataattgatgaaatataagaaaaaaaaagtaagcaatatgacacaaagaatgggactatttcgtatggaaatcaggctaaatactttacagtcacaaatcaatgctaagatgaagactgacaaagctagcactatgtctccttagccatacatattccaaaaagactggggctcagagtagctggcttctcatttcctttcctgctgactagtttagtgaccatgaacaagtcatttgagcttcctggttctcagggtttcatttttcatctgcaaaagatggtctgaggattaggtggtaaaaataataatttatatctgattttttgctttgcagtttatagtttccacatatattatcccctttaaccagaactttgtttcaatattttaggaatctgtagtttcattataaaggctaaatgtttgatttccaaaagtattgtcataatcaataagttcaatatgtaaaaacatctggtctaagtgagtaccatcttgtctgtcttggtcagcatttaaaaataaggccttcagtgcaggcatcagataataatgaccctgtatgataacctcatacctgctttggaaattatctaactgtggaaatccagtcccctaaatgataagtgcttgtattggtaaagaatagtcatgaccctgttaataaatctgttgttgggtcttctttgttctggacatttagcattacaaactcagaggaatgaattaatgtccaataaattataagaatta

SEQ ID NO: 130010 - DNA, 1064 bp, Homo sapiens
ctcttaacattatcgtcaaatagagagactatctatacctacaattaaatgcaaattttattcaggcatttaagcagaatcacattcattcattaaaccaaatgattcttttatttgaaaaaatatatcagcacatggtaatatcacaccctgcttacaagggcctctagttctctgtcagtgcaaaagtttactatttcattattaaaggattaaactacagcaaaagctgcctggtgaccatgaatgttttagttaatttgattatgcccataaagaaagagtttaattccatagcagccagtgggtcttatacctggcagtgtggttccaatgcattacgggcatgatcttatcctgggagagactgaaattgccatttgggtgaagtgtggaggaagagatgagaactgggttcactggtgaacccaggttaacaccatgcctcgacgttttcaaaatgcttccttttcttagttcttagttaccagagtgttacaaagaaagggttttgatctcatgtagatagcatagcattaattaccctgacactaattaaactgcatcaaacaaataccaccgtgttcctcagggggacaacagaaggcagtttaaaataattactggagcttcatgcatgtgtgaagttttcattactcttaggacacaagcaaaaaagatttgatatcattaaaatagccaccttttagtgattgcaacaacaacaacaacaacaacaaaaagtgactaaaatttccttggagcatattgatgtctaaatagtggtggcttcagttcttcagaatggtaacttttccttaagaattggaagtgtgtgaagcaggaacaggtgttccagtcacattctggtatgattatgtattagcttatgtttgtcagaccatttcattaaccacccactgctatcacatatacatatactttgttctttctgaaccatgaaatgaaatgcatatatcttcactaatgcttgctatcaatgtaaatgagaaaaagaggcttattaccaatcacgactcccatgaagtccacacctctgtaca

SEQ ID NO: 130011 - DNA, 1005 bp, Homo sapiens
ttcagagagtgacagatgacaaaaccaacactgggcagatggccttcccttggcacctcaccctctttgtagcgccaccatttgtcccttcccaggaagcagcggtggtgggcttctctgcagtgactggtcccaggcagtgaggccaccaagcaggagagacgccaggaggtttaccatgcagctgtgaaatcatttccactcagctgtgagttgtatacaaatagagaactggtttgctgtgattctgctagtctagaagttgtagcaacagatctctctgtgctgagctgacagcagatatgaccactatcattagagttaagggctcctagtgcctctactcttgtcttcttctggtgtattaaactttgagagatttgaaaaccttttactccctccctccctctcatgcccacatctctcttcccccttctaaaaatatagaacagaaatgggcaaactgcaatgtgcttgtttctataaatgcagtttgttataatggtagataaagtattcttaaggtgagaagtatgtgtggttttattctttaagatcttgcaggagttttcctattttaaactactacaaagtaggtatctccttttaaaattgggctgcttgaatattttatgtattttcaaatatgaagcttagtttgaaaggtatttatttttataaggtgctttatgtttatatattatatataagaatataaataaaatatatttatatgtactttttatacaatttatattttacaaggtgttttgtattcatctgttgctcaaccatggatttatccattcatgaaatttattgatgtactaccatgttctgggtactgttggcctacagtgatatacaaaggaggtttctgaatctaaaaatggcaagtatcctaactgagatgttagcagaattcagagaaaagaaagattatttccaaggttggaggaattggggatgtaagaaaagtctaagagagaaggtgtcaaatatggt

SEQ ID NO: 130012 - DNA, 1612 bp, Homo sapiens
taacaatgagagaagtcaggacagtgaggaaatgaggagccaagtgaacagaagcccaaaagtgttgtgtgctaatttatataaactgttcagtggaggcccttttatgtccctttcccttctaagcaatactatgcatactttagacccctgttcacagtgattttccacctcttcgcccaaaagattagttattctttttacagtctcataatatatttcagtggtgtcagatattttaaaagattataaaaaatttctagcatttttcttttctagaaggggcaatttacgtagtaagatgcccactttaacaaacatcttaacaaacaaattgaagtgtaacacaaatcttaatttctatcaaatttcaaagtagacaccttggaaagcaacaaagatacttccaaatttctggcctgtaattcatgggttgggtgccttgggagccatcagggtctcaggccatttacagaagtgccctgccctgtttccttattcctagatttggttggtttggttgttggatggtttaaattcccaaataaggaacacggtcagttttattcatacattgggagaaaggagtatacatctttttataagacatcctgtctctctgcaacattagattaaatatttgcttaaaaaaataaatgttgagtttatcctgttgattttctttacctttaaaaaaaaatctcaccatcattgtgtgcagtcatttatcctgagagtagatgatggggacatcagttttcatacgttacatgacacagaaccagaaatgggatgttgtcgtgtccagacctgtccatcactgaggattgaccttagacttcctgatcaattctgacaagtcactgacagtttgcaggggaagcacatatgtgacaaaggacaagcagggctacatgtgtcagcaagaaccctctgattgcaactagaaggagtcaagttgctgacaactgtagtgtctggatgttcttagttttcttttaaaatatggcttcagaaaatcacaagtacccattcctccagatacacagttttcctgctgatttagtccatggttaaatggcgggtcacaatggtttgaatgctaacatgttcttcatctttttgccagtttgttcatgcatttgcacacatttattgatattattctggatcctggaagataaagtgtaaattcatattctttataaaaaccacactgaattgttttaagatttagaagtgtttagcataaaaatggacacatctggctcaagtttgagtcttaaagtgttaatgtttgtccattgcacagaaggtacagaggccatatagcatggttaagagcatgaatgctgaagccagaaacacaggtttgagtctttgctccactcagaaaagctgggcgacattgagcatgccaacacctaatctttctgggagtcagtgccctgatctataaaacagagatacaagagatcttatcaccttgtgttttgggattatatgagttactacctgcaaagcatttaaagcagcacttgacataagatagatgtttacaattattaaattctgtcactgattcttaatatatttaaaatgcagtcactat

SEQ ID NO: 130013 - DNA, 1059 bp, Homo sapiens
cttttgacttatttgaataattcaataaatgaaacatttacagtagataatgttatctatatcatatgtgtcataattatataggctgtgtatcttgctatctatcataaagatatagtgttatttactgcaaatgttttcatagatatgaaatatatatctgtaaatattttcatctatacaaagtattattttgtatatattagatagaatccaggatggctgtaagtcatacacatttttaagacggtaaatttcaagaggagagcttgctgttgcgaaaaagtcctatcgctaatactgtgcatcacaaatattaatcttttaatcatccttcacctacatttatacattggttttgcttaaagtgcgacagacctattttagttttccctgagagattgttggttattttaatttggctttttacagattgatatatttagacccctaaatgatgaatagatgtggtaagaccaaaataataccaaataaaatacagaagctatgatttttttaaattagtgggaaaaaatgatatctatatgatcctgtttgagcaaagccaggaattcacttaacgctttctagcagtcagggcagatgtttattttgtactggagctagtataagttggtgaatgacagaattgtttgtaatttcgacaaagataggtgttgtttttctgtttactttttgattaatttcaaatattgaatacattcacctttaaagcaaaaacaaagcaaaaaatagcaagaaagtttagattgactttataggtaaaaaaaaaaaccaggtaagaatcagttttctatactttgtcatttgtgatgatgtttgattttgtaacattttttattttgatcttttgttttggttttaaataatagatttttgtttaaaaatatcttatttatatattcaatttctgataggtttttgcataaagaaaaaaagcctttgttagtaatttacaaatagattaaatcaaaaagataattgagaagcttttggcaacccctgctgagaaagtatatagcactttcattacccaga

SEQ ID NO: 130014 - DNA, 1020 bp, Homo sapiens
aattgggggtgggggactgaaagcaccagaccacaaaatcggggtggggtgcatgcaaaagtggcaagaaggaatgggaaggagattcaacattgtctgctatacagatgatcctaagttaacttcagaatcgtttccaaaagaaattctcccaaataatagtgatggttatctgtatttgtacaggccacacaagcttctcacatttattatcccatttaatctttgccttaacacagcgaggtagaacactcaaatcttgcaaatcaggcagctactgttcagagaagctaggtaacttgcttaaagatgcagcgccaaaaaatggaagggcaaagccacagccagcaaccctgacttcaatctagtgcccgttccaataggaggttgcttttattatgtacttttttaacctggttagtttccctgtgagattcaaactactttttgtaactgggttcattactgggccattagtcaatgcatattttctaagctgatttctattaaattgaatttaaaaggcagactttcttatcccccaacgtacatcatcagtctctgcaatttctcagatacttgtagatttatggggctagcctatgggccattttaagtcacttctgaaacaactttgttaataaaaagaagaaaacgtttgggaataaaagaaacaattgagggcatttttttttaaagatcagaggggtagaagaaggtttcttatcctacatgtttgttccataaaagggatctatatttctttagtttcatctcaagaagacaacaccttaattaaactccagtgggccagtttaattaaaaaatgtcagtcagatcctcacaggagaacaagatatccatgaaacagacggtctgcttcctttgtgattactcagaaatctctggccctgcagccacacgacagcggattgttgtggtgagcagagcttgtgcatatccactgagaagggtgggcttttggtggaccaatgagtgaggtcagggcatgatgaagga

SEQ ID NO: 130015 - DNA, 1030 bp, Homo sapiens
tttttatattaaagctttctgcacactataaatgtagaatctccaaaagattagataatggcttaaaactatagcacaaaaagtcattagctttggttttaaatgttgagtcctggttagctctcccaattagaaaatgcacaatcatattttatctggaattattcatacactgtttaaagttttataatttatttacaactcagaaatatgtagaaacaatcttgatattgcaatatttgcataaatattaaaaaggacattttcgtctatgcagagagcaaatggaagcatacaaaatgaacattatactgctgcattctttaaataaccggaatgctgtatcttacccattaacatttaagctttttggttgtccttgccacttcattgcatgcatgctaatatcttctcatataaaatttaatctgttgaactaaatgaaggaattagtatctgaaagacatctttcattaagcaattaacgaatctctccaacaaatctacaaaagcatatgtgtttatatttaataattatttgtatgatcagccagttataacacatgcatacatttagttttagtcatagtattactatacctcaactcactgtcattacgctataaagccctagtaaaaatgtggtttaaatgggttatttgctaaggaatacatacatgtatagtttattgacttttgaaagtcctctgaggtccagtatagaacaaagaaaattcccacaaatagagatatttggttgtggatcaaatcttgctttatattgcagtgaaaaccagaagtattataacagggcaaaattaagacaattcatgggtttgcagagtacatctcaaagaagggtcagcatcatatgtgccagttaacttttactgtcaaatgtaaggggccaggataagactttggtgtttcttaagaaaataaaagaaaaaaatcctatcttagttatccacaatttccattgcttaaataattatttctgagctgcactttaattagtagcctaccttcc

SEQ ID NO: 130016 - DNA, 1050 bp, Homo sapiens
atgtaacattgggtttggttatcttccaaaattttaaatggtaaataatagtaacaaaaaagtctattataacaattataacacgtttactttcctgtttctaataatttgtttttgaaattaaaatatttctctgggctaacaggtaacaattgtcttgctgtcagtgcttactataaaaatgcaaagcaaaatagtattgggatcatagacacatataacagttactacttcttttaaatcaccaaaatacaaatgcatttggatcaatacttgagtcttcacagtcattgcaactaactgaatgcaaaatatattttaatatattctgtaaatgagtgatgagagcatgcaggaatgacagtgcctcttgcgttattctcattgcaattccctggactgatttttcttgtggtaaaacaaaaccaggagaaaaatgctttccttttaaagtaaccttaaggcttgcctttaaatagacaacagaagcttgggagatcaatgcttggggacttaagctatattattatttttactgtttagtattgcagaattactacccataccatacatgaaagtctatacagttttaacaaaagacctggctatattgacttaagaaagggattttttttttcttacctctgaaaatacctacttttttctttttaattcaacttagatccagctagagagtttaaatatatttaaaatttttagtggaaaaaattatcctttaatatcaaatagattaaaaaacatgcattgaatggttgactcaggggctttcactaaactggccatgaatgctgaaaccatctgtttttctggacgttgtcagggtgagtatggcagaggcagctgtttgcaaagggacgctttagatgatgaaccagcccattgtttctaagcaattcacttgcattcagaggctctacccaagcgtactatagagcaatcaaaatcaaactattgtttgtaccaatcatattgatctgaaaagattgtggtgggatgaccccattgtagatgcaaatagttgttctgagc

SEQ ID NO: 130017 - DNA, 1688 bp, Homo sapiens
ctgctctccctcagtccagcttgccatcatcatttacctggattactatggtaccttttctctctacccccttctaatctattttctacatttagtcagactgatctttctaaaatacaaatctgggctgggcttggtggctcacacctgtaatcccagcactttggaaagccgaggcgagtggatcacctgagatcacaagttcgagaccagcctggccaacatggtgaaaccccgtctctactaaaaatacaaaaatcagccaggtgtggcagtgtgcacctgtaatcccagctactcaggaggctgaggcaggagaatttcttgaatccaggaggcagaggttgcagtgagccaagatcacaccactgcactccagcttgggagacagagcaagactccgtctcaaaaaaaagagaaaaaagaaaaaaaagaaaataaaaaagaaaaccaaatgtgatgatgtctctcccctgcttttatacatgtagaatgaaatctaaatcctttctgcatattaggttaacctttgtgctttcatctctggagtcatttagtgttgtaatcatctgcatagttatctttctctagctgtagactacagctctatgaagatggagactgtagtttactaatctgcacatggatgagcctagcactctgcctggcacaatgctcaacactatttgttgagtgaatgaaggatgtgagtttggaggtcatttttagttgaagtcatgggtgcagataaaatttggatgtaggagatgttcagtaagggttttgttgtatgaatggatagaaaatgagggtgtgtagactgagaacaggcgtagtcaatagaaccctgaagaatactaacatttcactggatggtaggggaaagtaaatctgtgagagtgattgtgaaagtcagaggaaagctaagggagagtgtgggaggcaggctaagcagcagagaattttaatagtgtttccttggatctccaagacccagcacaggggcaggtaaatgaatagcagaatgaatgatcagcagattcaaattctgcagcaaagtcaagtaccaaaaggactgagaagtacttactggatttgaattacagttgtagtgaagtgtttggggcagaagaccagggagggattgtaggggaggaaggagaaatggtgaagatagaccactcttagaaggaaaaggaaggagaatagacgggggagtgtctgtctgtgtgcatttaaagatggtagacaccccaagggtgaagagctccaccttctgctttgctgctcacccaacatcagagcttctcagcaggtgcttcagtcctgggcaaagatgactgaatagtggatgaactgatctttctagaatacaaatctgatgatgtctctcatcagacatcatcactgcttcaacactggccatggctggcaagctcaaaaatcttctcgttgtccccagaagaggagtttgggtgggaaggacagcaacaaatcctgaagttgtgaagtatggcttccaggtgctgcaatgggtcatgggctaggccatgaccttagttcctcccctgcaagtttttagccttacccattgggtgacttcatactttcttctgctctatgttgtctttatactttctctagaaacaatatgacaatggtgatgataataataataataatgaata

SEQ ID NO: 130018 - DNA, 1055 bp, Homo sapiens
taaaagattaaggtgctgtgctacttgggaatagacctgggtttttggttgtagatccattagactgtgataggcagaataaagccttctcagctccagagatagccatattctaaccttcagaacctatgaatatgttcggttacatggcaaaggggaattaaggttgcagaaggaatgaaggttgctaatcagctgaccttaaaataggggattatcttgcagtttttgagagggctcagtggaatcaggattattaaaactggaaacaggaggcagagaaaggaggtcagagttatatgatttgagaaatacttgacttttgctggcttggaagatggatggtggatgaagtatttcctgagccaaagaatgcaggcagcctttagaagctggaaaaggcaaagaaacagatttttccctggagcctccagaaaggaattcagccatacctgccctgccaatactgtgatttttagcccagtgaggcccatgtcttctggcccacagaaatgtaaaaaaaatgaacttttgttatttaagcccctaaatttgtggtaatttgttataacattcttagaaaactagtgtaatggccatattccccatgttctttgccttaaactacactgcctcttgcaaggaggttcaaagggtgaaaaagattgggagattggaccttggtggactttgctggttacttatgaggagcaggatggaaagtgaacattctgtaataaatactcagtgcctttgccactgtgctaatacatcatcatttgagaatttttggtctcagattttacagattatcatggggtcacagattagcattgatttctgtgttccttacccatagattcacaagtaagtcttgaatgtttgttatgcatctagcaactccatgaattttaaaaatcgttttgaaaataagtcagacattgaaggtattgagactcagatatgatttggttaggagattttttcttgcccaaacccggtgcatacctacttatggttgcctgcagcctggaggagaaaactgagcttgactc

SEQ ID NO: 130019 - DNA, 1050 bp, Homo sapiens
actgacagacatgaaagacattttgatggcttccaagttttggcagttatgaataaaggtgctaaaaatatttatgtgcaggatgttatgtggacttcagttttgaactcgtttgggtaagtatgcatgggcaacattgctggatcacatggtaagtgtatgtttagttttgtaaaagtactgtcaaactgtcttccaaaatgactgtaccattttgcagtcctaccagcgatgaatgagacttgcttttttctcacatgcttgaaaacatttggtggtgtcagtgttttggattttagccatactaataggtgtgaagtgatacttattgttttaattttcagttccctgataacatagaatgttgtgtatcttttcatatgcttatttgccatttatatatcttctttggttaggtttctgttaagatattttgcctatttaaaaaaattaggttgttttcttatcattgaattgtaagagttctttgtatattttggatattttgaaaatactgtctcttagcttttgccttgtatctttagtcttttaacagtgtccttgcagaagagaagtttttaattttaatcaagtccaatttcttattttttaaatggaacctgcttttgatgttgtatataaggagtcactgtcatattattttaactttttttcgtaaagtgtttccctgctttctgttgatcttcttgttagcaactgaggttttatactattcaaaataagtgcgattcagttcagagttatatttgcacattattctgatgaaaggcagcttcatatagtggcaagagcatcaaacattcctggatttgaatctaggctccatctcttactcattttgttatcctgaataaagtatttaatttttttgaaccatgatacattaagtatgtgccagtaccagatacatactaggtgcttgatatatggtagttatactgagacttttcttgaagaatcaagacatccagagaattctactgttgagttgttacctaaaggccattgaggctctagtcaacagttcac

SEQ ID NO: 130020 - DNA, 1041 bp, Homo sapiens
gtcgccgaccgcgctgttcgcaggcagaccccgggctgcccaccgcggcctagcgcgcgccggatggcaggagaagtgtccgcggccacgggccgcttttcgctggagcggttgggcctcccgggcctggccctcgccgcggccctgctgctcctggccctctgcttgcttgtccggcgcaccaggtaagcgcctcggccgccaggccacgcatgcgccctgggccccgcgggccgcgcgcgacccagatggcgaggggagtccccctccatgatttccagtgcagacagtcagaacttgctgcggggtactggcttcctttgggactttgtaataacaaaggcttcttctgtctttttcccacacatacgcgtacatattaaagctttgggaccgaattccatttgctgctccagcgtaagttgtaataagccctaggttggcggtatgcattatgcatcacagacacattgtgtgccttgccactgcgagttgatattttatggcctagaattcatagagcatttcaggaggggaatattcttaaatttcatcagttaaaagagaactgtttcaagaaaatgccagtgcatggtgtgaacaataactctgagtgcctctcttcctcagtttacctcactgtacctcatttggaaagctgaaataatagtacatgcctcgtgagatttttgtgagtactaaatgagttaatggagagtattttatgcagttgtcctatcatttttataaggacaaaacaaaacacacaataatgacaaaatctagacgtgtgtcactttaatttgaattgtggaagtagaaatagagaagttcagataaaatcattcactttgagtttaatctgtttttcctttctttctgggtcctattttcatactgctctggtgttcatcgcttttgagaaccaagcggatgcattttgttggatgataattgatatatgtatgtatatttgcatacatatgtatcaatgtatagatatctatgtgtgtgtgatacaggttgtttctcaatagtttt

SEQ ID NO: 130021 - DNA, 1772 bp, Homo sapiens
ttttcttgtagctcaagttgtgcatgaattactgaatattttactgtgcttttcttcatgaagggtacatgctttgtactcttcactgaaagctgaaaacatttcttgttaccctcttttgtgcctttttattttgccaaccgtgtttatagaaaggacattactaatgacattttgcagattaaaaacattcatttgaacacagtagtcccctagaaaaacaactctacaaaaattttgcagccttattcattataattttgataaaattaacacaaaatcagtcaagaaggaaacatgtatattagtgaagtgtttttggagactgtttgaatgtgaccaaatgtggttctagttgacttcttttcactttggcttatatcaattcttgagagttaatgtgatcatgatattgcaaacaactataaatggtctctaggccttactttgtgattatacgttatctccggctagaaaaaaataatggtagtaaagaaactgacaaactgaaaataagaaaacaaaaatcaaatgcctataataccataatgccagtttggtatagagtccaactttaaaacatgaattgctcgacagagttctattcagtaggtgtttctttgtattgtcttttgtgaatttattatgaaaatgctgcgttgtgttgaatgaaaaagacccaaattactgcttatgaagaaataaagccagcattgatcacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaataggaagaaattgaaatttcttttcatcaacatgtagagctgctattttactatttggagaatatgatgtgaaaattggacctcaaagggtttccttgtgttttcattgtaaaataccatcatcagtgagagtcttgagttcactaacattgtcaccttctggagagagagttaatggggggcattgaggatgatatttttttacatgtgtttggtttctgattcaagtgacacgcacaaactgaaaaaaaaaaaacaaaaaaagcaacaataactttcagggcacctattgctctaaatgcataatataacttgctgccagaaccagatgtgtttaaaaaagaaaataaaaccaccttctttctatagccattaaagcaaactttactgttctaacaaatttgtattttattttgcattgccacacatctgcttatttaaaaactacatccctttggtagtaatgtttcaggacaagtaggtattacagcttgatgtttgtgtgttctaattctaagagttctttattccagatcatatagagtagttaagacaactgtaacagcattttttgaaatacattgtaaaataataaaaggtaacataattaaaatcgagtggatattatatacttgtggtataagcattattgattatttatttttaaattttattttaagttctgggatacatgtgctgaatgtatcataggtatacatgtgccatggtggtttgctgtacctatcaacccgtcatctaggttttaagccccgcatacattaggtatttttcctaatgctctccctccccttcaccccaccccctgatatgccctggtgtg

SEQ ID NO: 130022 - DNA, 1100 bp, Homo sapiens
ttccaagggcattttattctttgtagacagagtatgctaggtttttgttcactgatgaataagaaagctgtaaactagccacttttccctcgggcacttgttttagggctagaaatagtctagaggataaaaagcactggcaatattaacagttttagaagtatagcaaagcttactagcttgaactgtaaagatctttattgtgattttattgttaaaatatgtgtgctaaaacataatttattggaatattgaggacaacatatgttctttaaacattgtgcacacaaattttttcagtcgtcttacgttcattttacttttctcaaactgtagagttgccgatttctaagtttttatgtgatttagttttagttacctgattctttctaaaggtgttgtaatcctggttatttcacaagtgctataatatacctcagcagcctagaactaattctgcaaaccttttctacagaatttaagattttattcatgtgcatggcatagaagatgaattcttccacttccaccatgagtgaagagcctgacgctctatcggtagttaaccagttacgggatctagcagcagatccgttaaacagaagagccatcgtccaggatcagggatgtctgcctggccttattttatttatggaccatcccaaccctccagtcgtccactccgctttgcttgtaagttgcctttagtaatttcaatctctgttctatttttgcagttaaggtgagaatttggaaaaagtgctagatgacaaggtaaaaaaacggaaagagagcaattagttgtttgtatttatgtaggtacaaacatatgtatgtgtggtctgtggtctgtttacaccagtggtaacatgctacattgtttttattctttatttttttttttttgagtcatctaggcctggagtacactgtggcaggatcttagttcactgcaatctccacctcctgggcttaaaccatccccccgacctcagcctcccaagtagctgggatgataggcacacaccaccatgccagccaaatttttgatattttgtagagatagggtttcgccatgttggccaggctcaaactcctga

SEQ ID NO: 130023 - DNA, 1100 bp, Homo sapiens
taagcgacagaggcgtcaggtcacctgggaagagtctgcagagcctttgcccgccagcgccttcgctctttggctccctgagttagtccggttgcttgcgatcgccgcggccggggctgcgaaccgaagggctcgctccgcgccgcctgggtctctacctcatccgtaggtgtggccctgatggtgtggcaggctctggactcctaaagctctggagcggtatgtggggtccacgggcggcagacaaagcagtggagccgggaaggccgcgggaagcggcccctgtaccgaggcagcgaatccgcctgggaggggcgccccgcctgcctcttgtcagatccagtagtgggtcccagtgaggcgctttagcacgctctacccccacgtgtcccgtgaatctgttagctttgctcatttcttctttgtcccccctcacatctgacttttactaaccccagtattattaatgggtgtcatctcatcttttcatctctccaggttattctttggtaactttctgttagttttgtgcacctgcgtgtctcctaagagcggaaagacatagttgtgttaggcttaattcaagagagaccagtgttcccatttttatatttaagactgtgttttgggagggcgggggtaggtattcgtgcagttagcaactcctttcgtgatacttagtgcactgaagtgtcagggcagtgcagaaggtacctccaacacctggcaggacagatgtccccacatgagcaagtagtattctggtttggtaattgctggtgtttgattttaccatttcgcgttcttactttaatctgataaccgctgaggattgttatgtgagataactgaggctctaagaacttaacttctcaaagttacagttaactcttcgagtaaggggaaagtcagatttaatatcaatgcttatgttatttttatcaaagcccacctaactgaataaggatttaggttaaacgtattccctctgcatctcttggcatgtgagaattaaatctttgaattgaatggtgaatcttgactgtacgagaaggaaaaatcttgcaggcatctgcctaattacaggtgtctcacatgta

SEQ ID NO: 130024 - DNA, 1025 bp, Homo sapiens
atatcttttcataaatgtattttttacttaaattagccatactaggtttttgttgcttccagctaagaatactgactgaaaaaaatacaaaagaaaacaaaacaccttatactgttacagttactttaagcaagctgatcacaagcaaatcttgttttctcttaaattacacatgaaggtttttttttttttgagacagagtctcgctctgtcacccaggctggagtacaatggcgcgatcttggctcaccgcaacctccgcctcctgggttcaagcgattctcctgcctcggcctcctgagtagctgggattacaggcatgcaccgccacgcccggctaattttgtatttttagtagagatggggtttctccatgttggtcaggctgcacatgaagttttaaaaatgttttaggcttgctctgtgagacatgtagacagtacaaattctaaataataatgatttcattttagtatttgcattttaaattttcagtgtgttttatggaccatgtgctgctatgtatgcctgaagaagtacttgaaatgcaaatttggggagactttgccatataaatgcttggctggattaagcgcctaattaggatggtttttcaacaagttggagtaagcatgcaatcggtgagtgctcaaaattcattttttaaatcccgacatttagatattttaagaattttttctgagaaaatgaaataaatctatatatgaccaacatcttgaattcaatatgtttatgtactgtttaatttgctttctatttaaatcatagaagtgaatcttttctcagcatctgaagtaaggaagtaactttctgggttacattgaaaacttaccagtattcatgtgaccattaagagcaatatatttgttattagtgaggaaaaggcttaaataagcagaaaaatcattgcataaaatatgcttggccaacacttgacagcgctcttaatgttgtagaatcattaacattgaatgctgttataatgtgtttaaacaacacagttg

SEQ ID NO: 130025 - DNA, 1847 bp, Homo sapiens
gtatgcttgaaaaaataatcacataaagcaatctgttcttttccttcctttaactttgtagaagatacctaaataatctacttattccttataattaaaagctgaatcggctgggcgttgtggctcatgcctgtaatcccagcactttgggaggccgagacgattagatcacctgaggtcaggagttcgaaaccagcctggccaacatcgtgaaaccccgtctctactaaaaatacaaaaattagctgggcatggtggcacctgcctataattctagctagatagaattgctgtaacccaggagatggaagtttcagtgagccgagatcgcaccactgcactccagcctgggtgacagagcgagactccatctaaaaaaatttaaaaaaaaaagctgaatcattggccacttctcttgttgaaggcacctagtatttttctgatattaaacagatggaaacataatagttgacatttcaccctgcaacatgcgtagtgaagaatgctaaaagcaggcagaaacatagttcctgaccttggcaaatcctttctaaatttttctttgtgagctttttgtcctcttcatctccagacaagacctttgcttgctggaggggagaaagattcactttagactgtctaattgtcacgttgtaatgcacaaatagcattccacttgtactacatcataggagaattttgacttgtgactaaatagaagactcaagaagagaaatgactgaatggtatacttacttttgccctatggatttatttgtaaaagaacaggatctattaaaatgtataaggtagggccatgtgcggtggtgcacgcctgtaatcctaggagtttgggaggctaagacaggtggatcacttgaggtcaagagttcgggaccagcctggccaacatggtgaaaccccgtctctactaaaaatacaaaaaaattagccaggcatggtggcattcacttgtaatcccagctacagtaatctcagctactcaagaggctgaagcaggagaatcacttgaacctggagggggcagaggttgcagggagccgagattgctccacttcactccagcctgggcgaaagagtgaaactccatctcaaaaataaatacataatagtaataaggtaaaaagtttgcttaaatactgtcttagaattatttgcccatgtttgttctttttttggtgggtagtctgatgttgacattgtagaacttgcgaggcttcccatttttctctagtcagatgttttcctttcccttagtcctcacgttattaagactacttgtgtcataatcctgtatgattattgatgtgaatgatgttttcttctaagcttcagagtaactttgcttcttaacattctttgtatactattcatattttaatatttttatcttcctttctacttaccagttttctaatctttgccatcctttttatttacatttccgaagcaagagctatcatttttgttggttattggagtcagtataggttataagtactttttggaactcttctaggtaagattcagtgaaactttggaaaatgtgtgataaaaattatatgaaagctatggcaggtgccaggggtattatatatccttctatgatttccactttgttggtttttttctcaggggttggggggcggggggacatggtctcactctgttgcttaggctggagtgcagtggtgcaatcctaactcactgcagcctggaactcctgggctcaagggaccttcctgctttagactctcctgtagctaggatgacagcatgcatcaccacccctggctaagtttccaattttttgtagagatggcggt

SEQ ID NO: 130026 - DNA, 1052 bp, Homo sapiens
ttctatctcttcactttttttttctttttccactaataatagctgtagtaggacaggaccttgctgggaaccttcagtaagttgtccttttctttctcaaacttcccatgcatgtcgtggtgtctaaatcgtatttccaagaatttcttaatgtcagtccttgccagggctgacttcaccttgacttgtactttactaagtgcattgtcctggaaattgtcctttgcatcccatgcctgtgtcactcaatgaatgcttccctcaccaacacctgaaacggccttttataaagaagattttcttctagttttattttgtcttttgaatgagtttgacttaaatgccaaaactattttgttttgtgggacaggatttcaagtacaaatgacatacatcttatcagttttggaattggttcttgagagcatcattaacattttcatcttattgagcacatattatggacttggtatcatttgcctaattaaggcttaagtaagatccaaattaagtccgtggaatagtttgttgtatcttgttgttttgtttttttaaagtttgtgcaaaagctggcattttatgtttaacatattaattttatggaggcattatttaattttatagatgtaaaattgagaaatgtgtttaatccttaattactatttatgatatcctgaaaatgagttaacttatatttctttgaatatgtattcttagaaaagtagtactggctgggcgtggtggtgcatacctataatcccagcactttgggaggctgaggcaggtggaacccccgagcccaggaatttgagaccagcctgggcaacatggcgataccccccatctctaccaaaaatacaaaaaatgagccaggtgtcgtggtgtgtgccagtaattctggaggcttacgcaggtgaattgcttgaacttgggaggcgggaggttgcagtgagccgagatggtaccactgcactccaacctgagtgacagagtgagacctggtctcaacaacaacaaaaaagaaaagtagtactttgtttttttgtttttct

SEQ ID NO: 130027 - DNA, 1100 bp, Homo sapiens
gtgctgggattacaggtgtgagccactgagcccagcccagtgcaggcttttaatgcttagtaagtcttatatgaaaatatacttaaaatgagtcacaaatttgttagttttctcaaatcattaaaataatactaaattgtcaaattgtatgtaatgtagacttgtttttgcagtactttgttttatatttctgttaaaagtgattacaaactgtgctgtagtcaaacttgaacatttgatatcacaaaaacacctctgttaagttaaatagaaattttccatctggatagttttggattgaatgatacagtggctgagattcaggcatttctcatgaagtaactgaaactgtcttgcttcttacataactgaaacgttaagaatattgtttttaggggtacaaaaatctttaacatcattttgcttttaaaaactgatattttctttgcttaataccagtgggattaagtttgttttcctttgtttctgtaggtgacttagattctaccacatttggtaccataccaccacaccctccacctcccccaccgcccctgcctccccctgcactggggctccaccaaagtacatctgctgttgatctgattaaagaacgaagagagaaaagagccaatgctggaaagactttggttaagaacaatccaaagaaacctgaaatgccaaatatgctagagatccttaaagagatgaacagtgtaaaacttcggtcagtgaagaggtgaggatacattcaccttctttcttccccatttgtttgtcttataaaaccaaagtaccaggcttcttgaggaattttgtttataacatgactgccatgaatagtttttagtttaaaaaaaagatgagccccagtggcttctatacacagtagctaagagattagcaaaataagctaacatttcccaggtgatgtttttagttttcccattttatttaaatatcagccttttcatgtaaagtcttcactgcagttgctcagtgagcattcactaattcaataaaggcgtgctgtgtaccactagcatagtcactagacatgcatggaacagggaactctatttgccctgaaggagagtaga

SEQ ID NO: 130028 - DNA, 1050 bp, Homo sapiens
cccacatcaaatgtcaccctcttcagaagactttcacagggtgccctgagagaaaatgatctcactgtactttgaatttctatgtcacaaaatatacattgttactatactgaatttcacttcactatgcttaaataaaaatataaccctgcatagaaaatgtaacattggagattacttagtagtgagctcaggggttaactttggctttcttctttctgctcttctacaagtttcaaatttccaaatgaacaactattattttcatagttagaaaagtaaaagtgtaaatgctaagcaaagatgtcatccttttcccaaccagccgtgatctacttgtaaggcagggaccaaatcctgtatcacctccctttggaacttacagatgacacaggtgaatcacttgcaaaatgcaagtgcttggcaatgggatggatttctacataacaggaaagaaatctgggcaaataactcaccaacactctctctgaggtggcctctgattcagactttggaattcctttttcaacttcatcttggctatcacttcgataccgataagcaaatttctttttcagagcctctgctatgagggcagcagggtcagtagcatccactggcttgggcttcacatcttgctctgaccttagagaagtgaacacaaaccaaggggacagatcaatacactggccaccctcagggaagtactttgtcaaccttttgcctgacagcacctctccagcatcatagctactccatagagacctgataaatactgctagcattgagatggaagcctagagctaatgctcaacaaaagcacacagaagtccaataaagggccatgtaatatgtctgcagaacatggactctactctccttcagggcaaatagagttccctgttccatgcatgtctagtgactatgctagtggtacacagcacgcctttattgaattagtgaatgctcactgagcaactgcagtgaagactttacatgaaaaggctgatatttaaataaaatgggaaaactaaaaacatcacctgggaa

SEQ ID NO: 130029 - DNA, 1237 bp, Homo sapiens
aaaactacatctttcttccctgtcagtactggatggcaatgacgtgaaagcagctttcctggttctcaacttcccttcaatgggaagcattatggaatttcagcagtgaacatcatctggttcctattcaaaccccagctccaagaaaatgtgagagagaatctaagatataagttctgttcaaggcaagaagtttccaatctcaaatatttcatgccaacaacttatgttataccagctgttccatcattgaatgctaaatgatcattgaaaacaaacgaagataacagtgccctcgttgccatcattcattactaattttacataaactgtttatgtccaaaaatatgcatataaaacacttatacagataaattagtgttaagaatttaaaatgtgcagtaacatccacaaatgtcctttttgtgttgtgaaatctatacaattgttttcaaaactggaaatctgaacgccctggccacatattagaaacatgtcagaacacacatgttgtggagagcaccaaagctgaccatctcacaaaagcaaaaccaaacttagtgctttcattattgcttaatccactaattagcctgaaaagaagaccactgaatactaaagaggtatttactaaacagtgtcgatttctactagcaaacttggccctcacaaatcaacaggggaaccaggagtcttttcgcagctcattgtctattaggagtctgatacattttcaattaaagccttcatttttcctgttggcttcaacatgtgtggcccaaactagaaacaaacaaaaagtataaataaagatattggttcaagtaacagtaacgatacgcccccacctcccaatcatggattagagggctgggtatgttctgcatgaaaaaccaagcaactactgggaatattaaaacctttacaaattgatgggttgttatgaacacagaacatatcaacagaatgaaaggtaaagaagtagccaaactgcttcctctaaatgaaaactacaaccatcttggcaataccctgcttttgttaaattttacttctctgagtaaagagagaaagtacaaagtttcctttccaatgtcttaagaagtttcaaaggtgctggaatttctgagatgcctgcctctctggaatagattagcacacacacgccccaggacagtaatgttaataaagggaatgtatcaattattatgtgggagcttccatgaaatgtacccag

SEQ ID NO: 130030 - DNA, 1586 bp, Homo sapiens
caggaaaaatgaaggctttaattgaaaatgtatcagactcctaatagacaatgagctgcgaaaagactcctggttcccctgttgatttgtgagggccaagtttgctagtagaaatcgacactgtttagtaaatacctctttagtattcagtggtcttcttttcaggctaattagtggattaagcaataatgaaagcactaagtttggttttgcttttgtgagatggtcagctttggtgctctccacaacatgtgtgttctgacatgtttctaatatgtggccagggcgttcagatttccagttttgaaaacaattgtatagatttcacaacacaaaaaggacatttgtggatgttactgcacattttaaattcttaacactaatttatctgtataagtgttttatatgcatatttttggacataaacagtttatgtaaaattagtaatgaatgatggcaacgagggcactgttatcttcgtttgttttcaatgatcatttagcattcaatgatggaacagctggtataacataagttgttggcatgaaatatttgagattggaaacttcttgccttgaacagaacttatatcttagattctctctcacattttcttggagctggggtttgaataggaaccagatgatgttcactgctgaaattccataatgcttcccattgaagggaagttgagaaccaggaaagctgctttcacgtcattgccatccagtactgacagggaagaaagatgtagttttccagtagtgatgaatcaaattattgaattaaatttcttcttaagaagtaaaaactcagaatgtaccatcttgtttcctttcagtttattaaatggcatcataaagatgactttgctaagttaatagagttaaaaatttttttaatataagccaaaatattaactttaatgaaacattgacttggcaaatgaatttcctataaattatcattggtcagaatgctgttttgtttaataatattacgcaacataaaccataggtgttattagaagtggagaactgcctttttcatctggggcttttaaggacttgctataaatgattattttttaaatgctttataaatcttcatggtttttctatttctgatacactcagctatagttaataccagagtatcctaccaggagtaatatttggaatatttaaatctagtaaaagaagaaagttgtacttcctggctgggagtattaggagatgggagtagagattcacttttaagttcttgaaaatatatgcattctcctaaatattaacaaaaatgatttggggaaatgacatggcttgattgttctgtttaaatttgtactgtggcttatgttacacatgttcatgttcacctctcattcacctgttttatatggtttaaaattctctttaacaaaattcagaaaattcacctgaaacgtattttgacctaaaagaaacatatttttgtatcagtattgaattttggacagtgcccccatataaggaagttactgttttaaaataaagcaaactaactgttttattttccttggaccatagtgcttccattttttcttt

SEQ ID NO: 130031 - DNA, 1608 bp, Homo sapiens
tctagtaattcttgtatttttaaaattgttggctgggtgtggtggctcacatccataatcccagctctttgggaggctgaggcggacagatcacctcacgtcaggagttcgagaccaacctggccaacatggcgaaaccccatctctactaaaaaaaaatacaaaaattagccaggcatagtggtgtgcgcctgtaatcccagctactggagaggcagaggcaggagaatcacttgaacccaagaggcagaggttacaatgagctgacattgtgccactgcactccagcctgggcaacagagtaagactgtttcaaaaaatagttaacatctatgaccgataaagttacttagccttcaaatttgattctaaaatagttttaaatgttcaatatgctactttaggtaaaatactttcatcaattacatattttagtcttatacctacatgtcctaacttgtcctgaaacccaccttaaagtctgataggatggtgggggaaagagagaaacacatttttgtttttgttttgtttgtgtgtgtgtgtgtgtgtgtgtgtgtgtgtgtgtgtgtgtgtgtttgagatgggagtctccgttgcccaggctagagtggagcggtgtgatcttggctcactgcaacctccaccttccaggttcaagcagttctcctgtctcagcctcccgagtagttgggattacaggtgtgcaccaccacgcctggctaatttttgtatttttagtagagacagggtttcaccatgttggccaggctggtcttgaactcctgacctcaggtgatccacccgcctcagcctcccaaagtgctgggattataggcgtgagccacggcactcggccactcctgtttttaatattagatttcttgttggctataatttaaaattgaagcacagtgatgtaattggtttactgaagctttccactggtcccatcaataagtctttgccaagacattccatcttgtattacaacacctatctttaagctgtacatttatttacatgacatttcggaacacagatttgaagtatttattgttgagccatgtcctgtaaagcagcaggagactgtaatgatttcccaagttcccttaacttagttgaaatcagtaaaagaagttacagatctaaagatgaattttttgaaggaaatactagaaaggatagtgcttcccttagtccactcaggctgttagaacaaagaaccagaaactaggtgacttataaacaacagttatttctcacagttcttgaggctagaaatctgagatccaggtgctggaatggtcagttctggtgagcactgtctttacagcttgtcagacctaggtttgggtccttaggcaggttacctaatcttctgagtggctccctaacctataacatgtctgttccttaaagtaaaattaactattgatatatggtaagtgctaaatcaaaggttactatggctattctttttagttcatttcttgataatttctacttatataaacacatggatacaattgtacctcataacatctttatttgagctcctggcactgattcactctagaggcttcctactcaaattcatgagggaga

SEQ ID NO: 130032 - DNA, 1056 bp, Homo sapiens
agtcctgccaccgtggcctctcaaagtgctgggattacaggtgtgagacactgcatcaggcctatagctccacttaaatacgacctatattactggaatatttttttctaaaaaattttaggaaacagttaaatatttaaaagattacttttttaaaaagcaagtaaatattacagaacagaatgcaaaatttattttacatgggagactaaaaattttcacacacatggccaccctttgggcctcttggctcaacatttcaggggctgagggagtctctgctctaggagtaaaaggtccttggagagaaaattttgacaagtcctaactttaaaaaagaaaaattggttcctggtcaatatttgtactcactgtaaatgtgatggttggtaatgatactctgtataaaagtaaaaatcatattttatgtcctttgcaaacaaatatatttgtacctgaggtacagattagaggtgctagtaattccttgaagattctgaaaatgatctttttttccaaaatgctttcttggtttttattaaactttctattttcttaaaactctcacatcaggtatttccagtgttttcaagcatgtataaatattttaatgtataaatgttgtttaaaatcccctcaatcggtatctcctgattgagaaaatacacagtgaccaatagctaataggaattcagtattgctttcaaagaaatgtgcatattaatcactgtagcatctgcatacatttgaaacacggagtaatacaggtctgtgcaagaattagcagcttgttccttgctaataatgacttgtgtcatctggaaggcccccaagagcccatggtctacaggtggaatgaccaccacttgggagtgagctgatggagagcacccagcaggtctcctccatcttcctggttcctgtgctcaccatagggctggtgtacattgggccattaataaacgtttgttgaacaaattaatttggaattaatgtgttccctttttagctatcgatttattactaagagattatattgaaactcttccgtctata

SEQ ID NO: 130033 - DNA, 2546 bp, Homo sapiens
aaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcatatttttatctttgacatttaccttataactcaatcttttggaaaacacaatgctaaattacaaggaaatcaaagttagcttcttggctcttgtaattcatccctcagatgtttactcagtccgagcttatctactaatgactcaccttgcaagtgagtaagcagaagcccagttagggctgttggagtcctgactaacacaggggagaggtcagctttgagccaggccttttgttcctacagtggtgaactgcataagacatcagcaagtcttgcaagtactaaaatactagttgtatttatttctatcaatcattggcctttttaaagtgataagaaaaggccactccactctacttgattgatatcagttgtaaacaaggtaccactgtgccattccctatatcttcccaggtccaactcattagaagggatatggtgcaaacttctaaatcaaacacattaacatattatttgtacagaagagtgttgatgtccaatagaaacagaatccaagccacataattttcggttttctagtagccacatttagaaaacatggaattaattttagtaacatctattccaatacgtccaaaatattgtatcactttaaaatgtcaatataaaaacaattagatgtttttacattcttttggggggtactaagtctttgaaatccagtgtatattgtgtacttacagcacatctcaatttggactagtcatatctcaggcacccaatatccacatgtggctagtggctaccatattggacagtgtgggtatagaggtctgagggtagtagaggaatatggtcagctggtcactctcgtgagatggccataccttggcctatatttaatgtgtacagaaagtctgataactcagatccttaaaaattcaggcccactgtttcagtacatagagagtggaactatcatggcaaacccacattaaccaagctcacagtaactatttttttaaaacactatcaatattttaatttacagtgagaaatgtaactatcaattattctctccctttaggcaaatcttcctgggaagccaaattatgagcagctggtgagcatggattctgagcaagggaagcaagttgcctcgtgcacccatgtccctttgggtgcacagaagacccatgtcttctgtgatattcatgtttgtggaccagggtaccct

SEQ ID NO: 130034 - DNA, 1038 bp, Homo sapiens
cagattggcaaataccctgagctgattatggtgttttaaacattccacctttttctcgcatgtgcaggtcaagtgtacagtagtgaaaacaacatgcaatgtcttcactgcagaatcataatacagctaggacattggtgttcttcccctcccaccccaaattaaaaactaattgctaaaaaaaattgcattgccaaacggcactggagtgaaagcttggcggtactctacgataaatgctcagtttccagtgcatgaaataaaactatagcaaatgggaggctttggtggcatccaaagaagaaaaaggcaaaccagggggaaagagctgcagtctaaagtttgatctttaaatttgtttgagtggttccttcacaatcatgctccaaggcaatttagaaccaatattttcagagttgatttgtaaacattgtcttgccagaggcagcagaggctgggcacttcacatttccattttctcagagagaacttagtggaaggtacaagatacacattgttgcatcagactggttaaattccaagagattgttgctgaacaattcaagtttcacgttttgaagattagatgctttgaaaaagtcgtggcacatatcaaaacttcctttgttactcctttcggattctctcctgctgggctttgcatattcaaggtttcacatgaaagccaaattcatattgctgtatgttcgggtcttgcaattaacaagtgggttcaaatgatccaacagaggaaatcttggaaataaataatgctggctggcatcactcacttggaaaccttggcagtcaagagttaagttctctcacctcaagaccccatttcacatttctaaaaacctccaggaggcagtttgtcccactggttctgggggttatgataaccgattttcctgaggtaataactgtgagttcaactcaaatgcagcatcagtgtcctcactgctcgactgttctctctgcagtcccttccagctggctttattcagccccacgtgtccaagcattgtctgggatagc

SEQ ID NO: 130035 - DNA, 1057 bp, Homo sapiens
aaaatgtcaagactctactgctagacccatataaattattgagttattttattcttacgatgttaaaaaaaaatgaactggatagattaattatcactcaatactgtaacttgccttgatggaagaattcctccgttactttttcactccactgcttgcttaattcccacgtccgacatgggttacaaatatcagcacatttcaaagccatctagcaaacaaaacattaatattgttttaagatatatacacacttgacaataataccaaagaaccaagtgcaaggactggattaaccataaatataaataaataagccagaaatataattctcctatttttagatgtaagaatttatgagaataaaatgctatttcttaattggtaccctaatcttgtaaaaattgttttcatcagaaatcttgagtatgaaaaacacgtaagcaatgatgccttcctaggtagcagattcaccagtgatctccttttggaaggagtgtgcgctaattgaaggaaattctttagcttgccctcaagatttaaccattctgaaaaactacactagaatattcattttttagtttgacagtcacataatttatcctagaaatagaatgtttccaagccccattttacctgtaaaaccaaatgtctgtgtctggtgtcttctaggcataaatcacctctatccaaatgggacctaaacaaagacagatactcattctggcgactgatgtctgtggctagtatcagagcacctatctgtgtctccatttgttgcctggaaatagagaaatataaagagaaaatataagactttcaattaactatttattgattttttttcttaaccataataatcggaaggctttatagaaccctaaaatatccaactatcattcaatttaaaatttatcacacaaaaaatgagttttatagaatgcttcaaaaaaagccattaaaataaccaaaactaaaaccaagagtttgtaggaaaataccaatatgcaaacattccaaaaggagagcctttattttgccagccaaggtggtatta

SEQ ID NO: 130036 - DNA, 1012 bp, Homo sapiens
gccaaggaagtgtgctctggggcagtcagtttcagtgaaagcaagatggcagaggcaatgtcaggagggaggtcaggtgcagccacactgagttaggttactatgtgggacaatttttaaagttttctattgtctattctcattattttggtgtctttaaaaaattaatctatttgaaaatgtctagttttcagttctttggttgtggaaaagtaaaacaacaaaaattaaatttttcttataatgaaacaagatgtgacatataaagttcataactggtaagaagatgcatatttttgatagacaaaaagtgggaattattactctttccatgttttatattcaaaatctgtatttcaaagcataatataattgtgttgacttgtatttcctactaatgtaatgtctcttctttctttttaggaaatagtctagtaagcttaacctttcatttatttagtcttcatggattaattgagtacttccatttagatatgatgaaacttcgtagatttttaggtaagtgattctaacccattaacagtaacaagatttacatttatacaagaacctgtttaagttttatctcagttatatcggttagctattgctctataacaaaccagccaaaattagtggcttaaaacaacacacagttatttagctcttgcatctgtggggctgttaaatgcttcttttggtctggtctgggtgagctcatttgtgcacctgcagacagcaacaggtgggctgcatgttggttttgtagagacctcagctaggataccaggcctgacccatctcggctctacatagtcttctgttaaatttaaaagaagcagaggagtttggcaccataatagatttacattaaaaacaaaaaagaattatttattttacaattagccgagctggttcaaacagtagtggcaggtttccgagagagctgatatccccaggccgctggagccctgggctcagaatcggcccaccttcacttctgcatgcagca

SEQ ID NO: 130037 - DNA, 1051 bp, Homo sapiens
gacttgtgttcttactcactggtattataatcctcagttggtatcttgcatgcagcttttcaattacatatgggtagtacactttaagagactgattcttgtcagattcctttggtggggacattacatgtgtttcttcactgcactttgcctgaattccaaaagagggtattttcccattagattgtagctttcttaaaacttattctacatcctagaaatgggtaatttgttttgttacatttgaaaaacaatttggagaaccttatgataatctaaatatacagagaatgaataaacattctaaaatatttatatactcgaagatggttgttacagcaatagcaacagacacgttgttcacttcttcagaaatggctccacaccacatggactcgtgtttgtaccaatagagcatatcaggacctgaacacattttaacatttaatttatttaaaatgtaagatttgaaatgcttttttctttccacatgaaggtgatacgtcaggtagtttttaaaaatagtctcttttggcctgccacatcttttctgtcattgcttatgcaaataatgctccaattaatgtactttttcatcagctgtggtcttttgttggcagttggttaggcagttttagataacaaggttaaccaaacagtcctttattatccttcataaatattattattataaattttcaatttgggactagtatgtcttttatacatttttgtaagagtcatcatagacgagagaatactagaatcgtgtattttattgcattatctgaatgttggcagtaatttatgagtctatgtgaaggatgtagtctacttaaaatagactttttaatatgtagcctatttaaaacgtggtctatttaattgttaaaataatatagtatatgtgtcctatggaagtttacaaaactgagaagtataataggaggtataaaaaatggagagttacaccatggaagggaaaacgaaacatcataaaaatggtagtttttccaaatttaatttctattcttggtgtgactccacttgt

SEQ ID NO: 130038 - DNA, 1080 bp, Homo sapiens
ggaggctgaggcaggagaattgcttgaatctgggaagcaaaggttgcagtgagctgagatcgcgccattgcactccagcctgggcaatagagcgagactgtctcaaaaaaaaaaaaagcaattcagctaatgttttgccccagagctgaaagtacactgagaggaagtcagtgctgactttagaataatgaaatcactgctgtactttgaaatcacctgctttttcttattgctttggaatgaagctcctttgataaggatgccaaatatgtaaaatgaacaaataaattacctttatttttcttgagaatcaatgtgggtcttttagtatcactccattattctctgtaagctgtatggcaatgcctagtggaaatacctttgtctataccttctgtttgcttatgcagtgttgacagaaaataaactggactgatcctaggcaaaattgtgaagacagtgaagtttgtctttatcagcagagccaccctcctgcctccctgcctttttattcctccccttcgctatctctcttctacttttcctttgcccttggtgattaagtgttctgttcttctccctgcccccaccttggcccgtacacacaggaaaggctctgatatcatttacacagttagccttcccttggcccttctcctttttgaaaatacaggtagtgaaatatcaagtggcccaccttcttcttgctcagggaaattcccctttcctaacttaacacaaatattattttaggtattatctcaaggcaaatatagatgaaacaatgccactcttaacattttcaaggtttagccttacataaactctcacagctcatagcctattattagtctactgggacacttgtcactcattgaaatagttgattgttcttctccaaattttatttttaaaaagtacatactctgctagttgggggcatggtgatgaaagcggcgtgagctcagcagtgcactggatgggcagaagaaatagccagcagtccacagtagttaactaagcacttcgctttccttttgatcacctcactctttgaatgggatttgtggacagggtggc

SEQ ID NO: 130039 - DNA, 1029 bp, Homo sapiens
gagaccctgtctcaaagaaaaaagaaaacaacatctgatagtgttgttcttagtaataaaagagtgagtaacttataacagtacctggaatacagtaaatactcagtagtgtcacttatttttattagattgtttgcaatttagtttctaaaccatacaacatttgaaccacacttctgtgatgttaagtgatactagaattcttaaaggtttgcaagactgtagcaataagctgggaaacataaccttcctgtgcattcattaattgaaaaacaaaataatgtttcatttttcaaatggagtttatccctttggcatttttttggagccagttgaaaaagtcatgattaaaagaaaaatgatacttgtattttttaaagtaaatcaatcactttacattttctttaacttctctatggaatatctccaaaagacaatgttattgaaattaaattacagtagaaatgtttggttttcatttcagtgtatgctggaaaaagttggaaattggaattttgatatctttctatttgatagactaacaaatggtaagtgaagaatttgacttgctcaagttaatgtagtctagattactgcattgatggtgcagccgctggtgcgttgctttcatttactgtactaaggttgttagccctctgctggaagagagtgtattagtccattttcacactgctgataaagacatacccgagactgggtaattgagaaaaagaggtttaatggactcatagttccatgtggctggggaggcctcacaatcatggtggaaggtgaaaggcacatcttacatgttggcaggcaagagagaaatgagagccaagcaaaaggggaaaccccttatgaaatcatcagatctcgttagacttatccactaccacaagaacagtgtgggggaaagcacctccatgattcaattgtctcccaccgggtccctcccacaacacatgggaattatgggaactacaattcaaggtgagatttggctggggacacagccaaaccatatca

SEQ ID NO: 130040 - DNA, 1035 bp, Homo sapiens
tgaacatcagggttaaatgagcttgtttttaaccaaatgaggattttaaataatattaaatttccaatgtattttaagttatatttgacttaatatttacagaccagattcttgagtttgtgtagataagtttttaagttgtgtaggtaaagctggggtgtcttctttacaattacatgaaagtgaagaaaattacttccctgtttagtaaaagaaatcagtggaaagcgttcatgcctgctttaaatgttaaaatgtttacaagttctgccttttagaatgagaatattgatctctatgtcatttgttgttattagtactgttataattaatgatttctactagtagtatcttagtgttgctcatgtcagtgtattcataaatgtatacaacagtgaacttttggatataaaatataagtttttttctagaaaaagtccacaaaaggttcaggttaagaatgtatggtataaaaatatttggtttttagggcctttgtgggatttatttgcttggctgaagtacacattatcctaaaagttaatgtagtaaattgtgttattttataagcatatttagataatataaatacatatccataagttagaagtgtttttttaaaaactgaataacaaataatttaagcatggtgtggtatcagtgtcagatgcctaggttctagaaacagactacctaatttaagatcccagctctatcactttatagctgagcaagttagttattttttgcttgtttctacgtccctaaaatgagaattgaaaacaatgcctgggctgggtgcagtggctcatgcctgtaatcctagcacgttcggaggccaaggtgggagaatcacttgagtccaggagtttgaaaccagccctgggcagcatggtgagaccttgtctctacaaaaaaaaaaaaaaaattagccaggtatggtaacacatgcttgtagtcccagcttctcgggaggctgagacaggaggattgctcgagcccaggaggtcatggctgcagtgagccgtcttgttt

SEQ ID NO: 130041 - DNA, 1048 bp, Homo sapiens
tgaacccaggaggcgaaggttgaggtgagccgagatcatgccattgcactacaacctgggcaacaagagtgaaactccgtctcaaaaaaaaaaagattgattactcttattgttatgggttaggcatatttttactcttcagagctgggatgtgggatatgctggatccctcttatgctgaaactcagacgctgaacatagcatagctcctcagtcattaaattcttaattcccttattaaagtaagctgagaaagaaagatgaaaagcaaagtacacaaagtcttaatgcagttccttcaaaacttaacatacaaaataaagctgaatttccaatgtcaccaacttgccaaagcacaagtaaaattaaactaccattaaactgtattaagattaaggtccaatacgtatcggtcaatttcctaatttatgctatcgagttaaggaagatatttagaagacagaacattctgttctttcaactttaggacaaacaagaaacaaagattagtggttcttaaatgtaggcacttatgaatcacctggaaactaggtgaaagtttttttaaaaactgcacatacatggggcagaatgctctgtgtcctaatgcaattcagtacagcagtgctaatctctacaagcaccactttgtaaggaattacaatagaaaagagataggagcatgggtgatagaaaagacaggaaaaagggacatgggattattgtttcctgggatatcgccataaactattaaagaaatgtttgctctgaaacaacctgatatgacttcaagagaaatgaacgactgggaagaaattaaaatttaatagacactccagacaaataagatcttagtctacaataccataactacaagcacaggctggcaaactcgagtctgaatgagagactaaattacaaatgatggatagctgctttcgcagaccaaacagataatggttggaaaaaagtatgcttgtgaataggaaactaatgaccatgcagtacagtatgaaagttagataagagaaaaatactataatgaaga

SEQ ID NO: 130042 - DNA, 1045 bp, Homo sapiens
ctacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggctcgcccattatcttgagctctgtattcattttaacagttaacttcatcccatgctagggcagcagggggacctttcaggatatttacattgtagcctataagctcttcactttaggcttttagttttattcatctttttatttctggtctctggcagcttctggctcatagtagagactgagtatatttttattgcattgaattgactatggctgtgtatctcctacagttagattttacaggggcctgtttgtagttctctccatataatctgtattaactgttaaccaagttcaggctggttgctgcctttctgttgaatcatgtgtctcatattgtctttattacaatgactgtatgaaagcatacagaattttccctaaatttcgcttagttcctcatgtgtatttgatttggagttgtttcctgtttttctgataagactgtgttagactttgattatttgtttcatacttagttgtattatgacatgaaagaagatgtttcttaaaagctcatatcgtactgattatattgtcttagtttatctcagtctttaatatctagtaactcccatacaagggtagattctgttatatttggaagcttttagtgcttttccccttttctttaggtgtacaaatagtttgctcagcatttccctcagccatgcagctttcttcattatagtatttttctcttatctaactttcatactgtactgcatggtcattagtttcctattcacaagcatacttttttccaaccattatctgtttggtctgcgaaagcagctatccatcatttgtaatttagtctctcattcagactcgagtttgccagcctgtgcttgtagttatggtattgtagactaagatcttatttgtctggagtgtctat

SEQ ID NO: 130043 - DNA, 1174 bp, Homo sapiens
gaggttctcacccatatattgattttcgtattttccactgtaagtgttggtagacatgaagtttctcggattttcactacaaattttaataaaattacacagttttccaagggaaaaagaataccagaaaaaaaactctattatgtttggaatgtttttaaaacctaggtcatgtaaatgacactatttctaggtaatcttagtaaatacttagagacaattagaagaggaagatactaaaatatgaaagttgatatagcttttctcttctcctctaatttattacttttttttctttaaaaagatttttttaagttgttttattccaaatggttagtcttcactacttcaactgaaatgtttttgtgcaaatgatattttataaaggtatttcagtagtttaacttatcttttaggtttatttgaaaatgtatatcacctttaaagatgcttggtagaatgcctatttcaaaaacaagcattctttgtggatttggcctatagtggagggaaaggggaaaaaacagaacttctaaacaccttaaatattaaacatattaaatctgtttctggaggagttccactttcagtaatgttagctaaagtaatttggattgatgctctaaaaaatgagaaaactattcaaaatgtaaaagacatgtatgtattcaaatgtatctgaatgctattgaggcagagagataagtccagaacttcaggccacttttcttcttaatagcatgtactgattctgggaaaggtggattagaagatgggcagagctttttatggacacttagggatagagaaacaaaaacaggtgtttagagcccagcaaggctggaaggttggtgctggtaaaccattcaggcttcggttggaatcctaaagtgctatgtcttagaaataaatcccaactttgaaatatctcactcaccgaatacattaatgtgatctgtgactcatgtttcttgccacctgcaggacagagatgttactcatcccttaagtttgctagctgcaaacagagccctgggacatgtcctaggcagagagtagtcagggctttgtattcttgagacatcagtaagaatgtgtagggacactcggggcctcggaggaggattacctctcccagtaacaaatgaccccaaaacttattggcataaaataa

SEQ ID NO: 130044 - DNA, 1036 bp, Homo sapiens
agcacagcaagtgttagttaatatattatcactcttaccgtgtaatggaaatggcacttgcttttgctaataaatcatttagtggaaaacttggaacaaaataaaaacaatgacacttaaaatatctttgctgggttttaaaacatgtctgtctttaaaagttatgtattaactaatattgggaacaacttttacaccttttatcatttaccttcaagtcaaatcttttgtggaagaatgattcaccctaattcaaggtgagtcttaccagggcactcagaactcctgttagtgaggcagtgggtcctttggtgctttacagtttaacttgtttgtgctactgctgacagtttctgattagctcagcctcgcccatgttttgacctatactagttcgctttacaagctgttcccaggatggctaaattagaaaagtcacgagtagaagcctctcagttatttccattcactggtgaagtgaggtgggaatgtgggtgatagctctgagagttttatgactgacagtgtgacacaggattttgatgaaatttgttttactgttattaaaaagaaaattctagtagtatatggtttttaaaatgataatctttaaagaaatcttttttacatttgcagcagtcttatataaaagtagatataattatttttaaaacaacatgattctaacacggaggtcaaatttttattgttagaactcataatttatagtgttttttccaaaatgagttactgtagattattctaccttcctactttagattattctacctagtgagagaacttaatattcattttaattttaattcttaagtgggtaggtgaatgaattatcactcaggatgtatttgttgatgggttcagatatttattttaaagtccattctttaaaaacagttttggtctcatttggatttatttcataaaagctatgtcttgtggttcagtatagcatttaagctaagtatttgtagactagccttacttaaattagtaccttataatgaatagaataact

SEQ ID NO: 130045 - DNA, 1026 bp, Homo sapiens
ctacattttgttagactgttaggtcagcgctcactaaagtcttttccctcccctcttccaacattacttaggcagttctaccccaaccctgcggttgtggcatgaagcatgcgctgggtaagaaggctggctgggtagtgcattcccagaggagtcaggtgatcactgttggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaaggtaggccatctttatttttaggatggtgacattcatcattagtttacatatttgataggaattaaatagctcgattttctcctccttttgcctcagtttttattctctgattaaaagagctgtgagtttcatctgtcgaccaaagggcttaaatttactatttgtagtttttgttcttatcccacattatttcttcttaagggctttttataatatctttcctcagtatcaaagcagcattcctcagtatcactgccttaaagaagtttttatgactaaagaagtttaacttttaagattataaaattaagttatacttttggtgtatatattttaaacattctctcggagaaaatgtaataacacttgtgtatttaaagtataatgttgaggatttctaaacaattataaactttttaaaaacgaaaaaccaccgtctatcatgttttctcctaaggtcttgctactgctaaaatacgtgccttagctataatataatgacataaatgtaggattacatatatgttgtttttgaagttgaattctaaatgtcaggcttgagaaattcttgatagaatgctagctagccatttgccatctggagaagggtctaaaactaaagtaaaacatatttaaaattatactctttgaaa

SEQ ID NO: 130046 - DNA, 1006 bp, Homo sapiens
tttctctttatacctatgttttagagatgttaaagttgacacgactttcttgggatggagggaattcattctaaaatgaggaaataaattgggtaaaagtatgacagtggtaatgccccagccatgttcaggaaatcatgagtaactatttggcttgaattagggtaggtatagggttaaaaaatgaaatattagaattaaatttgtgccatgagagagactttaaaaatgatattctgtctttgtaatacaaaatatcatgctgttggctagagaaggatgtgtgataaagtgctggtgtatgcagtttgataagagggttacatattgtatgttctttgctgtgtccccttttaaacctttgtcatatagatttttcttaccatattagtttgaattatatcagcatattaaaagagatatgttggtatactgaatgatgcatattttttctagaatgtgtatgtgtgtctgtgtgtaggagaggtgcaaggagagatgcatatacacacaccttgcctctgctggtttgttctcccaatcgtatcctctgtcctatggttcccaactgctggtggcaaatcccaagagaatttgggaattgacaggagcttcatgaattcatgtatatttcagaaagtaaacttaaaaactctcatacatatatataagcatatttcaaatataaatactgttgtgatgaattaaatccatttaaacataaattcacaataatgttatgctattttgtacttttctcagtggataccagaagaaaaaggcctatcttgtgggtgtgtgcaaactattttgccattaaaaggggtttgtcattcttcaaaagattaaacaccacctattccagccatgtcttgtctcctgaaagtaaatttgtgatttagactgtcaaacacttgggaaaatttctgactggtttaacattgttaaatgcacacctgattactgatgcagctgactgaaaattgactattacgttgagtaccaa

SEQ ID NO: 130047 - DNA, 1042 bp, Homo sapiens
actgaatgggggtggggaagacatgtacagaactggctttcctgaaacagtgtgagcaggctccagtatgacactcgttgtatcagccagaatttctttagtggcaagtaacaaaaaacttgttccaaattcttgtatacaataagatttacctagaagacccagggtttagtggctccagatatggttaattcagcagctcagaatcatcatcactgacccatgttctgtctcttttgctactgatgtaatacaacatgtcagtagaataaaaaaagccatgtgctcatcccagtagatgcaggaaaagcatttaacagaatctaacaccattttatgataaaaccatccagaaaactaggaatagaagggaacttcctcaacctgataaagggcatctacaagaaacccacagctaatattgtgcttactggtaaagactgggtgttttccctgtaggaccaggaacaaggtaagcatgtctgcttgtgttacttgtattcagcattgaactaaaggttctagccaagtcagttaggcaagaaaaataaaaaaaacatccagattggaaaggaaaaagtaaaactatctctagtcatagatgatatgattatctacatagaagatactaaggaatctactaaagaaattttagcactaataaatgagtttagcaaagttgcaggatgcaagatcaacatacagaaatcacttgtatttctgtacccttaaagtgaataacctgaaaatgaaatggaaacaactcaatttttaatagcatgaaaaagcataaaatacttaggaataaatttaacaaagggagtgcaaagtgtattgtctgaaaactacaaaacaatgttgaaagaaattgaagatctaaataaatggaagaatgtcccatgttcatggattggaaaacttaatattgttaaaatggcagtactccccaaattgatctacagattcagtatagtccctttcagaatcccagctgattgctgtagaaattgacaaagtgatttgaaaaaatatatggaattgc

SEQ ID NO: 130048 - DNA, 1185 bp, Homo sapiens
cataacaaatacaataattaaaaagtttgaaatattgtgacagttatcaaaatgtgacatagagataagaagtgagcagatgcagttgggaaaatggtgccagtagacttgctaggtgcagttgccacagaccttcattttgtaaaaaaaatgcagtgtctgaaaagcacaataaagcaaggcattcctgtatcttctgtgagttgtttctattggctcttgtttttgttgtcaacttagtatttttatatcaatttttgaattattttgtattgagaaagaacattttgtcatatttgtgggaaactttccctttttttgccttatttttaatgtcctacttgtactgccagatcttaactagtaagtctttagttgctgtaatgatgtaataatagcagtacgtttattattaataaaagtttttagtattttataaatctcgcacatgtaaactttttgtcttcaatatactagtttgataaagattttaatatattgcattggctaattgtcagtaattaatgactagttatctcttcatgtttttaatatatggtaaaggtgacaagataaatatttttctagacctgagaatgtggaatgggagggaaaaatttttatgcgtgtaactgaatgtactacagaagcactcagtgttaaagaaattgccacacataatctccccctaaatcaagtatttttaattttgtgatgttatagtaagaaaaatagaaaataagacccatttagacagattagttttctgaaacttttaagtttttaaggagaatttatatcttgcaaacatttaaagggatttttaaataataataacatacaagaggacaatttgaaggtaaaagcagaacatagattacctgcaatctgtagaaacatcattattcagtttaatgttttctttgtctcacaatgaaaattctccaaattcatttttggagaaaaactttgtggaagtgactttaaggattttggtggttggcctcagctcatttctatttgaggtgtggtttttcaaactttttagaggttttccaccctcttctccccatcagtggtatttttaaatgtctttattttaatgttaggacaccttagagcaggattcaagtgggctgtgcaagaagaaccactggaaatagaaaaataaaacttgaagatttt

SEQ ID NO: 130049 - DNA, 1034 bp, Homo sapiens
tctcagaatgtgaccttatttggagtaagggtctttgcaaatgtagttaagatgagaatatatgggattaagacagaccctcgattcaatgagtggtatctctggagtcccagaaactcagacacactcaaggaagaaaatcatgtgaagatggaggcagagattggagtgatgcagccaccagccaagaacaccaaggattgctgggagacatcagaaactagaaaggggcaaggacgattctcctctaaagccttcaaagggagcatggtcctgctgactccttgattttggaccttcagcctccagaactatgagagaatatatttctgttgttttaagccacccgatttgtggtactgtgttaatagccctaggaaactattacagatggttttgattatttcaaatttatttgttcattctttcaatcaaatttactgagcacttacatgccaggcactctgctaggtattacagagataaataagacattgttcctgccttcattcttggggtttgactcagtagaaaaagcagctttgtaaatagacagttgcaatacattttgatacatgttttcactagaatgttatatgaagttaagtgatggcacctgaagctaggagaacctgggatgttttacgaagtgagatctttgtgtttggtttcaaagatagagttgaaaccagcctccataggaattctgttttattctgccactgcagtgctatcagtcctacctagttcaaagcatatttagccggctgcaatagcctcctgtcactagaattctacctccacaatttggttgaagtaatttttaagatgcagtaagattgtgtcagtctattgaaaacatcagtgtgttctcatcacagtaaaacacaattcaaactccttttcatgatatggccccatgtgatctggttcctgctacctcttcaatctcttggcctttcacagtggtcttcctgctgtttgtgaatatgccagctttgttctggtctttgtctttgcattggctgttttgt

SEQ ID NO: 130050 - DNA, 1136 bp, Homo sapiens
gaagcttacagaattgtgatagagaaaatggtatgattatatgtggtgtaattattatactggagttatcaaagtgttatgagatgataaggcatgtatgcctaaatttctggtttaaatcaggattagccttatgtaatcgttgaggctttcttaggccaaggactgaaggtgaagcagttgtttctagacaaatgggtgaatgtagggggaggaggaaggaggatggcccacgtggatatgatcagagatgtccagtagaactttctgtgatgatggaaatgtttttgcactatctgatgatagtcactagccttatgtggctagtgggcacttgaaatgtggctagtatgactgaggaaatgaatttttacttcagttttatttaaatagctacatatggctagcagcttttcaattggcagagcagaggtattgtcaataaactagagtgaagtcatgttaatctatgagcaacacattctctgaatgttgaacatttttgtttttaggttttcgttgatgtatgcaaaacttcatttaataaataccttcatgcatgcttgataaagtctttaaaatcactaggttgggtcaaaaggtaagaacatcttttgaaattcacaaaaggatctatcctttgatattaccaaaataggtgatcctgtctgtttcatctccaatcatatattattagacattttataaacattttgctactatagtagatgcagtgtggtacactgagtttgttttaaattgcagtaagcaagagtgtgctttctgaagtattgcttgtgctatttgtatttgctcttttgtgaaattttatttgcatatcccgtgcttgtttataagggctcttgtgtacccaacatcagtatataaatgtgcattattccaaattactgttagcataatagttgcctctttgcaaacttagatacagaagctgatacagggactagtgtggccagtgagtgggataccccaagggaagtggttatatttatgagaccttcctacctgtgtattctcaaaacacctgttttgttgggaccttggcttcatttctgttttcagaaatgcttcatactttgatttaaatttaatactaccatactttagctttcact

SEQ ID NO: 130051 - DNA, 1821 bp, Homo sapiens
ggagcgcctccccaaggagaaggtgccccggggctccggcaagaaaaggaagtttcaaccccttttcggggactttgcagccgagaaaaagaaccagttggagctgcttcgtgtcatgaacagcaagaagcctcagctggatgtgactagggccaccaataagcagatgagggaggaggaccaggaggaggccgccaagaggaggaaaatgagccagaagggcaagagaaagggaggccggcaggggcctgggggcaagaggaaagggggcccgcccagccagggagggaagaggaaagggggcttgggaggcaagatgaattctgggccgcctggcttgggtggcaagagaaaaggaggacagcgcccaggaggaaagaggaggaagtaatagtttctaactgtcggacccgtctgtaaaccaaggactatgaatactaaatgttaagttctaggcaattatacggggactcagaaggacctggccgctgccttcattgagtttaaagggacaggattgcccttccgtcaagaaagtatgtaagtgttggactgcacaaattaatgtttttcccacaaccgagactttggagattaagaacttatttgaggatttaagaattagggaaataatttggtggaaaccgggaatgagttctattcttaaacagcctttttttttctttttaatgttggatatacggcgaggtagagttggccatatttcagagacttagattgacgtatatgtttctgcattatttttacaacaagtttgtgtatcagagcgggagtgcgggggagggaaagaaaacaaacagtttcagaattgaataggcaagtgactgttttaaagattaagtaataaagatgtcttatctagtgtgacttttaactttctgactactgggtagaaattgtacttgaagccggttacctggatacctggtacagattatttttgtttactttctgaaaaacacaaagcaggccgtgcgcagtggctcactcctgtagagtcccagtactttgggaggccggggcgggcggatcacctgaggtcaggagttcgcgaccagcctggccaacacagtgaaaccccatctctactaaaaataaaaaaattagccagacacggtggctggtacctgtagtcccagctacttgggaggctgaggcaggagtatcgtttgaacctgggaggcggaggttgcagtgagcccagatcacgccactgcactccactccagcctgggcaacagaggaaggggccatctcaaaaaaaaaaagcagttcaattataatggtttcagtgataccacttctaaacttatacttcttttggtatcaaatataatattcaaagtagtaaaactgatgtctgttttttaaaaagattttatgcctttcaacactgaacacatggatttcctgtaaatgatcaatttgggcttcattgactaatggtaataatcctcattaatccagaaaacacttaaatctttctctacgtttatatccccagttgtttgtgtgtgtgtgtttgtttttaagcttgacgtcaggtatagttttgtttgggggaagaaagaaacagacccataagatccttaattaggacattattatctttttttaagttccggagtagatgtgcaggatgtgcatgtttgttacataggtaaacgtgtgctgtggtggcttgctgcacctatcaacccatcacctaagtattaagtccctctgcccccttctatcccctgcccccaggccccaatgtgtgttgttcccctccctgtgtacatgtgttctcatagaaca

SEQ ID NO: 130052 - DNA, 1033 bp, Homo sapiens
agagaagtcgaccgagaagtgagatgcggtggcgacctcggagcgcaccgggtgtgcgcgcagctggggcctctggggagcggcgcggcggggacggaggagagctcggagcccggggctgcaactgggcagagaaagatggggaccagggaggtctttgggtccaggaagttctcctggaggctcaggtctagagcctgcctgaagaaaaattagacatcttgaagacactgggaaatatataaggcaagttcccagcatagggtagtaagtaagaagaggcacacagagttaaccttgggccgatttggtcaacgctcctaacccagtaagagctggggcttcatggagaccagagacccccatcttaaacttgcatgtacccccagagcgtttatctcagctgcccgcaggcatttgataggaattgctagagtaaatgaattcgtgaaagaatgatgctacagcgctgggaagacgctgagtcaactttttgtccatcgtgatttctgggtctatatatattttttctattgtacagtgtctgccaagaactaccaatttgatagcatcttagcactagactgcaatgtgagttagcttaaggcttttcattttttggtctctattttcaccttaggttttttttgctgtcgtttttattttccctaggtgccagtgcccaactcattctcatacttactcccaaggtaatacttctgtatttttaaactagccacaattttggtttctgcatttggcattataatacatttgggtagtgtatgtaaagaaaaccaaggcatgtgagagcaaggtccatgaaaacagttaccatttcactgtgaaattgataacacgtaactctatacaaagttagctgaatgtatactactaatcacgtgtttgtttgtctcaaatatctatttaatgctacttacaacgcttttctcttttaattacttgccaagtctaaaaatgcacagataggattttaagaatgtctgagtttgtcaaacagaattaatcaaga

SEQ ID NO: 130053 - DNA, 1098 bp, Homo sapiens
aggtaggcatttgaagctaagggaacagttgagagtttatgatgtgtttgggaaaagacaagtcattcaaatgacaggagctgaagtttgcttaaggaagtgtggtgcgtccacacttctttaagtgagaccaggtgggagatgacctggaagaccatgctaaggagtgtatactttatgctctaggcaacaagaaaccatttcaggtttttagaaatggactggccaactctcaaatactccctacacctaaacctttttatttttttcagatggctgtttcaaatattagatatggagcagcagttacaaaggaagtaggaatggcaagtattcgagatgtctacggtctcctactgtaaatgttacatatctcacaagaccatgctaaatgacaacaatcacatcctctatttttaaaaatgtacaacgtgagtttgccagaagagtctattgcagttctagtggagttgaacctaacttataggttttcttgtaggacctaaaaaacatgggtgctaaaaatgtgtgcttgatgacagacaagaacctctccaagctccctcctgtgcaagtagctatggattccctagtgaagaatggcatcccctttacggtttatgataatgtgagagtggaaccaacggattcaaggtattcttgtattgttgttattgtttctttactttaagcagaagctaactgttgattaaaacttgcccccaaccaggcgtggtggctcacgcctgtaatcccagcactttgggaggctgaggcaggcagattgcttgaggtcaggagttcgagaccagtatggccaacatggtgaaacactgtctctactaaaaatacaaaaattagccagtcatggtggcaggcacctgtaatcccagctacttgggaagctgaggtgggagaatcgcttgaacccaagagacataggttgcagtgagcggagatcgtgctactgcactgcagcctgggcaacagaatgagactccgtctcaaaaaaaaaacaaaaacaaaaaaaaccccacaaaacttaccccaagccttagttaatggcatggcaatttatttctgaaaaatataacatac

SEQ ID NO: 130054 - DNA, 1781 bp, Homo sapiens
aagagtttaccccagagaatttgagagttcattgagtaggaaattttcttctttatgccacagtgactgcagcactagtattcctgatattgaagcataccttgaaaacgtctttggcaattacatatgaccaccttacatctgttttcagccactgctttctaagagccatgtagcacattctcttaatccatgtaaaatgatttgagttcctggcgtttaattaacatagaacttttggggaaagttattatatagaagatcacatctataacatagtaatctttaaaataagggaaggaaaaaaacataagcttgattttttgttatgaatatatttcctaatttgtaaataaagcattcttggctcattttttgacattacatcctctctttaaatcttttgcaaaattttgaagcaataaagactaacatttatttccatgttaagactcatttgatttggggggaattattggggacaagacttttaaactgcctccataggcctgtaagcaatatagatagctaaaataattgactttttaaaaacttgataaaaaatatttcagtatatattttaaaacattattattaaaaaaatacagtgccattgttaaaacatttttataattattgtttataaaatatctaatcagttaaaataactgactttaagagtctaattgtgatatagatagctattttaataattttcatgtcactattaatatttcctttctagtcaaattgtgaatgggaaacagtggtttatgggaagacagaagaccaacttattatgactgaacaagcaagaagatatctgagtacttacacagctaccagtagtacttcaagagctctcatactgtaattgttattaaaattgatgaaatgccccactcccttactgcagtctctactaaattaggttgcagtgaaatttttctcaattagttgtttttaaagttgtaagatagcccttttaatacagcatcttttttctattctatatagtaggcagaaagctagtaagtcacttaaggggtagatagtttcatagtttattttttaagagatgagatttttaaaaattgtttttaaagaacaagatgggaaaataatagaatgttcatggatttctaaaagtaaattctcatatattttcttcacaagatatatgttgctactctcttgatgctgcagttttgttatagataggtgtatgagtatatatgatttctgaaattagtctatgtatggaaagcacacatgattttatgaagtacttttgcccatgtgctgatttacttaggctaccatttacaaagaaacacattgaaaaggaatttaaaggaaggatagaaagttgcactactaattttttgttttttttttcagaagcagtaaaattaactacagtgttaaatgtatttatttgagcatagtactgaaaacaaaaagcattcaaaaaagagttttttctttattagtaaatagtattttcttaatctcagaggagctgagagttttgttgaatgtattgtacagtatgtaggagcaggagaactttgtaaattggaaagaagtctgtttttataatttatttttatttttaaagcttaaatgtagatatttatacgtatacagggtgcctagaagccaatgttgtttcctgttattacagctaacacagtaaagaataattttgactttaagtatgaaacagtagtaagttatagctgcaaagaatacaatatctatactgtatgtcacatcta

SEQ ID NO: 130055 - DNA, 1421 bp, Homo sapiens
aggacagtgaaaaccaactgaaatatagtgtcaaactttgatttcaatcatttctagtactttttcaaacatttctagtacttttttctatattaattctttttttctattttaagatgattgattgaaatcagaattaccataggtgggcatactttaaaatagtcttagaatgtttaaatgaagcatatatatatgtgtaagaaaatttagcgtgtgcttaaattgctttgctttcattaacttgtatgaaatcagatcgtgactataacataaatatctaaatgactggataggtttagaacacctactattagaagatctatactgggtaccacaccaagaactcctactccttttaagaatgcgcttgctgctcaggagaaaaaatatggacctcttaaaattgtggtatgtatattcattttatttttaataattttcctaattttaataaaacacaaattatgatttttatcactttgatttttaacatttaaaaaaagatatttactgaaacagatacaaagctttatcttttgattttcaaggttttttttttgttttttttttgagacggagtcttactttgtcgcccaggctagagtgaagtggcgcgatctcagctcactgtaacctccaccccctgggttcaagtgatcctcatgcctcagcctccttagtagctggtattacaggtgcccgccaccacacccagctaatttttgtatttttagtagagatggggtttcaccacattggccagcctggtcttgaactcctgacctcaggtgatccacccccctcccccccacctcggcctcccaaagtgctaggattacaagcgtgagccaccacacctggcctaattttcaagtttgaatttgtgttcacctttttctttaacttgtaaataaacccttgcttggcttgttttgaattcttaactttatagcatctagagaaaacatcaggtgtcagtggaactcttttcctttttccttttttttttttttgagacgcagtcttgctctgtcaccaggatggagtgcagtggctcattcttggctcactgcaacctccgcctcctgggttcaggtgattctcccccagcctcctgagtagcttggactacaggcttgcgccaccacgcccagctaatttttgtatttttagtagaaatggggtttcaccatgttggccaggatggtctcgatctcctgacctcgtgatccacccaccttcggcctcccaaagtgctgggattacaggagtgagccactgcgccctgtcggaacacttttcttaatactgaaatatacattttagtagtttcagtcatggttacatgtattagaataaaataattttaatattttgatatactgaagcactttcatgataatatttaggaaactaat

SEQ ID NO: 130056 - DNA, 1015 bp, Homo sapiens
ttttgctcttgttgcccaggctggggtgcaatggcaccatctcggctcaccgcaacctccgcctcccgggttcaagtgattctcctggctcagcctcccgagtagctgggattacaggcatgtgccaccacgcccggctaattttgtatttttagtaaagacagagtttctccatgttggtcaggctggtcttgaactcccaaccttaggtgatctgcccgcctcggcctcccaaagtgctgggattacaggcgtgagccactgctcccagcctccaaacaatcttcttatagcatctcagttaatgctctttcaaaaggagttaggtggaataaaattctgaagttgagccacttgtcaaaggcaacagttagtaagagatgaagctgatgttttctgaaagtgtttggcagaggctacaaagtttaaggaggaagaagggagtttaatggtcaaacaaacatggagaatgctgggatattattggaggtatattttgaggctggggagataagcaggatctggcagaacacagatctctaaaaattgtgcacccatgcttcaggggatgccatttctgtagactacaatgtgaatagtctgttcactcccagccctgctctcagagttaaaaagcactggagaaagtgaagtaggcttgggcatactagcagttttctattctggagttttgcatgctagcaatttttgttgaagtgtgaattctaaggtagaagtggctgaaagatgcttatttcccatggcaaactgcttggattttatcgtgtaaaagagggtttgattactaatcttagggtaaaataaattcaagtattcagagccagaagtgacagagctagacttcattctagttataagtagctttgaagccatttctatggcttcatatcactgtttctaatcttttgactgcaaaaataaattagtatttcacaattgtaaattatataatttagaaaatggactctgttatgccagttttgactgcttagag

SEQ ID NO: 130057 - DNA, 1050 bp, Homo sapiens
actacagataacatataaagctttgtgcaaaatcatgattatgtctttaggttaaattgaatttctggatcaaagtatatcaccatttttaacacgttccatacacattaccaaatgattatgcagaatttgatggtgtcttcctgatgtgcagtagaatgtgaagttttatgacgaaatatactttttgataataacttaatttttgataataacttatcatttgttcttaaagtactttgacagtaagcttcaactactgaattagatgaactattatgtattttggaatcataggaaagccataatctgttcctcttaaatggtcttgcttaaaaaaaatgtccaaggaaagcatttttactgataaaatgagttgttaattaactctgtggaaatcatcatcctgtgttcaagagcagatttaactaggttacagcattaactttattaacagtttaatttattgcaggatcctgtagcatggagtgacgttaccagttttgatatttctgatgctgctgcttctcctatcaaatccaccccagttaaattaatgagaattcagcacaatgaaggagccatggaatgccaatttaacgtcagtcttgtacttgaagggaaaaaaaacacttgtaatggtggcaacagtgaagctgttcctttaacatccccaaatatagccaagtttagcactccaccagccatcctcagaaagaagagaaaaatgcgagtgggtcattccccaggcagcgaacttagggatggctcattgaacgatggtggtaatatggcgctaaaacatacaccactgaaaacactaccattttctccttcacaggtagtggtgttcattttgtttatgtttctaaatgtcaatgagttacattaaattagatctttaacatccttactagcagttggtagctttgataacatataaaaataatgtgtttaaatgtatacttgagaatactgaactctgagagaatagaaagtatctcacaaaatgtagtagctgcaaatatttatttatttatttatttattt

SEQ ID NO: 130058 - DNA, 1568 bp, Homo sapiens
ttcattaacaataggaaaacatgtgaagacagtataattatctgctgatactcaataccttaaggtttttattatgtttcttcacatttttctttagagtctagatttcagcagcataaactgaaacattctgcttctgtcttagaaagtttatcatttaaatttatttttttaactcgtagaaagataatacatggggccaacagagtatttaacagtcttaatctaaatatgttggaaagatgaggatatttcttatactgtaagaattgtttcccttttaatttagatatattcattattcaattaatttaaactaataaaataattttattatatgtgtgacttgataaaagaatagatgggtttaaaatactgtcacagattttcatgaaaagtttgggaaagatacgtttctaattcattagagttaccaagttgagcaataagtggtactaatcgagtattctaaaagttaagctctatgttagaagttatacataatgattctgcattatatagtgatttaggtagaccattacggaaagcagacaatttcatatttatggtttttgattttaaggctttttttttttctttttgagacagaatctctttctgttaccaggctggaatgcagtggtgcgcacacagctcgctgcagcctcaaccttctgggctcatgtgatcctcctgcttcggcctcctgagtagctgggactacaggcgtgctccactacacctggctaatttttttattttttgtaaaaacagggtcttgccatgttgcccaggctggtcttggactcctgggctcaagcgaccataccccctcagcctcccaaagtgctggaattacaggggtgggccactgtacccggccccgattttaaggcttttaaaaacacctcctctcatatttctttccactactgcttactaaatttatatgtatcttgaaaattcttattacagatgttttagaaaagaagcagaatgatacttagcctatcatcagtatatctattaaaagtatgtgagtgattctgattgtttttctaagacaagtaatagaagaagactttggcatggggtggtgataaaagtaggagatatgaacattgaaaaacttgcttcaggtctctgtccttgtgagtgcttcattcatatggacacataggaacacaattactttgttttctttaggagatagagcaacccttctaatagtagatgtttaaatatatttggtgaatgtcagatttaataaactggctgataaatctaggctaagtaattctcatatttcatctgaaaaaaagtcttttctaagtgttacgacttttaatcatagattctaggagtggagctgtagttatttaatagataagaaagtattataggtataacatttcaaaattaatacaggtactttctaagttttttatattgatactgtgtcaaaagtttttgtcatttgcttcagattttcaacatttatagcattatatgtatgataataatgcattaattactttttagatccctgggtatcagtatgtgtcacc

SEQ ID NO: 130059 - DNA, 1091 bp, Homo sapiens
ttatctggaatgctctttttttctttctgttctcgtatagctggtttgttctaaccaaaccaaaattactccgttacccacttttcttatcctactttatttgcattgtagtgaattttttattcatttatttgtttttctattcttccttccttcccactcccacacttccaaggagagtgtaagctccacgagagcagtgacctactttgccttactcactgcaatatttctggtgcttagaactatgcctgacatatgcacatacagtttatcttttgaatttttaaaaaatacctatcttcctgagtagaaactccaaaagaaaaattaagaaaaaagtatctaatttcatcagtgtaaaaatttgttttaagcactttgtacaagttaacacagtgttgaaatctgtggaatccttttttctttttaaatcatacctttcctttcttaggactgataattctatcaaaaatcattggaattctactatgcgaagaaaagtggaacaggagggctatttacaagatggaataaaatcagaacgatcttcatctaaacttcaacacaaaccttgtgcagctatggatcatatgcaaacccagaatcagttttacatacctgttcaggcacatacttttaatacctttattatttaaaaaattttcttaagttgctatatgggaagatgtttggtttcttaataggacaaatacaatgcgtattaaggggtaaatagacaaactgaaaaaaatgtgtaactttgatttataaatattttgagaacaaatttattaaaatgtttccttttatatgtaatttttacatcaagaaactatgtacatttcctaatactctgattctttgaatcttcatttatgattcaaagctaatggtcatctgtgctttaacattctattgtactttccatttaaacaattttggcgtaattatagtattgcttatctctaagaggtaggtatatataaaatggcttaaaagagaaagtagcaaaaataagtaattgttttgggggtgtggtaattaattggattttgctggcattcaactttgcttttccccctaataac

SEQ ID NO: 130060 - DNA, 1805 bp, Homo sapiens
cctgtaatcccagcacattgggaggccgagtcgggcagatcacaaggtcaggagatcgagaccatcctggttaacacggtgaaaccctgcctctactaaaaatacaaaaaattagctgggcgtagtggtgggcgcccgtagtcccagctactcgagaggctgaggcaggagaatggcgtgaacctgggaggcggagcttgcagtgagccgagatcatgccactgcactccagcctgggcgacagagcgagactccgtctcagaaaaaaaaaaaaaaaaaaaaaaaaaaaatatatatatatatatatatatatatatatatatagctccaccccaccccgctgtctgactcttaattttttgtactttgaataatttcattgtgaatatgacttgtagtctgtatgatttcttcagtcatacctgcacacacaagttcagtgtttgaatttacaaatttaaataaaattcttgatatcacaaattgtgttttttttgtagtgaggatgaggatgatgaccttcagtatgccgatcatgattatgaagtaccacaacaaaaaggactgaagaaactctggaacagagtaaaatggacaagggacgaggtaattatctgacaaggtttcatagtttcttacatgtatttattggttaatactgctatagttatacggccaggtgtggtggctcacgcctgtaatcccagccctttgggaggccgagatgggcggatcacttgaggttaggagttcaagaccagcctggccaacatgatgaaaccccgtctctactaaaatacaaaaattagcctggtatggtggcgcatgtctgtaatcctaatcctacttgggaggctgaggcaggaggatcacttgaacctgggaggcagagggttgcagtgagccgagattgcaccactgcactccagcctgggtgacagagcgagactccatctcaaaaacaaaaaaaaaatgctgctatagttatgaaagatatttaaaaacaaaatatgagaaaagatatgcatcaaattaactgtacgttctttttcttcaaccagagacatgaataactgatgacattggaacttagagaaacagtataataaatggaagaatttgtattatagtgggtggctttagttattctatggttaccagatattccttaatagaattggagagttatctatatttaggggtagaggaaaaggacggggggaaagctttctaatttttgtactgttttaataggatgataaattaaagaagttggttgaacaacatggaactgatgattggactctaattgctagtcatcttcaagtaagtgaaatattaaattatatttctaacatggctggtttaaggcattgggttaaatttgctatttttcaaaaatgtgtctacatattttaattttaggtttccttcctaaaaacatccctgttggtttggtctgcctctagttggttgctaatggcttggagagtctggtttagagtctggttttctagtaatgcgtttatccaggggcctaaaaagattattaacttaaaacaaaaatgataataaatgtatgtgggaccttataaatatttgctaatacacgttaaaacattctgtgagaaatatattgagatatttgatagctaaccaaaaaatccagaaaagccctattaaaaaaagcttatcatctgaggcttaccttttaaaatgttgattttaaaaactattatgcctattgtttaccatactactattcacctgctgttcgttatataactttataatttatgaagtat

SEQ ID NO: 130061 - DNA, 1019 bp, Homo sapiens
gcggcccccacagccaatgaggttcagggccgcgtgcgcagattcaaacggcggctcttgagggaggctgggcgcgagattcggcggtgcggacaaaaccctgcaggagactgcgagccctgcagaactgctagctgcgggggagagggcaggggtcgggcgcctgtggcggagccgggctggggccagggcagggaggctgacaagcggcgggagaagccggcggagggcgggatcgcgcctcctgacatgttgggggtatccctggccgggccgggccggggctaagagcggcgctgcgggccggggtcggggtcgggtcgcggtccgcccccgctgtccctccgtcctgccctgtcgaggacgtgcgttccgcactcggccgcctccagagggagcgagggaagcggctagaggatcggggagaaggagcattcgccggaggctggaggaggctgacccgcgtccccgcccagcctgctcctatgcggtacttgaaggatggcgaagaggtcgcgcaggtgggtggcacccctttcgcccaggcctgtcggcgccgtctcggctcagattctctttcctatcccgctgccccctcccgccataaggccctccctggcgagggcagaggtttttcttcccgcgtccccgcggccgcttggcctcgatgaccggagggcagctgcgacgtgtggagagttggggaccagggtgtttgaggcgcgggacgtaagagatgcccaggtttctcggtgactctccccgtaatgcgcgtccagatttctgacctcatgctgccacttcttcgaggcaggtttcttgccaggtaagtcgagcgcttttagggagtccgctacgcagagaaaactgactgtgtcctgccgggaggacttgaaaatggtgttcgggcgactcttttctgaatgacggtacagtcaaaataggaactccgcggtgaacctgggcggccacccctctgccaacttggctatcttgaaacgttgtggaaaatcctctgg

SEQ ID NO: 130062 - DNA, 1049 bp, Homo sapiens
tcaattctgataagtgatcaaatttcttgaaattctttcaaatcagctgaaaatttggttggggtgaattgatggtttttgagaagtaggccaggtatcctcacaaagaagttttagaatagggtttcttttaagtttttaaatatcatcctttgtctttccatatggttttcataaccaaatacatgactatagcatggttatttttctagtactgccatttgtgatatagccacatcttggcgtgcaagctagacatctcaggtaaatttgtttttttttttttttttagccctagaggtaacattataactaaaatgcattcctgcaattctgtttgcagtgcttcactaaacattgaaataaagttgtaaattttttcttcagtaatccattttatagttaatcataccaaatttaagttgatgacctaaagtccaggtagtgttgaagatagtatgtatctagaatactggtaatgagaaattgttgtaaattgaagaaaacaagatgctgccatatattaagatagaatataattaactccatgagaatggttactcaggaactagttaaagagcaaacccatttctcccgcttcactctgtttcagatatttttattggaaaatgttagggtagaggcctgagaaagttagcaaatgctattgactgatactggctctgtgtcttccagtgatttttagtttggtttttacagtcaagcctactgcttgcaattaagatatcaatctgaaatgcatctgtaattcctggccacaggtccttattgccattatttttaagtatcttcattggagatgaacactgacttttgcatatggtctcttacctcagggaagatcacttgctagcaactcatactactaatgacaggtttttgagaattgtactgacatcacatgttagctactaaatgcaaaatgtataaaagtattgttttatgtagttacctaccaatactatctgctactgaataactctctaaatatgtagacctcactaataactaacctttaggtaaaaaat

SEQ ID NO: 130063 - DNA, 2623 bp, Homo sapiens
cctttcagggaaaagggcattctttaggaactgcatctggtaacccacaccttgatccaagagctagggaaacttcagttgtaagaaagcataatacagggacagactttagtaatagttccactaaaacagagccttctgtattcacagcttcttctagtaatagtgagcttattcgaatagctcctggagtagtaacaatgagagacggcaggcagcttgatcctgatttggttgaggcccagcgaaaaaaattgcaggaaatggtttcttctattcaggcttcaatggacaggcaccttcgggatcaaagtacagagcagtcaccatctgatcttcctcaaaggaaaacagaagttgtgagttcttctgcaaagtctgggagtcttcagactggtttgcctgaatcttttcctttaactggtggtactgaaaatttgaatacagaaacaactgatggctgtgtagcagatgcactgggagcagcctttgccacaaggtcaaaagcacaaaggggaaattccgtggaggagcttgaagagatggatagtcaagatgctgagatgactaacacaactgagccaatggatcactcttgatttaattagaggctaataaaggcagaatgtttattgtgaatatgtaatatttgttggctgggccacgtaacttgattagtcattaaaaatcttgtacgtatataattcaaagattatatcttgttattcagtgcatgatagcaagtgtgtgattggccatagcttttaatatactgctgcccaggctggctctgaatttctataaattagctgttagatctgctgagatgactttcttccatatatgtggttcattggaagttctttgtaattttaattccatgaaagtcttaatgtttccaacatgaaaattctcttacttaaatacgtttgatttctgaaaagcctacaaatggaggggaaatgagattgtgctaatgttgatgtcatcaaggtaaccatctcatatactagtgtcaaaaggtttatgtaaacttgaattttatctgaactaaattgtatcttaaaattcatacaattatttattagacagtggaatgcaaatgtttctatgaacgtaaacacattcatagagatttcttggcgaaaatatcttgagaatagaatgtaacgatataacattttgctgatttgtgcaagattggggaaaaatttcttctagattgatgaggtcaatgtgattcagttgtgttgctgtctgagccacagccaattgtgtgtgctctattaatatgttaccattatttttgattcctggcttggtcaagaacaacctgatttttttttttttaatcttgcagaaaagttgattgcaaagtgtggtagaaaaagaaataatggtagcagtagagaatttataaataagagtttatctttatgaatgagttaattgttctacaattttgatcagtggtatttaagcctgtatatgctaagtgtatttatgcccctttgagccaaaatttttttttttttttcagaatccataagagtttatttgttggcttcacttgggtttagatgcaaattttactgcatcacaccctgatcagctgggtatttgcttagtgtattcatcaaatcttcagtgccagtttccttgagaagcagctttcatgcttattccttaaaaacaacagaagagtgtttatcctgagattggtattgcactattttattttattctgcaaatctgtatcctgaagtgtacatttcaacccatattcttctctgttcactgaaattaagttgaatttgaatggctgaaagacaaaatatatgttaatacaatctcttacctagagcattcaaagcctggctgtctctgtttgcacatgtaacagatgcagaactgtgtttgtaattctaagaaaatgtatgtcagaaagtattttatcagatgtttaaaaatctctgcctgttgattcataagggatatagacagtactttaacttgtgtttccagataaggcagattttggtcatctttctgtgaaagtatctctaactgaatccacttcttaaacaaactactctattttaaataaggaaagaatggagaatctagacattttacaggtgtatctgagcaaaatatatatttgggttagtttttatcacattatcacgtttgtctttatattttatcttcatcctaaattttctccctatcaaaacagcaggaaatttttaaacttttatattgtacactatttttgcataaaataagagctgtagctaccaaatactatttactacttagtaaaggtggcttctgtgtattaaactacgaattacaaatatcacttcactaaccactataattatttttggctttttcagccactggaactttttttggggggatttaaatacaggaaaactgtttaagcaaaaaatgcactgctttcatgtaaaatgatataatcttctttaacaaatattttcttcattgataactgacagatatctcatagcattaacataaaataccagaaacaaactttatctccctattcttacatttagtgcaaattggaatgcgtatgtgaatgttagaagat

SEQ ID NO: 130064 - DNA, 1685 bp, Homo sapiens
acctggcaaaaagtactcatggacagctgaggactgacaaaaattacagctttcccttgaacaatttggtttgctcatatgattcagtgaaagatgttctggtaccagactatggaatgagtaacctaacagcttgtaattggtgccatggcacatctgtgcgaaaggtcagaggagatgggtctattgtgtatttggatggagacagaactaattctaggtccactggtggcaaatgtggttgtggattcaaacacttttgggatggtaaggagtatgacaatctaccagaagctttccctattactttagaatggggtggaagagtggtcagagaaacagtatattggttccagtatgaaagtgattcatctttgaatagtaatgtttacgatgttgcaatgaaacttgttaccaagcactttccaggtgaatttgggagtgaaatcctagttcagaaagttgtccacactatattgcatcagactgccaaaaagaatcccgatgattatactcctgtaaatatagatggtgctcacgcccaaagagttggagatgttcaaggacaagaatcagagtctcagctcccaactaaaattattcttactggacagaaaacaaaaactttgcacaaggaggagttaaacatgagtaaaactgaaagaactattcaacagaatattacggaacaggcttctgtaatgcagaaacggaaaacagagaagttaaaacaagaacaaaaagggcaacccaggactgtttctcccagtaccattcgtgatggtccatcctctgcacctgctacacctaccaaggctccctattcaccgacaacttctaaggagaagaagatccgaatcacaactaatgatggacgacagtccatggttacccttaagtcttcaacaaccttttttgaacttcaggaaagtatagccagagaattcaacattcctccatatttacagtgtattcgatacgggtttcctcctaaagagttaatgccaccacaggcaggaatggaaaaggaaccagttcctttacagcatggcgacagaattacaatagaaattctaaaaagtaaagctgaaggtggtcagtctgctgcagcacactcagcccacactgtgaaacaagaagatattgctgttactggtaaactgtcatctaaggaacttcaggagcaagctgaaaaagaaatgtactccttgtgtcttttagcaacattaatgggtaagatgaatttaattctgatggtatatcttaattgtaaatataatacactgagttttcctgttatctttgggggaaaagaaatctgtagccattgtaagtttttaattatatatttcaggagagaattatttttagtattttgaacagttgatagatgttaataggattattgagtaactattaggaaaatagaaagttaaggtagtccctcaataatagtcaacagattatttaaatatatcttattcttgcaattgctttttaaaaaacagacttgtatttatttaaagcgttttaaattttttggtaggctctattgatcctgcctaccttgcccctttttcatttatttttaatttttattttcctgtatgtcatgtgatttcagcacttcctgtttgatgaattgcagtttctggtgtttatattctcactgcactcccacctag

SEQ ID NO: 130065 - DNA, 1013 bp, Homo sapiens
tcctaatgacgtctcacgcctggagccctgaattcgtgtgtgactcctaccccgcccgaggaaaatgagattatgccagtgtcttgaatgagcgcggttgttttgagatctacactttagcgggaacctggggagagtgccttctcattccttgcccccgcccaaggctctcttcaccttccccgcgggggtcctctcgttttctgtctcccaaatgctggcttcccgcctttcctcccccgcttatttacttaattaaggccctggggctgcaccccaccggcagctccttcgggggtgtggccgaagagctccgagggcggggctgaccgagccatattcgggcgtggccggtggtgattggtgagggcggggcctgccgcagggggcggggcctgcaggtttggcccccgcagggagcgcagctggcgccgctgggagctggtggcgcggcgcaggtcccggccgagtgtggcgcagcagtggcggcgcttcccattcgccatgcgccgggggtgggtgcccgaaggtaagcgtgtggctcatcgagcttgcgcgaggaacccttggcggagaacagccccggcactgcgcgggccaggtggagggaccccgggggcgcgggaggcaggtgtggtgtgacgggccccggtgccatttccgcgcccatcacgagcgcggggcggggcgcgcgggcggcccctcctgtgaacccctgagaggagaggcgggctccacacccgggcgtgctgcgacttcgcggcactcattcactgcacttggtccgagacagaaaacgtttgagttgttccacacacaccccctctaaatgtcgagaagccccaggtactgtcaagtttgtatatcctttaaaatatagtttgtggttcaggacaggaggagaaacccgatagtgagcttgcggtggggctttacttttactttgtgttattcagtttgtaagaaaggtgtagtagaaacgggactgttacttaaacatggacagcaggggt

SEQ ID NO: 130066 - DNA, 1018 bp, Homo sapiens
gtaatctgaattgttcagcacacttgaccagttcatcctgatacaagaagtctgaaaaccacactttggttacctccaactagatcttttctaggtgagagttagtccctagcctacgtgaactgaggtgtgtaagttcctagaatttcctaatagtaagaaaggtagatgggctgcagatatttgtggcttgtagtaggaacataacaaactaaatctctaacctgggctgagactgatgagcaaaagtaggttcctatcagaataaacgaaaattagtcccatgcttaaagaatgacagtcatagtattttaaagttgttttgctaatcacttttttttttttctgttggttaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtaagtatttaacataaagcatgtgggaaaaaagttgaatgtagagaatattttcatttctgcttttcttctccaacctagaacacccccttccccatctccacatacctagattttacttctttcacatgatctgttctccacaaagtcttctgtggctaccgtaatggaataaattttccttttttagtgtctctttacttatcttcttggagaattgtatgaaactatctaattaatcttcttaacagaaaatgtgcatgtgcatacacatggatctatgcacacacttataattttgtgtgcactgtcaggaattaatggactcctgaagtcatcgattccatattaagaactactgtcctgaaatgtttatagtatctctcagttttaaaatatttaattcagtattttatttttttcaccttaaaggctaagccattt

SEQ ID NO: 130067 - DNA, 1047 bp, Homo sapiens
tccccagtagctgggactacaggtgtccgccaccacgcccggctattttttttttttttttttttgtatttttactggagacggggtttcaccatgttagccaggatggtctcgatctcctgacctcgtgatccgcccgcctctgcttcccaaagtgctgggattacaggcgtgagccactgtgcctggccagcagcacataattttttctatggtttaccccaaaaattagaatttctgggcccagggaaaatacatacacagttttaccaagtattgccagattgcttttcagaaaagttgcttcattctgaattgtcaccaacaatatttgaacatttctctttccctattttttttttttttaccaacttttggtattatctgtctttctaacttttgccaggtaacggacataacgtgatatctcattatcattttaacttatatttctctgattattagtgaagttagccatcttcacaaatttgctgccatttgggttttcttttccatgaactgcctgtttatatgtttgcccatttgtctattggtttctctattaaaaaaaaaattaatttgcgtattacatttataataatgaatattaatggattctgttttactttcttactgtaaatactaatatagttatttctattttgattttcattttaaaagggagaaaggctgtagaaatgcttttgaagttataataaagttaatttttgtttttagtccagatgtcagagcattccttcaaatggacagtccaaaacaccagtcagatccatctgaagatgaggatgaaagaagttctcagaaggtagtaagaggaattgcctttcttaatagaaaaaatactattccaaaggtgaaattagtggctttaggacacttacttcaaatgaagtaatttcatccatagtagagtttctactatgtagaacacataaaaacaaatgcatatacctcttacagatcactatttcttttttcttttgagatggagtctcactctgtcacccaggctggagtgcagtggca

SEQ ID NO: 130068 - DNA, 1046 bp, Homo sapiens
tcccagcactttgggaggctgaggcaggtgaatcacaaggtcaggagttcgagaccagcctggccaacatgatgaaaccctgtctgtactaaaaatacaaaaagttagctgggcgtggtaggtgggcgcctgtaatcccagctactcgggagggtgaggcaggagaattgcttgaacccaggaggcggaggttgcagtgagccaagatcgcgccactggcatgccagcccaggtggcagtgtgagactctgtctcaaataaataaataaataaaggattaaattaatgaaagaaaagctaaggtgaataatactgtgcttttgatgttttaggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgcta

SEQ ID NO: 130069 - DNA, 1047 bp, Homo sapiens
actgtatttaacgtgtaaatcaattttgggcagaattaacatcttaataatattgagtcttccaatccatgaatgtggcatatctctccatttatttaggtcttctttaatttctctcagtgatgtttttataaaggtcatgcaaatattttgttaaattggttctaaaaatatttgatatttttgatgctactaaaatggtagtgttttcttaatttcattttcaattgtttgctatgaatatatagaaatacaattgatttttatattttgactttgtattctgtgaccttctgtgtatcagtagttttaaaagttccttagccagttccaatgtgtagccaaatttgaggctcattgttccatatcactaagtgctcagcctagctgcctattagaatcacctgggagaatttttaaaaaatatttatcactgtgtctcacccccagagtttctaatttaagtggtttggggtggcacttggcattggaatttgttaaatctccccaggtaaggttagtgcaggctgtggttgagaaccactccttataggcttgcaaaggtttctttctaaatatcgctctctctctctcattttatatatcttcaaacatccaaattccttagaatagaacatgcgctagatatattttataccatctacctatccacatctcactcttttgcactgcatgtctatgcctacttttgtatcacccccttttgtgtcacatgtctatgtctactcatcataggtgattgcactaggaagctgtaatttctgtggcaaggatttgaaagctaagctaaggtaatcatattcctttttcagaatttaaatttgggatatgaagagactgaggcaattagcaaagaggttagaaaccaaaatgacatatcagcaaatgccatgagacaggcaggtgcctcatgcctgtagttccagctacttgggagactgagcaggcaggattgcatgagtccaggagtttgaggctgtgtgtgctatgactgcatcattgcattccagcttgtacgacagagcg

SEQ ID NO: 130070 - DNA, 1049 bp, Homo sapiens
atagtaaaggaactagaaatatttaacttggaggagagaaaacacggagcaatcaaaaagttatctttgcatatctgaagagcatcatattaagaggtctcagaagacagaacaagagacctgtgggtagaaattgcagtgaaactaattttagcttagattgatagaatcttggttatagttagttatggttatagttagttgcaaaactttcaaatgcctttacttatctgccttttacagctgagtttcaaaaaatctcatacattaaatgatttatacaaagtaatacagctagtaaattctagagactcagcctaggttttctgattcccaagttcagcagtcattcagatacatcacttttgcttgaaggagatctttcaagtaatggaagctggttaaaaaattaaaaataaaggaacggattgcctcatgaagccatgaatgctaggagaggtccaaaagagactggaaaatgaatagcccaggatgttgtagaggaaatttagttttctgatgaaagtttgaactttgaattccaagatctcttccaatgctgaaattgcaaacaaaaatcttgcaaatctatgaggattttagataaatgaaggactaaaagaaaaagtcaaggatttgtctgtaaaagatatttagttagattaattttcccaactgtgtatttatctgaacaaaacttcgggaggggagtgtggaatgataaataaaagccaggatggaaaccaaaaggatactggcttgttctggaacagtctatttaagtcggtggggaaaaaaaatcctttgaaaagaaactaaaaatttttttaaagtaagaatatgctttaggtgtggctaaggttcatatatatctcgatttgttcctgccaaaatatatattatttttataatatcaacatattttctttggcaactattttcttttttagcgttttcctatctgaagcccatgcacgactgaacttaaggaacaaagtgcttaaagaagatgtgctgattgcagccttactatttgaaacatccctcac

SEQ ID NO: 130071 - DNA, 1369 bp, Homo sapiens
atgaaatgtttccaccattttcctgccagtgctaatggctcctgtttccagtttggaataagctcatttgtggaaatactaggtactaatgagacaaacatactcagttacagaggtttgggtttgtcagtactgactatcaaaaaagcagaaacaggtaatagaataatagtacttttttattaaaaagtggtttgggagtctgaaaggtaggttgcaagtacagttcctaaaggaatgagattctcttcttggaccattcctacatataagatgcccaacaaaatgcaaataaaaatgggaattcgaaatgtaatatttaatttccaggtgcaagaaagcctttgaggtgaaggtgtatgaaagtcatcataacagatgttttccaaaaacttgtagaaggttgtgaaaaaactactaggatcacgcggcatgtattgaggtacctaaatttaattaatgttagttatgtgatgtattcttgacagataggtttaatagctggcacaatgatgacttaaattactttttgccgtttacccagctgaggttgtctttgaagaaataattttaagactgagatgccagtactgtacattgattaattactgacatgtatgtaaggcaataatttaattaagggtgaatattctttgtttttagcatataggttgctgtagatgaatgttcttagctgtcatgtttaaaaatacttctgcttcgttacctcaagtaagtgatttgtcaagcaactatgtctgctgacagttcagaaagtatctgataaacttaagggtgggggcagattcttgttgaagttgcttttgcatgtgtggtattctcaacattagttttttgaggggcacttgtgaatattgaggttatatgagaactttgagtatggaatgattttcactgtggtttctgactttgttttggaggtgtggcatgcagcattttggaaggaaaattgaagacgtgttcaagaaaacatgaacagaagcaaatgatgaaaatgagcattttacttgatgttgataacatcacaataaattatggagaaaaatacatatttggctaacttttaattgctgaacaataaagtgttttcttttaaatcaactctaaatagctccattctcatagtcactagtcagacctgttttgaacatattcgaaagattataatcttgtcaataattagcttatttatgggtggtgattctcattgaggctgacagctggggagacattgcttgtacctctaggttccctgtctggcttccccttcagagcctgctgttgtaccaggtggttgaatcttaaaactctttaataccaaatagcaatcaaattcccccttacagat

SEQ ID NO: 130072 - DNA, 1050 bp, Homo sapiens
cttcttcctcccaaccagagcaacttccaattggccacactattcagccctcccagggtgccactttcatgaatgatgccattgagaaggcaaggaaaacagctgaactacaagctcgaatccaagccgggctggcactgaagccaggactcatcagcaatgccaacatggtgggcccgtctaatctccatgacatgggcattgcttccccaaagggggagttaaaagaccaaattaaacctacaccactgatcctagatgagcaagggtgcattgtagatgcaacaggcaaggagattgagctgacacactgcatgtctactcctgccaatattcgtgctgttccctcttcggagggaaccattcaagcaacagctaaaagaaaagccatcagaagacatggagtccaataccttttttgaccccgagtctccactgtcgcttcccagcgccagaaacgcacttttaaattccatgacaagggcaaatttgagaagactgctcagcgattaaggacaaaggctcaactggagaagcttcaggcagagatttcacaagcagctcaaaaaacagacatccatactttgactaggcttgcccttattgctcctaggaaggagctaaaggaaggagatatccctgaaattgagtggtgggactcttacataatccccaatggctttaaccttagagaggaaaatcccaagagagaagattattttggaatcacaaatcttgttgaacatccagcccagctcaatgctccagttgacaatgacacaccagttactttgggagtgtatcttaccaagaaggaacagaaaaaacttcagagacagacaaggagggaagcacagaaggaactactagaaaaagtcaggctgggcctgatgcctcctccagaacccaaagtgagaatttctaatttgatgcgagtattaggaacagaagctgttcaagaccccacgaaggtagaagcccatgtcacagctcagatggcaaaaagacagaaattgcatgaagaggccaactctgcctgaaaactcacag

SEQ ID NO: 130073 - DNA, 1050 bp, Homo sapiens
agtttgttcccgtggtgcggagggtcaaggcccacacccggaaacctagcgaggtaaagttgcgtcttggttgtagagacgacaacttctccgcttcctcggcgatggcggcgtccgggagcggtatggcccagaaaacctgggaactggccaacaacatgcaggaagctcagagtatcgatgaaatctacaaatacgacaagaaacagcagcaagaaatcctggcggcgaagccctggactaaggagtgaggaggtccctggcgagacgcaggggagggaaagggtggcggagtttaagagacccagagggagagggaggtgaaaggggtgaagagctttcaccgactgggagggggacagaatatgcgtcttggatctgcaagtagagcctaagccctccgctggggctttcactcccctttctgtcgctttaatccatttgcccccgggtgatgtaaggggagaacaacaagcggtgatttaagttgtcacttctgaacatccgtattgtcatatatgccacacaccctaccttgagcccagtgtcgacatgcaccttgtttgggtcttcaactaatcccaaactggggattgcagctgttttcagaaatcgagtcagcagcccaaggtctcaaaaatagctatgagctattttcttttcttttttttttaatagaaatgggtcctcgctgtgttgctcaggctgatctcgagcttctgccttcaagcgatcctcccgccttcgccttccaaagtgctgggattacaggcgtgaggcctgggcctataatagttttttgattgctggtaattatttcggaggcacacggaggctctactacctggtctctaaaatgttactccaccagttcccataagccagaaattataaaaatagagcttaagaccttttgcccttcaacaatatccatttttccctgggagtggtgacaagtcgagggatctttacccataatatttatcttttcctgagagcatctcctgagagatttcctgctatcaggaaaagataattattacgggttat

SEQ ID NO: 130074 - DNA, 2464 bp, Homo sapiens
acctccgcctcccaggctcaagtgattcttctgcctcagcctcatgagtagctgggactacaggtgcccgccactatgcctggctaatttttgtatttttagtagagttgagatttcactatgttggccaggctggtcttgaactcctgaccttgagatccacccacctcggcctcccaaaatgctgagattacaggcatgagccagtgtgcccggcctaaaataattgtttcttaaagcaatgtcttaaaggctttcttaaagctttccttgtttaggtgaaactgatttatccatttagcaaatacttactgagattgtgttaggtattatgctaagctctgagaatgcagcactgattagagtgttgtggcaccttctcagggctcagtgtatgtaataagatacagcatgtagtttaatctgtgccatatggttcatcataatgacagtaaccatatatattggtttgttcaagatgatcctggtttacctgttgtccagtgtttttttctggtttagcatttgtcctggacaaaggtaccttggctgagatgataaataatatagataccctgattacaattttactcacatggctaacatttattgagtactagctatggacaaggcatattcttaagaggttatatttcacagtaatctatgaggtaagtgctgttattgtaattttccagatgagtaaactgaggcaagttaagtaatgagactaaggcagtagagttggtggaactaggctttgacccctggcagcctggcttcagtgcttgtcctcggaaccaacataataggttgcctttcttccagataacctgtcatgtaccaggaatgccaaggactttatatgtatcattttatttaatcataatatccctgttaagcaggtgaattttttttgttttatggattaagaaagtgaagctcacaggagttaagtaatttgtccaggtccacacagtggtggattcaggagtggaacctttatgcagctccagagtctatctcttaaccactctccagtagttaggaccagcttacggctttggagttacatgatttggagtacatagctttaaagacagttttgttataatttctaacattaatttgtacataaataattttaagtcttagttcaagtatcacctgctcagtgaggccttatagtcccccagcatttctgggcctccttactttaatctgcttttttttttttccataaccacttcctgccactatctacatatcacataatctaatcatgtgttgagttcattatgtgtccccccaatagtttataagcttcatgatggcagaaattcttctattttttaaaactcttatactttcaatgcttgacaaaatgtttggcacttaatgggaactcagtaaatatttgttggtaagtgaatgagttaaatattagaatatctattataaaattaaaatacctttggctaattcctcaaaccttacacttaatttcttctatgatgtactgtgtaatttcatcaagctgtttaattaaaatttgagatgagttgtatatttcatggttttttttttcctcttgcttttgtaaacattatgtctctttcagggaaagttgtcagcgaagctttctgaaaacagtaagatactgatctctatggctaaggaaaacataccaccaaatagtcaacagaccaggggttccttaggtatgtcattagatgtgctaaacttattttaagatatccttagtgggctcttctgaaagaggtttgtcttgtcagaaaaaaagatttatttggaatcctagtagtttttctttctggaatcttacgtaagtcaatatggtctacatatgaaatagaactcatactgaaaactttgtacttgttttatgtgatactgcattggttatgatttatggaacttatagaagaaggtgtgtataacataacttaaaaattgaaaactttgaaaggaatttgtgtgtgtgagagagagagagaagagaaacttttatttgttgattgaaaatggtgaacttgcttatttaaaaattaaagaaatatgcttaaagggtacaaaatgctgtttggtgaaagactattttaattattgatgatcatgttggaattgtaaagaagttaatactgtagccatactaatgctttgattatggtatggtatgaaaatatttggaaactttttaccacattttggcttgttggtaggtatacattttaaaaaaagaaaatgtatgaatatgtaaaaatttttgtttatttattaaagacagggtctctctctctctctctctgtcactcaggctggagtgcagtggcatgatcatagttcagtgttatcttgaactcctgggttcaagcaatcctcctgccttggcctcccaaagtactacaattacaggcctgagccaccatgcccagtctgtatg

SEQ ID NO: 130075 - DNA, 1048 bp, Homo sapiens
ttttcatggatgtaggtatactcctaaattgtttttgtgtgccagtggatacaaggggatgccggccaagaaactggatagtcagtaagctttgtctctgcattagacaaatagctcaaagtgagtgccctacttttaatatcagatagataactctttccattttgaatctcttataaattattaatatacagcattagtgaactaaagtattatatattggtaaaattttttaatctctaaggctctcaattttttttctgtgaaataagtttgattatcttccagccctacgtttttatgaatctaaattttaattattccaagagataatttttaaaaagtttaatagtaggttatctcaagcactaaggtcgctaaggttagacagaatcccttttaaattctagggttacagcttgctttggattgggctgtgatgcctttatgacctgtcaggagctacactttgtttccttatcttatgacatctatctcaaaaagtcgttatgggcgaaagttaaatacgtgaaaagatggctggcacgtaattggtacacaataaatattaatttctttttctccttaacatcttttttttttgagacaggatcttactttgtcgcccaggctggagtgcagtggcataatcttggctcactgcaacctccactgtccaggcttaagtgattcatcctccctcctcagcctccaagtagctgagaccacaggtgagcaccaccatgctggctaacttttttttatatacatatattttctgtagaggtggtgtttcgctatgttgcccaggctggtctggtctcgaactcgctagctcaagccatccgcctgcctcggcctcccaaagttctgggattacaggtgtgagccacttgtgcctggccttccatctttttaaaagtagtttttcgggctgggcgtggtggctcacacctgtaatcccaacactttgggaggctgaggccagcagatcacttgagatcaggagttcaagaccagcctggccaacatggtaaaaccccatctc

SEQ ID NO: 130076 - DNA, 2781 bp, Homo sapiens
aatgatgcattaaaattgttgttggtatttatttttatagaaattagtgtataattaagtgaagatgtaaagataattagtttttctttaattttgctgttcttgagaaagcaagatgccaaacaatgctggactacttgtcttaactggaggaaaaagtgaatataatgcacacatgcatataaatatgtatatgataatataaaagtatctgtttataggtgcattaaaaaattatctgcatggagacaagaaataacaatgtttgttgttctggacaggagaacagggtggctagggctcatggatgagaatgatatttttgataatatttttgattatctgaatgtattatctattgagacattttaagtaaaaaacttaccctaatcctactcttggaataagcataattctgttccttcttactgtgctttgttacaggaagtagaactttgagattggtttgaaaatgaattatactaagaagttgttttttttctaggaattgattatggattaagtttaccacttggagaagactatgaacggaagaaacataaattaaaagaagaattgcggcaagattacagacgttatcttactcaggtaatgagttctattaatgagttgggtttaatgtttcagaattcagctcctaaatttgttttcataaggtattagtcatatgtgttaatttttaggttttcagtggtactagcaaagtagtagtatagtcaaagttaagtggcatatatgacattggtagagaaaaaaatattgctgagaaccggtgccatagaatgatacagacttttgaccttttgactaaggcagtggattctaattttaagtgagatcgttaattatggtttttcatgttttctgtaaagttgtcatggtttgaagtagtccaatcatggtttcccactcttctacaccccccaactatgtattaaaatgacatatggagttctagttgctaattattttcctatgagccaagcttataaaattacatttaattatttagccactaaagcttttgttttatgatctcatgttttacttagcagaactcttgagtatttttgttaaattatataatggccaaagtaaggtttattgtaagttttaaatttaggttataaaattattttaaacaattatgatatttgttgtcatctcaaaatattctttagttttttactgctttatgtttgttccaagtgtacaaatgtctcttattctgatttacacatggagagaatgaactttgacttaatacactttgtcaatggtttgtttcccttgactttagggcattacacaagggaaaagaaaggtagggttgtctgcaatacgtcctccttcagttttttctttctttttttttttttttacgatctagaaggttgcaatcatttgcatttatgagattcaaaccaattaggaaaacgggttcatttgtgattttgagatgtttgaatggcaccattttgtattcttgcttttagcagatgacagcatacacattataattttccgttaatatagtcattacttttgattcctgctttgcatttgtgtttattgctttcttatgcattctttttgaatattctgcagttaagtctgttttcagcatgcaattttttatttctcaaattacactaatcacagtaagattaatagagtagtagaatatccaagatatttgaactacatgttgtgagaatttggattactctgtttttccaccaaaatctatagattgcattgtccatttatattggaaaacaaagagaaacagtttatggttttacaaaactggttttaaaaggaatctcacagattcaccattcaactaacatattttaaacacttattatgaagatatatcaggtatgcatcctgtcttcaagaggcttagaatttagttgtagagatagcattcatacgattcagaaagtggtaactacaagaaggatataatgatcaagatagtcctcatagtgggaatttctattttgtgaggcaatctagatttgggtgatctggagagagaatcgaagcgagaaagcttttcagatggaaagcatagagtaaaggaggacctagagggtagactttagctttgtatgaatgaggcatattaggtttaccagcctgactgggtcagagtatcattctttttgagagtagtaagaaataatgatgtatataggataggatcaaattagaaggcagtggatttttaacttgttatatgtaatagtcagtgatgagcatcatactttcttaaatagcttgtgaagagcatggtaactgtgttttaggacagttagttctgcatgtagagactctcattgtgttaaattgctgcccaacttcttaactgatttcctcgcgctaattttcacttcaccctccaagctattttccagaatgattcagtccctaacttatttaaatatgtcagtatcctctaactgcctccaggataaaaattcaaattccttagcatggcacatgtctttcgtgttccagcctgactccctgggcttatacctcattatcttccccttccctactttttcttattgggtggagttttcctctggtatcagatatctaccattttctcttgtaggttttgcattactccctaggtaagatttttaaaaaggatagtggtgggggacatgagaagaaattgccgtcatgaaagtacaaatctttaaattcaaagggatgtgaaggagttttttaagatttttt

SEQ ID NO: 130077 - DNA, 1037 bp, Homo sapiens
agagcaggtactattctcattttgcagaagaagaaagtgtctgtcagaaaagttaagtgacttccccattgttacacaactgataagtgcttgggctagttgtagatcctaggtcttttgactgctagtctaatgctgcctctactacactgcattacttaaatgcttaatgaacaagattggaggaacacataaacaacattcatagtttatatctattggcatttcagtagatattcactcacataattataggaaaaatagaaaaaaaacttgtggcatgcattaagatatttgtgaggaagtttaaatttgccttgagaacaaaaagacagtagagcactgataatgaagagtacatgcttagaagacgaaattgggaaattttttttcatgcttctaatcatcttgaatcaatagacgtatatattgcacatgaaaattaaggcctgattttccctttcagggagttgttgattggaagaaaattctcttttttccaaatgcttttggtatggtctatatagatttgtagtttctgtcttcattccatttcattcatttgctctgcataatataatactagtttagaatatagaatgcaaagacacatttatgcaacatattttataaaggcaattaggtaatatatttttttaatgtgtatatatacagaaaaattttctatctacgagtgaaacagatccatctactttgggagtttctcttcctattggtgagaggttatctgctaaggtaggtggataggagtagttattgtgggtaccagttttccgaggcatcaaaatcattaaagaacatactgctgatttaaatgcaaatggaagatcacatcatttccccacacttgaatatatttctatttcaaaaatccgtggagtcatatttatgctgtttaaaaaaattttcttgaacacaacatttgtaaccatataattttatatttctttaatatgttgattcttttgctgtattcagttatacttaactgaatattcagaattcatttttttcag

SEQ ID NO: 130078 - DNA, 1683 bp, Homo sapiens
tttttgagacgaagtatcaccccgttgcccaggctggagggcagtggcggggtcttggctcactgcaacctccacctccccagttcaagcgattctcctgcatcagcctcctgagtagctggaggcaggattacaggcccctgccaccaagccccgctaattttttgtgtttttagtagagatggtgtttcacaatgtaggccaggctggtctcgagctcctgacctcgtgatccacccgcctcagcctcccaaagtactggcattacaggcgtgagccaccgctcccagctgacctagtttctttagtacttttttagattgtgttgttttagcgacacgggagtattaaaatttaagaacattttttaatcatatatttatgttttaacagaacatttcattataatattttataatctgtgataatttttctttttaagtttaaaatataaaggatcattttttaaccttggaaagcaaatggttagcagcaggtgcttcaggggagtgggttgggcattaggagagggaggtgtccctgagaaggaaagaaggaaggtaaccccatcatatctctttggaaacatgctaatgacagatctcctggcaaacacaatcatcatatttactagtgggagagatttatctctgaatgcttttggcagaatacacctggtttgtctaggattgctgttgggaatcaaacctggaatctatggatttatgtggcatggctctttggaaaatgtcatctaagctctgttaactattggagtgtaaaatggagatgtttcatgaacgaagcaactcccttctgttagagacctcatgtattaatggaccaaagcatgtagtcatgcatattctcatgtgacaagaaagacctggggagctgtatgtgtgtcctcaaacctcttccgacttctcccatgcctttcagtgacatctgtccttgaaattattagtaaagcttgattctgggtaagagttctgatatgtatgattcagatttgacattctgataggacattgagggatttttttttcctgaagttgaattttaacattgccttttgatttttattttaaggaaaggttgaaacttgaacgtaacaaagaatacaatcagtttctcaggggtaaggaagaatccagtgaaaagttcaggcaggtggaaaagagtactgaggtaggttttgcttttgaattaaatctgtactactactaccacaggttgaatattttgtacttgaaaagctttttctattttagacattttacttttttttgtaaatacttgcaaaattaagccaaattaaaccaaacacaggacatttaaatatttagttttggaagttattttatctcatattgaagaacttttaacatttaattggggagatttaattttagagatcagttttgttaagtgattttcatttatttttaaaaatttaaatgagtttttatgatgacaattcctagctatgtttgtttttttcaaaatttaaggatcaattagccggacatggtggcaggtgcctgtaatcccaactacttgggaggctgaggcaggagaatcgcttgaacctgggaggcagaggttgcagtgagccaagattgcctcactgcactccagcctgggtgacagagcgagacctggtctgaaaaaaaaaaaaaa

SEQ ID NO: 130079 - DNA, 1306 bp, Homo sapiens
actagtttacatttgatcatttactataaatggatcatacaggatatactagttttggagatatggcttctttcactcggtatgattattttgaggttcatttgtgttgttgaatgtatggatgattcattccgttttgttgcatagtaatgttccattgcatggctgtatcagcttgtttatccattcccctgttgatggacatttgagttatttctggtttttgctattacaagtaaagctcatgtgaacattaatgtaaaaacgtatatatatataaatatatgggtgattaaataaacatcagagttgaaatgatagactaagtataaattgagggtttaattaccttataagagatagtttcttgtcaagttttgtttcttttttcttttttaattgaacagcccaagagtcagagaaataaaaaacctattggtcaagttaagcctgatctaacttcacaaatacagacatcttgtgaaaattcagagggtcctagaaaagatgtcttaactccttcagaggcatatgaagaacttctgaaccaaagacgactagaggaggacagataccgacaactagatgatgaaatcgaattaaggaatagaagaattattaaaaaagcaaatgaagaagtgggcatttccaacctaaaacatcaaaggtttgcaagcaaggctggcattccagatagaagatttcacagatttaatgaggatcgtgtttttgatagacggtatcatagaccagaccaagatcctgaagtaagtgaagaaatggatgagaggtttagatatgaaagtgattttgatagaagactttcgagagtgtatacaaatgacaggtatttacaacttcatttttattttatttgcttaatatagcaaattaattgttaatatttgctgttgttactttttatcattatactagggagaagcagttttgatttatcataattaattctaagatgctgtcagttttaagatgcatcattattttatgtcccactgaggggaaaaagaaaacactcaaggtgggggccctgttgtaaagttggaaaactgaaaggctacaccctttatgtaaaagtatgtgaattggaagtagtcattcccacagaaagggacagagaggaaatgtccacatcccaaccttggcagtgagtagagagtaaagatacaaacaaccttccttgagaatttgaagtgtaaattagtaatgattcaagttcacagtccgaattcatactgccagtagcgtccaaagaaaccttgaggcaagaattcagagttttctcaat

SEQ ID NO: 130080 - DNA, 1414 bp, Homo sapiens
agtgagcagagatcacgccactgcgctccagcctgggcggtaaggtgagactctgtctccaaaaaaaaaaaaagtgtggctgggggttgtgcctcacgcttgtaatccctgcagtttgggaggccaaggcaggcagatcacttgaggtcaggagtttgagaccaaactgaccaacatggtgaaaccccatctctactaaaaatacaaaaattagccaggcgtggtgggacgtgcctgtaatcccagctactcgggaggctgaggcaggagaatcgcttgaacctgggaggcagaggttgcagtgagccgagattgtgccactgaactccagcctgggcgacagagcgagactctgtctcaacaacaacaataaaaataaatgaataaaataaaacgtgtgaaaaaaggataccttaaaatagatgaaatacaatttattcctgtagtcataagttttttcagtcagattttcagatggttttcagttcctttgaatgtttttgtgacactatttataatttcttaactgctacaatgaggttttattgttgtatttatcatacattgatacttgccatagtttaacctaacttgttttggagataggaatacctcagggtctcatatttgtcattgacttgtttacttgacaagtgttaatacattttgagtagcttttgggacctgctttatttgctagtccaaatagattagtttttaagtattttagaaaatgttttcggggtagtgctgtacattcaatattctaactattaattacaatacaaagcttttacagttctttgtcttctacattctgtagctgttatgtcctcacacaatatttttaatatttaccttgatttaggtaatttgaatgaaggattagaatttggaaatggcaattatagtttctctgatctgaatctaattgtttatacttcagaaaattctccaaatcctataatgttatatttgaaaatgcttatatgtaaggtaattaaaggctgactaaactaaaataattcagttggggaactgcaagtaatctttgactcttggtgataatgtctcctttgtacatgagaacttcttttccctttatggtgtttgtttacgtttagggtgaatgtaatgcatacccttttaagtttggaattttaagaaacataatggttgcttctttgtttttttttaatctattacttttataattatatcctgtgataattttatacatgaactaacaaatgaatatcattctatttgagaactctcatatcttcttatgtatcccaaaataaaatgaactccttcaatataaacttttccaaatactatttaagaatagattaaacatgaggttgagtgagaataattcttgttaaatactttaaagtgtttcttcaatata

SEQ ID NO: 130081 - DNA, 1962 bp, Homo sapiens
aaactctgacatctccaagtgttttttcttatgtgtctctttaacaatttaatttaaaatgggatttctttatttcagatttatagattccttatttccagcaaaaaaaaaaaaaagaccagtcattcagtagtttataaatagactggtttaggagaaatgactgtatttgtgaaaattttgagactaaagaaatgtggaactgagtttcatctcttgctccaagcatttattcttaacatactatgcaatcttgatcagaagttcttgacaaaaaataattataatgtattatgagaagtgcacagttaattttccttcattcttctaagttttctttggtcttttttttttttttcctttcctaaaagtcagcatctggtaaattctagttttggtttataataattttttatttttggtttcaatttttctctaccctataaacgtttacttttttttcatataccataattattaatgaaatatttccccatacttaaatatgggaaagctaaaacttttctcagaaaatgatgttgccttcctaaactcatatcatgaaatcactgacagcattcttaattaacaaggtggttaacactgtaattgatagttgcattctgtgtgtgtatgtgtgttgtttatttatgcatatttaccaattcaagtaaaatttatcatgttttaggagctttctaaagtagaatgtaatagcatgtcttaagatactttgaaatttataagctctatttaaatatagtaatcctagtcttatttattaacttgaactgtagaagttaatattttactttattatcttttactttaaccaatgttaatgaataaaagaagttttacttcttaatacccaaagaaaccaggtacagagtagatggggttgataatagaaaacactgctaccaaagtaaatataaaaattgggaaagaatggaaaacaaagagaaaaatgattgtccacagttaacatctcagagtgtttcattagcttctttttttttttttaaagattaacatgtgttcatttttaggataaacttggcctgtaccctatacctggtttctttgggtattacgatttttacctgatcaactagagttgttgactcttgtcttcaaggaaatagggagaaaaatatttttttcatttaaaataccttttttttttagttagtaggatggtgaaaccattttgcagttattttattccctcaatcatatctgatttgcatttcaaagttatgagttctgtccctttgtgacaaaacccaacatgttaaggtgtggtaagtgaacttatatattaaaagccatagaatatttagatagattttctatggctataccaccctggaatgtgcctgatcttgtttgatgttggaaactaagtaggcttggacctggttagtaatttggtgggagagtatttagatagattacttttgggtcacaaggatagtcttaatctggtactctcacagtgaaacataaaggggttccagggacaaactgaacctaaacagaactcctgaactttgattagaatcaaatggttcttagacatttagtgagtgcattacttttggatattatcatctgtctgttttcctttaatgttgagatgattgaatagagatgtagccgtggtaaaaccactgctgattcttactagttgctttcttcagagaggactttttttgttcagaaaaggttacaacaataaattgtaagaccataaaagctgttttaagtgaactaacagagctagttctgggtgattaaatgctaaatttattagaaatataaaggccaatttagtaaatgaaggaaatgccataaaaattgtagggatattttaatagagaataaggtggctaacttaccaaactatagtttgtcttttcagcttaatttcccttcaaggtttcttttttttaggtc

SEQ ID NO: 130082 - DNA, 1483 bp, Homo sapiens
taagctagaattattaatctaaatattatcttcagaaaacttaactaataattaaggaagccacaagccctatgttaattttagaaaaagcttttgtatatttaactggcctttaattctgggaccccaagttatgcttttaagaatttgtaactttaaatttctatttaatttttttcttttttttttgagacagggtcttactctgttgctcaggctggagtgcagtggtacagtcttggctcactgcaacctctgccttccaggctcaaacagtcctcccactttagcctcccaagtagctgggactataggcatgagccgccgtgcccggcctctgttaaaaaaatttgtaataaagatttctttattattaaagaatatatatatatatataaataaagattatttttatatgtaatttttttttggcctagatacctctttactacaccagtgaatttactttttgtgttgtgtcatgggttctcaagaaaacctctaggttgggtgatttgctaggaggatccataaggactttgggtatagttgtagtcacagttataatttattacagcaaaatgatacaatgcaaaatcagcaaaggtaaaaggcacatggaacaaagtttgaaggaaaccaggcacaagcttccaaggggtctctcccagtggtgtcacacaggagatgcttaattcctccagcattgaattgtaacaatataaggaaatgtctgccaggaaagcgattagacacttggtgcccaaggtttttattgtgggatggttacgtaggcaccctgtacctggcatgtaccaaaattccagacttcctgaagaaaagcaaatgtttagcataaactatagtttgtgtaaacagtttaagcacagtgagctgctcttatcagttctgccagtggttgtaactctcccaaaatctatattcccaggtgccagccaagggtcaactgtacagtcaggattttctgaggataggcagtctcaggcctgctctgttaacgcttttctgcattatatataaatatccagtataattaaatctggttgcctggcagtgttaattacaaatttgaatttgagtttgtatttacctgtttgttaagtggtagaagtagggaatgacactaaactgatgtgtcattcacacatcagaatgtgtgtatgtgatctgtgatcgattaaaaaatggaagccattcatgcgttatgccatgtcatagttactaagattaaaattccaaatagtgttttctccacagatgatattgacagtggcttgtatgatggaaacaagggaagaaagaattttatatgctggttctgtggagagtgagaagtttctttttttttccggaaaattgccatttttcttaatccaataatgaaattcacctaaaatactgaatactgctttaacaaccatatttctttgtaatagtcctcttgagaaagacaatatagttg

SEQ ID NO: 130083 - DNA, 1045 bp, Homo sapiens
agctaatttttttgtattttttattagagacggggtttcaccatattggccaggctggtttccaactcctgacctcaggcaatccacccacgtaggcctcccaaagtgctggaattacaggtgtgagccaccatgcctggccaaattattattaattttttaagcctgaatacattggagttgcactgtataaagagatagaatgccatgattttaccttaaccttaaaaatttgtaaatattttaatgtccatagtactttgaaaggctaataattcatagctacattttactctgaaattttgcttcctgaaaattatctggattttaatttactctttttctctgtctttttttctttagtgctccagacaatgaaacatccaaatctgctaatcaagatacctgtagtccttttgcagggatgctctttggtaggcacaaaacttccaactagttgcgcttgtatagagtgtcttataatccttttttaagtgagaactcagtgttgtaattaatactatttttactaatagtagaaaatatttgtaagtgcttactttacactaggtactattctaatcatttaacatatatagctctgtataattttattttgtatttttaaaattttatgtatcttcttatttttactcatgatgttcatgaacacatctatgtataattttaaagctaaattatttagtgatgtgctttccgtaggtgataatgaaattattagtttcagtaatcttttttttttgcaaaatggattgatcattaccaatcagtaatgagcttttaattccatattttattagcactctgttgcagtgtggctgtttcttttctgcttttaaaaagtattttgttttatttatgatagttttttccttaattcttctttctagtttctttagctagtacaaaactgctgtgtattttagtttcttttctccaaattaaacctttctttcctttgttcttttcatgtagtttctgagaaggtgttttgttcaaatcgtgatgatggtctaaattttct

SEQ ID NO: 130084 - DNA, 1052 bp, Homo sapiens
aattgaccagtttaatcagtaccatgtaaaggctatattctttttgttttgtttttatttatttattttattttaaatggctatattcttatgttttgttttttttttttaattttgaaattgagtttcgctctatcactgaggctggagtgcaggggcacgatcttggctcactgcaacctccacctcctgggttcaagcgattcttgtgcctcagtctcctgagtagttggaattacaggcatgtgccaccatgcctggctaatttttgtatttttagttgagacggggtttcaccatgttggccaggctggtctcaaactcctgacctcaagtgatgtgcctgccttggcctcccaaagtgctgggattataggcgtgagccactgttcccggccgatgtagtttataaaacatggtaaaataagagaaatgtctttctgagctgagagcctactgataaataattttatcaataaaaggattattgtaccctgaccttttaaagatgaatggcatgagtttatcactaatgcaatccaggatttatagatgaatatttggtaagacaatggactctaacatttgaaactgttaaagtcatttaattcaatgacttacctcctggttgatcttttccccccaaaactatgtttgtacatacctataggaaacttacgatttccagagacaggacattccatcttcagatggctgtgattgttatgatactcttatttcaattgaactgaaatttatcttcctataattttgccccaaggatgtcacttgggaccttttgctttatttaaaaagtgagatcattgatttagtttagagctaaataggaaatgtattgtggggtttataagagaaccataggtaatttagaagtatgttttaaaatttccaagcatttggggattttccttctatcttttttgttattgactgctcgtttaagcctcttatgatccaagaatataattagattaatttcagttatttcaagtttgttaatttctttgacaaagtttttttttttttttttt

SEQ ID NO: 130085 - DNA, 1002 bp, Homo sapiens
aggacaagcagtccaagttatagtgagattttgaggctccagtattgggccattagtagaaaatgaagaggggcagttggttttgagatgctcgtttgcgattgaaatgttaaatttgtaagacttatggaagatattaatggaaatattatttagattgttagaaaaatggggttgggataagaacattctgttatttaggaaaatttttgactaatggtagaggcatgggcatgattactgtatcttgtgtttgacgcatagtaggtacccattaattacaaaagaaattgaagaaggactgattcatgtgatttttttccttctgtatttcttgcatattagtaattatatgatacaattaagatggagtttttaaggacttaactttctaattgcatacgatgcttaagagttaagattgtatttttctcataccactatctaggaggtgaagatcgagaacttattcagagaaggaaagagaaatacagactagaactgttggaacaaatggctgagcaacagaggaacaagagacggtaatgaaaggtttgcatttaaaagagatattttgagtttaaagtgcatttgtgtaaaatgacatggttaaataaggggttgtcgttctaatatgatgtttgatttgtaaatcacttatattttcatctctacatgctaaatcaacaaggaaaataaatactaagagagttttttttttttttttttggtcataagtagcaagtgagagtatttatatattctgtaatagcccttttacttccctcattgatttcttcagtttttgatttaaggtagcatttaatgttatagatatgcccattggattatcccatatatagtaacaaatataaaagtattttttgccatatgaaatggtatgcacacacacatacatgcaaaaaaaattgtatcctataaatttaacatttccatcccaaatgagcatctcaaaaccaactgtccctcttcattttctat

SEQ ID NO: 130086 - DNA, 1050 bp, Homo sapiens
gcaggagaattgcttgaattcgggaagtggaagttgttgtgacctgagatcatgccactgcattccagcctgggcgacacagtgagactctgcctcaaaaataaataaataaataaataagatagatagatagatattcagagtcttttatagctgtaaaattctgttattcagtaaataaataaataaaaatagatattcagagtcttttatagctgtaaaattctgttattctgtgactgtcttaagtgcctgctgggataggaggtcttttgaggtcccttccacctttaaacttatgattatatgtaacaaacagattttttttctttattttagcctgatagactaaagcagtttagtgtggcaccaagacactttgaagagatgataccacctgaaagacccagaatagctttccagacacctctccctcctttatctgccccatctgtcccacccatcccatcagttcatcctgttccttctcaaaatgaagatttgcgcagtggactcagcagcgcccttggtgaaatggtgtctcccaggtgcttgtttaaatgttttgtgtttgggaattaggtaaggtattgctatattttatgtttagaaggatatactgaagcggatgacgttattcttcagagattttgtacagttaacagttttgtgaaataaattctcttgaaatttgtttttttctctgctattataaaaaaagggaaattcttaaaacattttattgtttaaagatgattttgtatctttagaatgaattactaagtacattttagtatttatttagttttgggttgtattttgggatgtttttgatatcttttaacatataaaagttgtacatttttttcaattttgttctttccacttggcaaacattgaattcttcaatttgtgcagaaaaagtttctaatgtggctcttttacacatataattttattttagcttctgtttcttcagctcattctctgtgattacttatgggctgtgtaactcaaatacctgaaataaaaagtgttgagattataaaa

SEQ ID NO: 130087 - DNA, 1050 bp, Homo sapiens
tgtgaatttttcaaaaatattaattttatttgagacagtcagactttttcctgtaattacattgttttattcttgaaatagctaagaagtaattttattagtaaatcatttaaaaataaatcattagttattgtgttacttgagggactttggctgtgttattatttctgtttgttcaggaagccgcctaagtcatatgtgtactgttcaatgaattaccacaaacttttttcactcctgtgtaactatcacctagcttaagaaatagatacagtgaatttgaaagttgcaaggattgtcaaagcaaaggcaggaaggagctaaggaaggggtcacttaaggattcctctttggcctatagagaaatatccttctgtatttttaaatgtatttatatgccatgctatttcaaaaaactgttgtattttcttcttgctttgtcgtcaatggatttaaattatttattgtgtatttgatgtaggaatacggttggacagaatgaactgaagattacaagtgatcaagtgataaattcaggattgatttttgaagataaaccgaaaccttccaaacagtcacttcagtcttaccaagaggctttgcagcagcaggtattgattcatttactcatttactgttgaacctcttaagtgtaagcatggtggtcccttagagctcagagtgtggccggggaggggaaaaaaaacagttaattataattcaaaatgctgagttttgaagtggatacagtaaaacgctgttggaagcataagatagggaaaataattgcctggggcagttgggagagcttcacacagtagttgatatttaagctgcatgttgtgcaatgactacgttacaagttgctggtgtatacagagaatggaattggggtggaagaaggggctggagagttagttaggttgttctagcagattgtgaaggactagctaataaggggttttcagtttcatctggttatgggcagctgaaggaaggaaattttaggccaagaaaagtatgaaaggattgtttgctttaagcagattt

SEQ ID NO: 130088 - DNA, 1172 bp, Homo sapiens
tatttttagtagagatggggttttgcatgttggccaggctggtcttgaactcttgaccttaagtgatctgcccaccttggcctccataggcatgagccacgacacctgacctaaagtatttttacattgagtattacatatatttgtgattttaacctttgtaggggggtacactggggaaaaaaaaaaaagcaaatttttttgcttgttttctaatacaaaaaataacatctggtattactaacttcttgtatcagaatacttgtcagcgtttattttaaatatatcttatgttgtcaagattcgggaaagagaagaaagaaggaagaaagaacgtgaagaaaaagaagaatatgaagctaaattagaagctgaaatgagaacatataatccctggggaaaaggtggaggtggtgctcctctcagggatgcaaaaggaaatctgataagtacgttatttctactgacttgtttttaaaataagctaaattatttttaactttttaaaagattggggagtagaaaaaagtaggaatcatagcctctatagcaacgcatgtatgtaacttaatgcatatgaggtattttaagagtaaatataataacagaggctagaaagcatttcttcttcagaatactatccatttgtttttattataaatatttcatcctccgatgttgataacccagttgcagagaaaagctcatgttagttgataagtttttactgaaactggtacttagaatattttgttccctcataaaaatgataaaacccatattacaatttaaaaaaaataaactagtaagatgtcttagaaataaaggatgtaaaacagttttgggaggggattttgtgtttaatttatctatgcaatatacctgctaattgcaagaattcctttgggaaaaagaagacatgatcatagaaactttctagcaagtttcataatttgttgatttatctttcaattatgtactctcaaaaatgtttgatctagtaatcacacaacaaatacttcgaaagagtggctttatacaacttgttatatacagttgtctgttggtaaccatgggacattggttccatgatctcctgtgaatacccaaatccatggatgctcaagttcctgatataaaattggtaaagtgttcgcatataacctacacac

SEQ ID NO: 130089 - DNA, 1032 bp, Homo sapiens
aggtgtgagccaccacgcccggccagactaatatattaatcccacttctgtaacaaccacaactgcctccattaccttctacagaacaaaattgagagccattgacatgtgttttaggatattgaagaataggtatccattctatggtttccagtcttatttgccattgctctattacatgtgctttatgctctagtctagctggactactttaatgttgccagaacactcatcatgctttacccacttggagtgctttctcacattgttctatttctctattatgctttcctacttatcttcatctgtgaagctcctatacattttccaagtccaagctgccctaaatattgtaacagaatgtgaaccttcctgattctgaactcccattctcttttgtagcatttatgtattacttgccatgttctatctggaattctaattgtgattcatgttcaaaatacattcttgaacataacaggcttcctgataaatacttcttatatccaggtttaagttcactttcagtgctgccatactgttgcagttttttggtttgtttgttttatggaaaacaggtactttttattttattaaagctttaagttctgtaatcattcagttctgtttttgagattggttgtttgacccaattctaggtgctcagatttttgctgtgtgtattagatatctattctatgtaatgaattaacccaaaacttggtgttttagcatgataaacagttattatcttgcggttctgagggttagaaatttgtgagtggtttagttgggtggttctgtctcaggctccctcataatgttggagtccaagatgttgaccatggcagtagtcatctgaggcttgatggggactgtaagattcattttcaatatggctccctcacatggctcaggaggccttagttccttgtcatatgggcctctccatagggctcccttagtgtccttatggtatggcagttggctttcttcagagtgaatgatccatagataagcaaggtggaaata

SEQ ID NO: 130090 - DNA, 1048 bp, Homo sapiens
ttgagtaaaaaaaaaaccataaaatgtttaaaacttccttttttttgtgaattgaaattcccaaattagacttttcttccctaagaatgaattaattggctgggtgcagtggctcacgcctgtaatcccagcactttgggaggctgaggcaggcggatcatgaggccaggagatcgagaccatcctggcctacatggtgaaaccccgtctctactaaaaatacaaaaattagctgggcgtggtggcatgtgcctgtagtcccagctacttgggaggctgaggcaggagaattgcttgaacccgggaataggaggttgcagtgagctgagatcacgccactgcactccagcctggtgacagagtgagactccatctcaaaaaaaaaaaaaaaaaaaagaattaattaatctaaaataaactttctcaatacaagaaatgattcaaagccacctaattttgtgctatgccatatatatgtgtatgagtgcatgtatgtgtatgtatgtacacacagacacacatatctttgcatatatgtagcatttgatattttaaaagcctgaaggaacttgaatatagctgaaaattgaatgttacaacatgtgtttaagtttccttatcctctaatattttatcttcattaggtttgtttctgatgccctttataatgttcattattttttcttttattttatggtttttagatgagctatggcttatgaagtctaatacgaatttggcttaaatttatttttttggcttattatcatgccaagatacatttctgctttctttgtatatagcaagtgtttccctatgattttccttttatagtttattcatttctaaaaggacttctcttgtctgtctctaataatatttcttctctaattgccccaaaggtttagaataggagtgagcatcacggtgaaacatgctactcaagtttgttttgctaatcagcttttccaccacagcataaaatttaaaagagccttcaaggtgtatatttagtttgttttcagtgggaaaattttctagagggaaa

SEQ ID NO: 130091 - DNA, 1193 bp, Homo sapiens
gccaagatatgccactttattcttgcctgggtgacagagtgaaaaaaggatgattgatgtgacatcactgtttaagatacaataatagaggattaaaaagagtggaagcagggatattttactagtgtgggtgacagtggaaatgggtggaaagtgctttttaaggttcagcagaaacaatatagatattaaatgtgagaaactggtatcagaggtcccaatattgtgcactcaagtcaggtagcagcaagttgagggttcagagtccctgttgaacgtaaaggaccgtgtggtatattgaccatgacagcaggtcataatttaagtacctcctctaatgcttagcagttcttatcatggtctaaggtagaattcagccaaaaaacaatcttacaattgtatagacttttattgtttttgagatacttttacatatagtgtctcatcaaacctcagatttctctgagagaggttttattatctctgtttaataacatacaactaatacacagactaacaggcttgcccagggtgtcacagctagcaaattgtgaggccattgcttgaacccaagtctccagacttcaagtgtaatatctatggatatcagacttctatttataggattcactaggaagtctttacctctagaaaaagtatggtaatgggggaagctttaactattttagtttcaaccttcagttcttccaccctgtcaaccctcaatttatctgtgaatggattgctttcagatgatgattttttaatttttctttcagcagcctcttcaaaatctcttctcccacctcaaacaaaacctaatatgtaattctaagaaaatgtaaaatagatcaatggtatttattattactgtcaacaatataatgtcagataaaaagtatccaaaacttttgttaaaaaaaatattatgaaatgttcaaatctgtgcacaaagatggtaagaaattagcctgaggtctgtacaagtaagttccacagttagctcaagttaatgcatcagaagtcttcatgctgttaaaatttggtgaatattaataacacttgtgaatgtttgacatttttaaccacagctttaaaaatagttaacaaataaaatatttttaagaactctgaagcatttttgtgttatgtaattggaaaaccatgacaggaagatagctttccctgctttc

SEQ ID NO: 130092 - DNA, 1911 bp, Homo sapiens
tcagatctgaaatataggtgatatctacagtaatttgcctgctgcttcgattgtaactgatagtgcttggtgccctaaagtttcttttgacaaaccataatttagcccctcaagctaggtagctgtagatatgctcattgagtctgttatactttagattgaactacaaggaaaagagaacatggaaaatgttctaagattgatcctcaaggtgatgcttgaagaatatgcaggaatttgccttgaagaggagggtgagggattatcagcttgtggaaagtcgtggagagcaatgtaagctcatggcacatgtggagaatcttccatggtgtggtctggcctgatgatgcttgtgcattaaggcagcagaggaggtggaggtcagaacatgtgtggcatgctgtacggagtgctaagagctttgattttgttccataggctggtagattccagacaggctaattagcagaaggtaaagaaatgtgtcagaagaacatgtttctgaattccaccctttgagattctgatttagtaggtctgtggtagataatgcataggaattcattgtaatatttaagtaggggaatgacatggccacttttgtataatgtttttttaggcaatggtgtggagataagttttggaggtggggcaagactaaacatggagataagatgcttttgcacaagtccagatgtgagactgaggacccaaacaaaggcagtgacaccaagaactgtgaaggtgtgacagctttatgatacatttaagagacatagtagtactatttgttgagtgtgtggtgggtaggagtctatgataactttcaagtttttggtgagggttacatagagtaggcagttgaaaatatgaattgtggcagcagaatgagttctggactcgatttgtagttctggacgccatcaacatattggtgcttgttaaattagtgccattgtctacgatgagtgtctacaagagaagtaaaggaggctgagaatagaatactgggaaattaccaacatttgagaagcagtgaaaggaatggacagagggtgagagaggatggcagtgacggcagttgcgactggccaagtaaaatgcccactgaatgtgtcacttgggggtcacttgatgactttggtgaaggcagtattgttggagtgatgggtgtgaaagcaaaggccatagctgtgtgttgagaagtgaatgagagtaggcagtagacccaaaagtactgcatttactgttctttaaggaagctcagctgtgaagggaaggacagaatggacaggagacagtgagcaatgaaggatgaggtaaaatttttttttaagaaagggagaggtttttacacataggctgagaggaaggtgcttggagagaggaagttggaaaaaagaataatcggaggagaatgggagtcaattatcagatacagagtacaggtgaagggattctgtttgggtagaggcaaggacacttccatcgtgatgagaaggaagaatagatttacatggtagatacactctagaatagatataaaaggtggatatactctaccttgggtagagtatagctgggtaagttttggaggtaggatagtgtggagtttggtttcctttacatataaatacttcaaaaaattactcccttcaagcttctgtgtagggaagacatactgaacatgtctttgtcattattgttgaacaggaaagttccatgtccagggcacagtcacccccggtacctgccaggaaaaatcagctccgtgcagaaggtagagttaactactaaacctgttacctagagtatttctctttttaacttttcattttgaaataattataaactcatagaaaattgcagaaacagtatagagcggttaggtgctgtgtacccattctccaa

SEQ ID NO: 130093 - DNA, 1050 bp, Homo sapiens
ctgcaacctccacctcttgggttcaagtgattctgctgcctcagcctcccgagtagctgggactacaggtgtgcgccatcacacccagctaatttttgtatttttagtagacatggggtttctccacgttggcccagtctggtctcgaactcctgacctcaggtgatccacctgtcttggcctcccaaagtgctgggattataggcatgagacaccatgcctggcctcataattttttttttttttttttttttgtagcgagggggtcttgctttataggccaggctggtattgaactcctgatttcaagcagtcctcctgtctgcctcccaaagtgctgggattacaagtgtgagccacagcacctgtcctagagtaattttttaataatatgatgtggtgaaaaagaccaaatttcttttacagtgaattagatgtgaactcacctatttttcctgtgaagcacatattatgatttgtcatttatctataggaaaaaggaaaggaatcccatggatatatttgatatggctagacatcggttgcaagctcctgtcagaagacagtcccctaagggcttagacgctgccacttttcagaatgttcatgattttaatgagctgaaagatagaggtgagtagattgctgctcttttaaagatgtagcagaagtgttctacccatatttaaatatctataaagatctttgtaccctttttctaaagtggaattttatctatggtatgtattttagttaaaatgaaatgaaacttatgtattctctaggtcttcagttaaccagtctggtagatgaagctttagtttgactaactgctttcttttggagagcatacagtgttaaagtctggaatggatgagatcgcatagactagtacgaagaatggaacttggcatttaatggaggatggacagacaaagatgagctcatgaaaaatactgaggagaagccagagagactggaggagaagcaggagaatgtaggatcctgaaacctgaggggaaggagtatcaaggagacaggatcatgtaa

SEQ ID NO: 130094 - DNA, 1022 bp, Homo sapiens
cagcagtaaaatgtaataaacaacttaaacatggcacagcatagatgaatctcaaacaccttattgctaagtgaaaagacaaaagattaagttgtagaattccatttatgtttggtgttaggtaaggtaaatctgttgaaacagagccgtgtttgcccggggccagcaggtggggagtgattgccagtgtgcacaaaggagctgtttaaggtgatgaaaatgttctactttaaagtgatgattgtacaactctgtaaatttactaaaaaaatcaccgaactgtgtatgtacatacattgagtgtgtttcatggtattgtaagcaaaatcttagtaattaaaaggctcttggtttagctctgggtaagatttgaagcagtattaagactccttctgcttttcggggtcctcttaggggcttacggtgagacatatcctgccattgaagatgacgtcctccctccaccatcacagttgccctctgcacgggagcgcaggaggaacaaatggaaaggactagacattgtatgtatgagacttttctcccccttttcaacttagaagaatgagaggtctgggttctgacctgtgctaaatctgtgtggcccaataaagagcacttgcttgaaattcagacatgggtctgaatctaggctctgccttgactggatgaccttgggtagctattgaattctgctgctttggcttcttccagataataatagtattttcttgtctcctggggtggctgtaagtagctcctcatcccaaccttccttcttctcctgcagaatatatggatttcagagaggcacaagaaggaactgatgtcatttattgaaaagcttcataataacctaattctgtgatataggcatcaccttcatttcggtcaaatgacttgccaaggtcacatgggcaagaaggctgagattcaaacccatgttctcctcactctgctccccagctttacaatatagccagtaaaaagtagaggctttggagtttatgtcccagcaatgt

SEQ ID NO: 130095 - DNA, 1043 bp, Homo sapiens
ttatgacaaaactgtgcaaaaataatctatacaattctattatataaatcaataatcatggccttttatttatgtacataatatacatcatgataaaaataattttatatacagatgatggaaaaaaagtaactttcaggtaggggccaaaagtaggacatattaaaggtacagatttaccattcctttcaccttaaaaggcactactgggtccagtacaggtttattttaaccatgtgcagtcgacaggccctgccaagtgaaagtgcctggttttccaggaatctgctgctgctcctggttcagctgctctgccatgaaacgtttcagcgtttctgaagtgccagggcggagccagggctcagttgctacagagtttgatccgtcatcccctatgtgtttcatgatgtcatcagggtcaaccagtgaactctcatcatctacaggaggcaagggacacgtggctcaggtaacacaggtggcaggcaggagacataagcgcaggtctcttgtagtccaactcattacaactcagcatttccccacagtctcatatcctgaactctactgtttgtttgttttggttagactcaccccaccccaccctattttagagggaggagagtgggcccacaaaggccaattttgtaaaacaaaaaatgatcaactgagtaagctgactccatggcactagcaaccagagggattctaagcatatcaaaggcacctctccataaaacaaagtcaacaggaggaatgtaggtagtcttattttgtaactgttacctcaggagaagcctaatggctacacataaaatttctttcttttttctttttattttttttaaagcaaggtttggggaatactcttcaacctacaacactgctataaggaaattattaagttattttgggaaaacactagttggcatgagattacttccattcttaaaacacctaatctaacaaggccgtgtccagtcaatgaagaggtagctcttgcttcattctttaattgaatctgattgattgtacgcaacttc

SEQ ID NO: 130096 - DNA, 2115 bp, Homo sapiens
aaatttcagtaacccatagcttataaaatctcaactctagtttgtactcacttgcctgctgcttattacccaggaaaaacagtgctaaattactaaaagtttgtcaaagatatacagacaaatgtttttcaaaataaggatatgtaagtgaatagtgtttgtatgaagtgagtttttctaacacttctgtctctcagttccacaaaccagagtcactgcctgctgtggaccctgctttcctggctcctgtgatggagccccagagtagtttgactctaggcagtttaaggctctgcagtttgcaatcactactaatggagaaattcattttccctgcagtttaaagctcatgcatcattctactaccctctcttatgtgaaattatgcaatttgacttgattcctgaacttcgtgctgttcttagaagattttttctgcgaatcggagtagtttttcagatatcacaaccacctgaacaggaacttggaataaacaagcaatgatgggaacttaatatttttgttggcatttacatccctctgctctttaaaaggacgctggagctgaggtttcctacctgaaaaatgatttctctggattgcagtgtctgagttactggtaaagatgcttagaagtcttactcaaacttgcaacactccagtcccttttagtgctggtggattttgtgtgttatattggcctcatgttgagcagaaagcctgtttaaacagtgtcagctcatgctcacgggtccttccctgtcttccacggcaggaaaagccccacgtttttggcaggtgtggaagtgaaacttacccaaagaactatagatgtaaagattgaacttctacaagaagtacaactcaggagagctgtattttgaaggataaaatgtttataattggggagtggggagagaagaagaaattattgttcatggtaaaagatatttagcaactatggtattcttattctgaagatttttgcacactcaggctatctgagatactggtaatcatcctgtgaaaaatgtacagagatgcaggtctgtaatataaaaatcttaaaacattatatagttcttcctgcactgttttctttattttcttattcatttgctaaatacccataatattttgtcaaatgcactaaacatttgggtggaactttcttttttattttatagggatttttagttttgccctttttggtaggtggtgattttgaggctgtaacatgcccagaagctgttgtggccgacacttcaacaatagggaaaaaaaggtagaaaatatccctactgacagtaactacctgtcacatatttctcttaggacttttaaagatgagccattaaaatagaatgatcctttatggaccaaaacttgaatcactgcaaaatgaatccagattgctgtcattttcttttcttttgggtggtggggcttgatgtagattttactctatgtacagaatttaacgttgaatatattaaaataacaaatctggcatggtttgcggaggttagatttactggaaatgtattcatactgtgaattgtgctctgatggttaaaagacaagattgtcaagcattccgtattaacagtggatgtagaaaattttttcagatggacaaaatgtatatggtacagatgtaaagttttctatgtaaaaaattctgtacaactttctgtacaatattgattcccatctggcatattctaatcaggttataggtcaataaagtttttgaattatttcatcagtgcaatcaaaacctgtataacccacccccatgtttcattgattctggtctattaaggctgaacaactatggaaaagacattttcagccagaactacaaattcaatattgtttggttctggtattttctttccagcttctagcattagatcctccttacactgtacttaccataggatacttatttttaaggcaatttttaaaatttttatttatcttttagagaccggatctcactctgttgtccaggctggagtgcagtggtatgagcacagctcactgtagcctcaaactgggctcacgattctcacactccaccctccccagtagtgaggactgtaggcacac

SEQ ID NO: 130097 - DNA, 1049 bp, Homo sapiens
acttacggaatagatgttctgaggccaattaaatacattttagaattttaagggatcacctagtctctgttatcccatttgattgacaagactgattgattaaggccccacagggccttgtgatctagggcctcacaagggtcagtgaagagaggagtcgcctcagattccagtccaggtctcttgaaactaagctttgcatgtgccacctgccacacggcagctttgcattgaaagaaacttagaaaattaggaaaatgtgggtttcctggtaagttacaatggcttcttttaacatgtttggttttcttcccaatttgaaaagcatgtttatgttgacactccagctaatgtaaacagatgggatctaacatgttcttgaatagttcatattcactactatgttcatgattgctctttctcggtgaatatggggaccagtagatacgcaagtaacattaaaggaaaccttttcttttgcagtgtctgcagtgaagcactaagttacttcctcactctaacatcagaaagtcatcgagaagcctggactaacttactgcttttgtttctaactaaagttctaaagataagtgataatagggtaagtatgaggcttcgaatccagccccacatttctagcccaattcgcattgggatgcggggtcccagagccgccgtgcaagagctctcagagatgaatcaagcagtgcccaggctgcactgctgcttgtgcaaagccaccagtggccttgctgtatcttcctcagtccttgcttttctccccccttacccagctttgttcactaattagcagttctctaggggattcagtaggcgagggatcagaatcccttgggataccttgacaagttcccattatgaccccaggaatctccccctttgccccattttgaaaactgctgtccaaccacctcatggccttgtactctgcctactactcaagactacatctggttcctgggcctgtgctctgggctgcagctgttcctttggcatatttagtggttccaggtaacccagagtcccta

SEQ ID NO: 130098 - DNA, 1120 bp, Homo sapiens
tttgtttgcatgtgcattggggggggtttcctcacagaatttccagaacaaaaattgtttgctgccctgttgattaaatgtgttgtgcagctggaactcatccagactatcgacaacattgtcttcttcccagccacaagtaagaaagaagatgcagaaaacttagctgcagcacaggtaaggagataggaggacagctgctttttttgtgtaagtaggaagttaggtatagcagtctgggctgtagagttaggctagagaattagtttgtggggccttcatcatacagatgtccttttaaaccatgagactggatcccatcacaaggtaataaggttagctagagcagggaggagggtcagcaactgattactagggacctcatcctctacagctcctggagatgaggcagctagcagagactgaagacgagaatccatgaggcatggggaggcacggggaagcaggtgtcagttgtcggggaagtcagatgaagaaaatgttttaagaagaagcatgtgatcagtcgcttgttaaatgctctggataggtcaagtgatattacacctgagaattgccctctaactgtttggacgactttggaaccttaacagtgtgttaaatgttaaattgaggacaaaagcataattataatggggagagagagagagaagagagaatgtggactcagccagtactctgttaagaagttttgctgtaaaggcacagagaaatgtgatagctggattgtgaggggttcaagagaggggtttgctatgttttgttctccagattggtgatatggcagcgtgttcactggtaagagctttccagtagggagagaaaaactgactgtaggcaagagaggggcaatttctagggccatgtttttgagtgagtggagatagtacctcatacagagtgggaatcacctggggtagaagcccagacagttcccatgtggcggcagggggagggctgggggatgggttgtggatgcaggaagtctggtacgtttggggtaggagcttgtgagagacctcctctgccagcttctggtttctcactgagatgggaagaaaagtcatctaccatgtgagatttggaagaatgttttagc

SEQ ID NO: 130099 - DNA, 1069 bp, Homo sapiens
cccttttctccacactgcaccccaaccttagtcggcctgtgcccatttccctcactgctgcccacacccctgtctccatacagggatccacaggtcacctgtattcctcccctcaccttttcacaaaaaagaggaaccctttacttttttactggatcaattcagttccatttgctgaaggaaaattacaacacctagaaaagaccacagcctccttagaggagaacaggacagctttgagaactttttaaaacctgaggtgaaatttacataacagaaataacaatatgcaagtgaataataattcagtggcatttagtacattcacagccaccacctctatctagatccaaagcattttcatcactcctaaagggagccccccagccccataactgttatacagccacttcttcttctcctcttccccagcccctggcagccactaattagctgtgtttgtgaattgcctattctgcatatttcatataaatggaatcatacaaaatacaaccttttgtgtctgtcttctctcacagtgttttcaagacgcatcatgttgtagcataatcagtaattcattcctttttattactaatagtccactgaatgtatagaccacattttgtttatccatttgtctgatgatggacgtttgtatttgtttcacctgtagttgtcatgaatagttctgctacaaactgttgtgtacaaatatcatttgaatacctgttttcagttcttttgcattatctacctaggagtggaattgctagctcatagggtaattctatgtttaacttcttgaggaaccaccaagcaattttctatagccagtggctgcaccattttacattcccaccagcaattccagtttttccacatctttgccagcgccttttttgttgttgttaaatgataaccattctagtgggtgagaagtttacctcattgtggttttgactggcacttccataatgattagtgttgttaaccatcttttcatatgcttgttgaccatttgtatatcttatttggagaaatttgtgttcatgtcctttgcctgttt

SEQ ID NO: 130100 - DNA, 1050 bp, Homo sapiens
ttttttttgtaaatccttttgtttagggatgttgcatgaataaggcttctagtattgggtaaaaatccccatttgaaaaagattttccaaaatctaacttttgttttgttcttagactgctgtatatgtattttcttttttggctacagtgccacaaaattaatattcactcaaacggttatccttttcaatttgtaattccatttacagttttttaaatgctgcattggtgaggtaagagtaaaggaaaagtaaaataaaaaagtttacagccaagacctttggagattttttttcccgaatgatgtatcctaaaggaacctgttgttcttacaacttaaattttttaaaacccagtgtcatgtgttaatttcagactagttttaagctttctgtttttaactgctttgtgaactctaaaaactattttaggagaagtatgcttttttgtattacagctttctaattgtgttttgtcattttaggggtttaacagtaatgtttgaaataatgaaaacatatggccacacttatgagaaacactggtggcaggatttatttagaattgttttcagaatctttgacaatatgaaattgccagaacaacagacagaggtaagaggatacacaattttcatttagcttagtcaagttaaaagattctcagtattataatcaatacattttagtgtttcaaattaagtacagaaaagaattcctagaaaatttttctttaaggcatgagaatgtaatactatgtctttataaataagaacactggctgggcgcagtggctcacgcctgtaatcccagcactttgggaggccaaggcgggtggatcatctcaggtcaggggtttgagaccagcctggccaacatggtgaaaccccatctctactaaaaatacaaaaattatccgggtgtggtggcaggtacctgtagtcccagctacttgggaggctgaggcaggagaattgtttgaacccgggaggtggaggttgctgtgagctgagatcgcgccactgcactgcagcctgggcgacgagcaaa

SEQ ID NO: 130101 - DNA, 1039 bp, Homo sapiens
aactagtgatggagatggtcttgagacccatggagtattaaagcaaagcctttatttttgaccagtaagtacattgcacagccttcttcaaggaggagtccccttaagttcaagggggactgactgaaatactaagattataagttaagcctatatggaagatgacaatgatgaccatcaacatcaagaatcatggcatcatcatagctatcatttattgcgtgcttgcttaagtattacactaagcacttcacttatattattttacgtagtgcttacagctatctgtgtatattattattatttccattttatatcaagaaaccgagatacagagaggttaagtaattttgtatattcattcaaccaaagttgaatcagtacctaccgtgtaccagtcactgtattaggtgctatgtttataatgtaaacaaaacagacaagttttactattctcaccactcagggcagtcagttaagtggtaaagatagtcttgaacttcgtatctgttggatgtcagaacctgtaacaacctttaagaggaagtgcattacatctagatgttggtgtatttttggtacagctaagaataattgaaaaattatagtaatatatatttttctctattttagcccttgtatttgaaaaacactttccagcgaccattgattctttccaggatgcagtgaagtgtttgtctgaatttgcgtgcaatgcagctttcccagacacaagtatggaagcaattcgacttattcgccattgtgcaaaatatgtgtctgatagacctcaggtatagcgtcatttagtaaacaaaattttgcagagtattctttccaatttgaaatcttaagtttgtttgggaattgagggtatatgaagcatttatttttcagtaatttgaaaaataatctgagcagcctgattccaagttaggatggttagtgattataactaaccattattgaaagtgtcaggtatttttctgagtgtttttcattaacttgtattaacttgtttaatcttctaatggcttta

SEQ ID NO: 130102 - DNA, 1738 bp, Homo sapiens
agtatgaaacctctccccatggctccccatgcgctcaatatgaccaggaacttccacatttaaaccagtagaacaaaagaaaacattagcaaaaatgggtagagaagaatgaaaagcaatacattttttagtcataaatggaaggagttccaccagggaagaaacagagcttattagactttgaccttaagtatttctgggtttgaattcttctgtattttttccttattatgtgtaagttactttagttcgccgagattcaatttctgcttttgcaaacaaagtaatatctaatcataggattgttaggattaaataagaatatatatgactggacttagcataatggctggtatattcgaagtttctagatattctctgtccatccctccccaaccccccacctccaaccaatctggacgcattacttagagcaggaatcttctatcttttagtgattcctctgttgctgctagcagtgaaaattcttagaaaccccaaaagaatttcaaactttataaaggatccataggaaaagaattaaaaaccaggaccatgatatggcttcaagttggactggggaaaactaattcccagtggtaatcaactgaagcagctagcaatgcagtctgtccctccatgatagcatagatgctatagtattgtaaggtctgggaggtgcaggtgtagacttgataccttggtgatctagcagtaagatttagaactacctgagcacctgcacaatgattagaagcccaactttatacattagaactgtaattactccatggggtaacatgagatgcagatgaaaactattttcaggcaagggaagtgaatgtgcactgattggctcagtaactttgaaaaggcctagagagtgtgggaatgccaaaataatgacaggtgttaattgctgggcctgagttttggcaagtaggactacagaattaggttacactaaaaataaaacaccagtgggatatcttctagaagttttagtcaaacgagaaataatgatacttgctgataatatttactggtatacttgaaaatgaattaaaattaattcatgtactgtgctacttaggttgcaaggatatgagatgaactgtcttctcccttcagaaaaagggaatttacagaaagatacacacattgaggcctagaaatgaaaaacagttcaggcttccagaccattctcaagaccagtaacacttattttatgccttatttaggttttctctgttatgtacttctctttttggtctgcaccattctctgctcagtcctgactccatgctccattttgaatccacatcctagaaggagctagtctgtggacttggcccctgttgggcagagccctcccgttgggccgtcccgttggataaccagccaacccatgtggcaaatggctacccttgtccccctgtgcctaccaaggtcagacagcagatgctttctggagcagaatgttgtcatcagaatttaagctagaagaagatgtggtacagtcaagccagtttagtctgcatatacagtggatacatatatatatatatatatatatatatatatatatatatatatatatttttttttttttttttaactaatatcttttttttttttttttttttttgagtcacagtctcactctgtcacccaggctggagtgcggtggtgcgatctcaactcactgcaacctctgcttcctgggttcaagtgattc

SEQ ID NO: 130103 - DNA, 1873 bp, Homo sapiens
taactattgcctggatattatttagttgtaatttgataggaggaatcattgtctttgattcctaaaggagttaaacattttttttttcactgccttaagaaccgtttgtatctcttcttgtataaaatataacacaggcttccaaatagatacactgtttctccacagaatgtgtaagttattgctgtcatatggtactttgtagtttagaagtacggcacttatgtttctctcagcttctctctgtagtggcagttcaaatataatagatgaagaaaagtgaggttcagagagattaaataagtggcggagctgagactagaacctaggttctatgacttatgttttttttgtttagagattataaatgtttacttctcaactttctgaagtttagaaacaaagctctgggtaattgttttccttagtaatgctaaatgctttatagatcttttagaaattcgattgtaatttctatagcgcactgatagaaacatttttcatctttatggctatatggctatatagtttttctttatgatgaccacttaaaagcagttgaatactttcacatgagacatttcaaggttatgtattttattagaattttcagtggccaaaaagtagcgtcttttttgctttatattgtaacttcattcaggattcaaagttttgatagtaaaatttcagtaagtatttgttgtcttccacagtgtataatgaggaagtattttatttaactactttttaaatattgtccaactggaaaccagaaatatcactgatgtctcaatgtaaaatatttaactattttttaaaaattaggctaaatgatgttcagggaatgggcttaaagaaaagataataatgttgtttgttgcaagtaggaaaatgattaacaggatcttactggaaatagtgtgaaatattgcaagagacaaagcttacaaagagagaggagttctgaagtcgggtaaaactaatatttttatgaatattgattatttccatttttaaattgatgtgaataatttataggtacagttcttaaaatatgcctaaggtcctctattgaatgtattattttgctctcccatttattcaagcccaggcagcattatatagttttccccctttgtttaagaaagctttctagataactgccaagaatttcatttctttttttcagaacttgtattgtctaaaagatttgagaaattttaatgtgttatcataatctttaattaaaatacaatttttaatttttgtagttggcttggacgccttttctggctgcattcagtgtgggtctacaagattgtgatgatactgaagtagcctctctttgcctggaaggtataagatgtgcaatcagaattgcatgcattttcagcattcaggtaacagagaattttgtctttgtagccagtttggaacattaattacctatgccattacaatagtttaaattacaataattgtttatgtgtgacattaaaaactaatttcaagtttatgatggaatttaaatgaatcttaatgtttaagcttctgagaagctgttatagaaggggtagttctatactgatctgtctaagtttatcattataactttggttacagttttttttctctattgaagactatacagaaagttttcaagactttgaattcctatgttaatttgaacatcttgtttaaacgaataaaatatcttgttgaatcatagtttatatacaaggttgtatatattttatatgatttcataacttaagcctaagaacaggttatctttaagacatgtaaatattgaatacataattttcatgaaagaagtcctttctagtaatttatatgctttgaggaactttta

SEQ ID NO: 130104 - DNA, 1057 bp, Homo sapiens
gtttccctgataattgtattctgaaagtggtacctactcgtttcccttttcataggtttccacttcctgactcccagtctaggaatttttttttttgaggtgaaattcatagaacataaaattagccatttaaaaatgaacaattcagtggcatttagtacattcataacgttgtgcaactaccacctctaattccaaaagatttcattatcccaaaatgaaactccaaactcatcaagcaattactccttattctgtctccccccagcccctggaaaataccagtctactttctatttctatggattttacctattctggatttttcatataagtgtaatcatataatatgggatctcttgtgtcttgcttcttaggattacttttaattactggtggtgtttattatttgatagtaaaatatcaaaatagaattcttaaatgttttatatttaaaatgctgatagtgtttattgtttcagatgtagccagtgaaaaacaaagaagacttctgtataacttagaaatggagcagatggccaagacagctaaagcactcatggaggccgtgagccatgttcaggcaccctttacaagtgcaacacatttggagcatgtgaggcccatgtttaaggttagaattttcaagtaatgtttgattgcagtgtacatttatatataactacatttataatatttttaagttaaggaagcgatacagtgatataacacattagtgtagacatattgaggtgaaattcatataacatgttatttaggacatagtagatacaaattttctattacttaaagagaacaagaggagttactcactataagtaattaatagttgtgtaatcttaggaattaagcaaagaaaagtattggagaatgatcattaatccttggcctgattttctctaaatgagttatgcttaagcctttggagttaactcacatttcaaatgatcatgaggctcttgttttctttaagtgttttgggcccaggaacttatatcaggcttctgaatatgcctggggcccagaaagtagggta

SEQ ID NO: 130105 - DNA, 1003 bp, Homo sapiens
ctgccttccacagttatcaacttatggccggtcttgttctatctatatctctttcctcccctagataattttgaagcagatctcagatatcataccatttcatctgcatttatctcagtgtgtttctctaaaagagaagtactctagttaaacataaccataccagcatacctaaaaagttaacaataatttaaaaatacctgatatctagaaatgttcttttgcctcatgaaattcatatttacttcttaaatattgaagaactgtcacttgatttctgatacctacttaaaaagtttgatttaaagttttagtattttttgcttagtttctaaaaacacacattgacatccttgggtaaaattacatttataaattatttgcaaggatttcttagtacttctaggggtaggtatctgatgatatttgttatgcttaggttgtaaaataaattacctactttctaatctgagatgtattggaaaaattaaaattcatttgaattttgagattaacctttgcagtatagggattttttgtgtctgttttgagatgtttaaagcagagtagataaggaaagtatataccaaacctaaagtaagaatatatacgattatatacatatgtatatacatatgattatatgtgaagttactcctgttttaaacacaatattgagcaactatgcatttaccacaaatttacttgattttatataggactttaaaaatttattaaagaatttaataattcaagatttgcctctggcatatttttggcagtatagtcaaagcagctcaccttcagggcttttattatcgagcatgatgacttctattctacggctttataaggtagttcacagttgggatttgtttagatatttttacaccagaattttcagtctaattttttcatttgatttttcaatctacactagagtattttgacctgggtttacatatgtttggttttaaaaagctatgctttaaaagacatttgg

SEQ ID NO: 130106 - DNA, 1662 bp, Homo sapiens
tgggctacagagtgagagtctgtctcaaaaacaaacagaaagatgtcttggttataatataatcatctctaattggtcctccgtagccatgagttctgtatccatggattctacatctgtggattcaaccaaccacaaattgaaaatattcaggggaaataatgggtaattgcatctgtactgaacatgtacgaactttttttcttgtagttatttcctaagcaatacagaaaacctatttacattgtattacctattataagtaatctagatatgggagtagagtatatgggaggacgtgtgtaggttatatgcaaatactgtgccattttttataaggaacttgagcatccatggattttggtgtccatgcagggtcctggaaccaatcccccactgatactgagtgatgactggtgtgtgtgtgtgtgtgtgtgtgtgtgtgtgtgtgtaaaatctgctttttaaattttctaaactgaaaagaatatcctgatatatttatgaaggcatttagtgtgtttaacttttagctttgtgtttgaaattgttaactctataatcaaaagtctgcggatcttaacaaaattttctgctttttaagtggctgtgtggtgaatgtaaacatctcatgaaaatctcaatttctggccgggcacagtggctcatgcctgtaatcccagcactttgggaggctgaggcgggtagattacctgaggtcaggagaccagcctggccaagatggtgaaaccctgtctctattgaaaatacaaaaaaaattagctgggcgcagtagcaggcgcctttaatcccagctactcgggaggccgaggcaggagaatcgcttgaacctgggggcagaggttgcagtgagccgagatcgtgccactgcaccccagcctgggcaacagagcaagactctgtctcaaaaaaaaaaaaaagaaagaaaatatcaatttctatctctgtttttactttagactcaagtgggtgagttcctgggagataatgataaatttaacaaagaagtcatgtatgcatatgtggaccaacatgacttttcaggaaaagacttcgtttcagcccttcgtatgtttctagaaggatttcgtcttccaggggaagctcagaaaatcgatcgattaatggaaaaatttgctgcaagatacctagaatgcaaccaagggtaaataaggttcaaatgctcattgattgtctgttatatccaaaccactgtgctaggtagcatccagggatttacagataataggacctaatcccctgtttagagaatttagattgtctacaatctggaagtcgtaaaacaaatccataaaaaattgtaatgtgagatacttagagaaataaaagtgctatgggatttgaggtgacttatttaaatgaaactatataaaacagtagaagtttataacatgatacatttatttttccagacaaactctctttgctagtgcggatacagcttatgttttggcttattcaattatcatgttgaccacagaccttcacagtccacaggtatgttttcttttaagtcagttttacaataagcggtacaaaataagtacattattctgaattcagtaagtaatagttgaaattttagttttattcagttaaaccagtcaccatatttgggta

SEQ ID NO: 130107 - DNA, 1036 bp, Homo sapiens
agatgtgcgagtcttccttccacttgaacacttattgtagggttcttaactggcctaatttcagtatttttttgtctcagaatagggaagcccaaggaaaggaagagagatgagccagtcagtggagcagtcagaacacacacaagtattgattaagtttaccatcttatatggacgtggtttgtgtcaccccaaaacaattacaatagcaacatcaaaggtcactgatcacaggtcacagtatcagatataatagtgaaaaagtgtgaactattgtgagaattaccaaaatgtgacacagatacaaagagagcatatggttttggaaaaatggtactgatagaccctcaatgcagggttgccacaaaccatgaacctgtaaaaaacacgtatctgtgaagtgcaataaaatgaagtatgcctgtatgaaatatttagtattactcaaagttcgtctactacatggcattctctctaatagtctctcatagtctaatttcccactgtggatatggataaaaaaatacttcatactgtaaaaaagtaagtaaacaagtcagtgaaatgatagtaataaagatggccttccatatgagacttatttctaaaaagaaaagaataaagaaaacttggcacaatgtaattattttgtacattcatgtactgatgtgtattaaataagctactattttctgggtgctattagaaaatttactgtggtttaagatcttttcagggactacgaatggttttctatttttaatgttcttatttaacatcatctagatttaataagaaaccaaagagaggaatacagtacctccaagaacaagggatgcttggcaccacacctgaagatattgcccaattcttacatcaagaggaaagattagactctgtaagaataccattttcattctaaccttttctgtaaaattcttgggatttttttttctttttattagagacagggtctcgctatattgcccaggctagttttgaactcctgggctcaggcaatcctcctgcctcagcc

SEQ ID NO: 130108 - DNA, 1063 bp, Homo sapiens
acctttcccaggaaatatattatgaccatctaagttagttacttctactgtgttattttcttaccttgtgaatacatctatttgtcacagttttagtattataattctttaaaattgtgtttcttccattacagtgagagcttctaggggtagggggattatgtttagcttagtgaaaagtgtttcattttatgaatgttaagtggttatggttggatgagaacttgacaagggaacctttaggaagagcatcccagactaagagaatggcatgtgcagcagcagaggaaagggaggacatctgagcacttgttcagcatggcaggctagagtggagggggaataacaggaggtaagattagagcattgggttggatctaaattacagaaggccttattctccatgtaaaggactttttgttgtcttgttcctcttggcgctagcgtgctagtgaaggactttaagcagaggagtagcatcatcagatttctgttttgtaataggactttgctggcagcctgaagggtgcattagaatatgggcaacatgagctagagggagaccatttaagaactcttgcaatagcccaaatgacaggtgttggagcaccaaagtaacaaaagtaggaagtaaatgatctgtaaacagagaggtaacatttgaattggatctttaagcctgagggagactcccctgtgaatggagcaggtaaaagacatgcagaggaaatagactctaaaaatagatttagggaatgggatatgatatatgggagcagaggaaggagaagggagtgagagagaatctggagctgtattgagaaaggttttgtgtggtctaattaatttggacaaatgagccaagattacttgaagattaagtagaatgtatattcggagtaccttagggatattgtgggttcagttccataccacagcagtgaagtaaatattgcaatatagtgagtcacaccatttttttgatttctcagtgcattaaagttatgtttatactgtaccatagtctattaacctataacccccttatgtctaaaaaacaatg

SEQ ID NO: 130109 - DNA, 1050 bp, Homo sapiens
cagctgtgttgagaacaaaacacatcaatgtgaattgcagtactgataactagaagggcaagtttaagtcacttacccaagatattttagtcctgaggattcagagatggaactcaaaaggagttgaactccataagagcctgggtcctaatacctgctctatagctctgggatgtttaaaaagtgatcacacatatgaattctaaacaatattttaaacagaagttttctcctaatcacaggtgttctttaaagaaattttcttatacattttggaaacttctaccagctcatttgatcacaaatggatggttattcagacactgacgaggatttgtgcaggtattttaaattatcctttttattatctctttcttattattagatatttaaaaggccaaatgtactcatatcctagatgtactttgttgaaattaatgttatattgttacagatgctcagagtgtagtggatatttatgtaaactatgactgtgacttaaatgcagccaatatatttgaaagactagtaaatgatctatcaaaaattgctcaaggaaggggcagtcaagaacttggtatgagtaatgttcaggtaagaactataaaaacattttcaaatttaaactttaccaggaaagagtcatgtgttttccttaaaagacctttaaaaaaaattttgtttttgaattactttgtaggaattgagcctgaggaaaaaaggtttagaatgcttagtgtcgattttgaagtgtatggttgaatggagtaaggatcagtatgtgaatcccaactcccagacaactcttggtaaggtgatattttgagctgtaattctttgtcattttaagtgaataatactttggaggatagttgcagctgctgttaaaccaatttcatgacatatttattcatttaactgatgaggaaacattctctgtgagttaaatgtctagctttaaaattgtgagatttttaacttagttatccaaactatttttttctaaatcttcttagaaatattttgattatgtaaaatgaagcatattta

SEQ ID NO: 130110 - DNA, 1103 bp, Homo sapiens
ggggcttatggtacaataaattttggaaacacaacatactgtatatccttggagagttttgtacatattagcaacttaaaggctacaataaagaaacctatttcccagcatttcctgaactaatttgacaatgagatattttttcgaggaatttgtcttcacatctcaagtcattagcattcatcaaaacccagttcagtaaatgctaatatagactaaaagtaagcttctgttttggcacatcctggttagcctttcatcagctaagtgtgtttcattgccagagcaacttaaggattgtatttggaagtatgccagatgcatacttatttagtagtaagtatgctaacctttaaatggtgccaatacatattttacttcacattgctttcctgccactgtttcattttaaatactctgtgctttttaaatacacttcggttaagtcagatatatttgcatggtttttattcttatcattttagatatgggagaagggactactataaatgcaagtgcagatggcaacattggaactatagaggatggtagtgacagtgaaaatattcaagcaaatggaattccaggaacaccaatttctgttgcatatacaccatccttacctgatgatagattgtcagtctcttccaatgatactcaggtataaatggaggggtggggagggggagaaatcctgttaatcttacaaatttataggctaccaccaccttgtcatgagtattttcagctgatgatgctgcctgatttttatttagtttggggaaataagaaacttggggttttttttccttcatttatataaattacagcgattttttccccttcatattttgatagttacatttccaactttaaggtaggtctcatctatgtttacatcttctccacacccatctaccaattgaattaacatttaataagaacattcttattacatattcacaagataattctggtatgggctgaatatttctaatctgaaattcaaaatgctccaaatccaaaactttttgagtgccaagatgacgctcagaggtcatacacaaaggaaatgctcattggagaattccacattttggatt

SEQ ID NO: 130111 - DNA, 1009 bp, Homo sapiens
acaggcatgagccactgcacccagcctacttacattcagtatatttgataagggatagtgtaatgtgtgtactaagtataagtaagcatctgtaggacatgttagaaatgtttcatttaaaatagtttttgaagttttggtacttaaaggactaatctagaaaattcagttaagtgtaataatgtaatagcttgtcaaaggaatcattgaaattgacttgaatttggaaaatatttaagttttggtatacattttgaaggtttagcatataattgcttctaatttcatgttatctatttgattttttttcttttattcctcatgatttaggagttttttcatcataaatgtttagtaaaaagcttccaaaaagttaaaataatgttctgttgaatttttcttcttttaaagcattatctaaaaatgaagtgttatatgacggagaaaaccatgattgtgaggaaaagccacaagacattgtacagaacattgtagaagaaatggtgaacattgttgttggaggtagtatacttcattcaaaattattttactctgtctatgggatttcatctgactgtggagactttgtaatgtctggaatagaaagggcaaaattaaaacgtttggagccaaccaatggaaagttacaaattccacatttaggattttggccttgattctagaacaaatgggttaatatggaagattttagcactgagaaatgaaatgaccagaactatgctttaagaagctaagtctggaaataagaattcccagtaggataccagcacagtattcaaagcctggataggacagaaaccgtctaaatggagacaaaaatatggataagtgatataatgtatattgaatcaagaagactttgtaactgattaagtaggtaaggaaaagagaataaagtgtgtcggaggccttcaagattaccccaaggtttggtgatttcactggaagccgtcacaggacccagcatatagttgtactcactgcatga

SEQ ID NO: 130112 - DNA, 1028 bp, Homo sapiens
gagaaaataaggggaaatgggatacagacgacttaacttccacatttgctaaaatcttctaagccagatgttgaattctttgatattagctactggtaaccttaattttccccttcccccacaaaataaaactccttacaaagcaaatcttgtcagactttattattaaaatcctttaattcaagcttattttataaattcgtgtaattctggcatttccacctaacctggaatattactggagaatatgaaatgttcatatttactactgtataagatttatcttggtggaaattaattctgtgagactcattcttatcaggtcttgaggaccaaaagagatgtgtgaaagcaataaagtgctaaaaaatgaaatcttgtgatcccagttaatgtttctaacattttgtgagccagttttacagatagtattatatacataataatgacagtttttctaaaataaaattcagacatttgtagatatagtttttttcataattattagatggctaggcagagtgatttaagccttcattgtaattctattaaatgtaattttaatttttttattaaaagatatttgacaaggtgacataagaacatgctccagaaggataaacactgaaaagttgcctcccactcttgttttccattttatttcctaatctctaccctctataggtaattgttagtactagcttcttatgtatttttatagactttctgtatgtataagcaaaagtgaatgtgtgtgcgtgtgtttcatccacacaaacaccaaatacagtgaaaatgctatatagtgaaagtctttcatctctgttcttatgtgccaatttccagccacctaagaagtaaacattgttcattgtttttagtatagtttatgttctccatttctgataaactttaatttccaagcgtagagagaatggcaccttatagaaaggattgttggaggtaacattatccttccaaattttaaacaacttattttactaatattggaaattttatttatttcc

SEQ ID NO: 130113 - DNA, 1036 bp, Homo sapiens
gatgatttaggtcagtcaacacagcatttcctccttatccatacatttattttattttatttatttttgacacagagtctcattctgtcacccaggctggagcgcagtggcgcaatctcagctcactgcagcttccgcttcctgggttcaagcgattcctgtgcctcagcctcccaagtagctgggactacaggcatgcaccgccatgcccggctaatatttgtatttcatggggtttcaccatgttggccaggctggtctcaaattcctgacctcaagtgatcgatgtgcctcggcttcccaaggtgctgggattataggtgtgagccactgcgcccagcccacacatatattttcaagtgataaagattatttttgattgtatctgttggtgagccgtgcaattttagtaactgatatacagatcttaaatatcattgtgaacctttattaaagtggtattttaaatagctgcagataatatttttatactatctgccttctagttctaccagtaataaaatggaaaggggtttggttcacagaaaactaaactgaaatactgaacatcagatgcctggcacacagtaggcaatgagtaaatttgtatgtattgtatgaataagttgtatggattgtgcgaatgaattgtagaaattgtatagcaaggtgatttgtcaaagtcgctttttaaagggtttaatacagtatctggtacgtgaaagatgctcagttagtgatagtgttaaaaatgtataggccagtagttgtttatcataccccaatttagcacagtttgttcagtttctcagatacacctatatggtagaacggttaataaaccagaatctgtagttagattacctaatattgaaacctgattagccatacgtccaagccatgcagcctttggacaagttgttcaacctctcttcctcaattttccagtctttaaaatgaagatataatagtacacacctcataggattgttgtcaaacataaatacattagttgcatgtaaagtgtaatagtcta

SEQ ID NO: 130114 - DNA, 1038 bp, Homo sapiens
ctgatgctaatgagcaaaaagtatttttttctccaaatcacctgggcttcatagtttgtttcttctaaccagttaaattgtttaaaaacttatgaatctaagtagaggttacactttgtataaactcaaaacagatggctttaggaacagtgtcactttctgcccctgatgttatatgtaataatcataagtagggaaggtatgcgaaggaaaaggaaagaaaatagcaaagaagaacaagatggtattttttctttctcttttagttctccagaatatggtagcatttattaaatgtctgcatactatgtaactcacactgtgctggatgctaggaatgcaaagaagaatgaaaaatgtccctgttctatgtaacagatcactaaagcttattcttctggtctagctgaaattttgtatcctttgatcgctatctctcttttccccatttatgtacctcctctaacttctggtaaccctcattctactctacttctatgagtttgacttttttagattccacatacaagtaaaatcatgtgtctttctgtgcctgacttttttcacttagcgtagtatcttccattttttcacttagtgtaatatcttgcctatgttgtcgcaaatgacaggatttccttctttttaaggcagaatggtattccattgtgtatattttattagattgtctttatccattcatctgatgatggacacctaggttgcctccatatcttcgctactgtgactgtaataaataataatgcattatatatttcagaattactaaaggtagattttaaatatttttacaattaaaaaagtatgtgagttggatttgttaattagcttggtcattccatatagtaaaaacataccaaaacacctcattgtaccccataaatatataatatatacaattaatatgtgtccattaaaataataaaattaaaaaataaaaaaatttccttgcattcaagtagctcagaatcaaaggtaagcaaataatctcagtgctttataaataagtgccttata

SEQ ID NO: 130115 - DNA, 1019 bp, Homo sapiens
ttctttgatatctaaagtaaaaggtgttttcagtaagccaggctacctgaatttttgagatgggtagaagaaaagagtataattaatgacataaccgaaagattgatcctatttgtatttgttcttttctttcacatttcagatttgtttttaggacacttgctctagaatagtgttgactgaaataaatgttgcagagtacaagttcttagagaagctctttgaagaaaataagtttgggttgaaaaaataagtttggattatagtgtgtaatctgtttccatttgggaaatttataatgcacatgaacatagttaagattctgaaaagtcctccaagaaagacacctgctcaattttgtttaatgaagttcttcctgaatttatgtgatcctttttcattgtttgctaactcagttaactcccctaggatatgttgttccttggaacttactttgggacactggggaaagaaagacaagtacaataaccctaactactggtgagaccatcttctagaagaggtttggggaaatcagtgcacaaacctgtgtttctctaaacacaggtttggggaaagtagtagatgtgttaatagtgtgggaaggagaagaaagtccgaaataaggagcagtagaaatatcgagatcagaggactgtttgctgactagctttctttcccaccccatctaggggcaggtaactcatttgtgtctcttggtaaggtttaacttagagagaaaattgtgaatgggaaataatttggggaaatatttgtcataatattcctcacataatggaggaaggaagatatttgaaaaggaaaaatacatgagtaagttattgttgccattccgaactaggtatatatttcaatcagatatttgttgaactcctcatatgttccagatactacttcattgctgggtatacagcagtgaaccaaacatgctttcatagaacacacattctagtggggtgagggtgatagtaacaaccttatatcatcagaagaaagag

SEQ ID NO: 130116 - DNA, 1053 bp, Homo sapiens
tggccgacaaggaagtgaagaaggcgcatcactcccagctgcgcaaagcttgcgaggtggcgttaggtgagcggggaggaggcccgggggatggggtgcttgttgtggggcggggaggggggcgcctgtgggggggtggggtcgcccggggcttgcccgaggcccgcgcctctgacctcgggaagccctcgcggagccctctgttccctgtctggagttgacaggaactcggctggatgtggggcagaggcggggtagaggaggaagggcagtgagctgggctcgggaaacgcggcagggcttaggatcgcggggcacctgggttcgagggatcgacttgagagtgagaggattttgttggtggtccgtgaggtgcggactggataccaccctttgtgatgaagcagaagatgagctgttgtttattagcttggaaattgaggtggggctggtatgtcaagattgggtgtgggaaaggttccgtatcataattaacaataactttttcgtttggcgaggtactttggggagataggctgctgaagttgtttccttgttgacagtcttgagaaggggtttgcaagaggtgcagcccgttctgacatctctccgcctccgccacaggaaaaacatagagtaatattgtatctgactgggctgacctggaagaacaagaccggtggttaaggggtgagggtgggggtggcggcatgaaagcagggaagcaaagaacctttagataaaatggctttaggtgacaagggaagggagggtttgaaatgaggaaaatgaaaaagacaatgacacccaccagccacatgtctggacagtggcagctgctctcaagcttgaattgtgatttatagttcagatggaagagatctagtgtaatgaagcccgcagcagggaaaatccaaacaatacctcctacctatgaggttaggcagatgaggagttgttaaagggggaacattgttagatctattgcatccatcaaagttgaaatcgtttgagagaccagaacatttaacacaaagatacattcctaatgtt

SEQ ID NO: 130117 - DNA, 1001 bp, Homo sapiens
tttctacatgaaacaggatctaataacccttcaggggtttcatcagaccctgacaaaataactttccaccccactacacaaccaaagatgttttaggtttaatttttctcctgctccttctaataactctagtactatttttgcttgacctcctgaacaacccagataactacactttagccaaccccctcaacaccccaccccacattaaaccagactggtactttttgtttgcttatgcaatcttacgatccttccctaataaactaggagacatactggcccttatgttctccattctcattctggcagttattcctgtacttcacatgtccaaacaacaaagcataatattttgaccattgagtaaagtcctattctgaatcttagtggctgacctatttacactcacatgagttgggggacagccagtccaatacccttttatcaccatcgaacagacagcatctcttgtgtatttctctatcatccttacccttatgccactctctggcctaattgaaaataaactgcttaaatgaagatgctcttgtagtataattcaatactctggtcttgtaaaccagaaatggaggatccttccccaggacaactcagggaaaaaatatcctgcttcaccgttaacacccaaagctgaaattctaattaaacaattccctgaattctttctcagcatatactttgactaccatgtcagtattaatcaactagcactattgtaatagtgcctttatgtactttgtacattacggctagtccccatgaatgagtaatatatagtatataaatgcttaacagtacatagtacattcatgtttaacaatacattaaaaatccagtccacatgcatataagcatgtactaataatcccttaatcaactgtcgcacatccactgtcattaaccgtacattaccccacatggatattgaccagtactgtaaatcttacattacttaatattacttaatattacatagt

SEQ ID NO: 130118 - DNA, 1049 bp, Homo sapiens
tacaggcacaagccaccatgcccagctaagttttgtatttttagtaaagaaggggtttcaccatattgaccatgttggtctcgaactcctgacctcaagtgatccacctgccttggcctcccaaagtgctgggattacaggcatgagccaccgtgcccgaccagtatttctattttaacaaatctaagactgactctacatatcacagatctaattgtttatcatatgtatttgaaaatactggggagaacaattgatagattataaataaaacacaacattgtttctggaatagcaaaatctctcggggttacctaatttctttcaggaacataagagcccttatgaatcaggagaccacttggacaaggttggtcaagaaaaatgatatatattcaacgttgactttcacaggacataggatattgcttagcataatttattatttaataacttgtacaaataagatctatatcacacaaccataagtgaattcagtttcaggtcaggaatataagaaacatgagccataaaagttaattctcctaccagtaatatttagcctctttttcatcatcaaatccttgaataatgttctctacaggagatccatgaagtgggaaggtggcatcaatggatattaagagagtagttatttgagggtgttgtaatcaggattccaggtaactttaataaaacagtagaaggttcagaaacacagaaaataaggttctctcaaggacagatgcaaagtgatgcttgcaaacatttagactacaagcctcacagaagggaagaatcaaaggacgttgtgcaatgtgagtctaggatgaacagataccatagagtgacacatgtacaagctggcatacccattgggatgggaggactctgggctttcagagcttcttcaaatggtctttgtatggcagactataagtaactcaacaaaattctgtcttctcctccacatgggtgctgtatttcacaaccttccctacaattagttaagtgtggccatacaactgatcatgaccagtggaactgag

SEQ ID NO: 130119 - DNA, 1065 bp, Homo sapiens
tgggcatctggacaacggacgctcgccagcagtctcctgagctatctggccttcagtctcaaactgaaagttacatcattggcttctctggttctgaggccttggaacttggactgagcaatactgagggctttcctggttttccaacttgcaggaagactatcatgggacttcttagcctccataatcatgtgagccaattcccctaatgaatctcctctcatctatctatatctatgtatatctgtctgtctatccatctatctatctatctatctatctatctatctatctatctatctatctatctgtctatctatctatctatccatccatctatctatctatcctattggtctgcctctctggagaacccttactaatacaccatgtaatgctttttgctacagaaaaagagtcatgaaatccaaagttatatttcatttatgtatttattgttttatttattttagaatgaagcaaacctttacttttacacactttgacaaataagttttcattaaacagtctttccagtggagaatagagaacatgaaatttagcctccagacatcagcagtggctctgctcagggcctaggatcccccttacccaagcagtgaggtggaagggtgtacttcccttccattattagcttatcccgcaacttcttgatggctctcacaagtcccattgttttctgctgaagcatgcactctatgaaatcatcagattctgtcttgcactctttctcttcccagatactacctattccatgttcacattctatcaatttttttcccaaaaacgtggcactgagcaggaatcttgcagggttttggattttcacccatggatctatgttaaggcctggccttttttgcacatcaaagaaagggatggtgttccaccgcagtgcccttaattcttctctggttgccacttcaggatgactccaaagttacattttagaatcttctgtttctttgtttaaaaaaaatgagtattttatactttagtttttttccccagaaattccaaacttttaacatagtaaacctttat

SEQ ID NO: 130120 - DNA, 1072 bp, Homo sapiens
tcagtgactgcaacaaattaacataccactttcttgcaacaactctattcactcttcagtttatttaaatgccattagttttagactgaagttgatctgtggaaaatatatgtgtataataccaattcaaaaaaatatataaattgttttgtttgttaaatgtattggaaatatttaaggcttagtttccaagtgagaaaaggcaataaactttaactttaaaatcaagaatgttctgtgtgtctatcttcaaaaatctaagattatttccgttatctatctagctttctatcttctgatgagcattcaacaacagctttatcttttcaattagtgacaccgtcttaaatcacagcagctcttagaaacaaaactggcacaaataccctcgcctctcaatggatttacatactatcttgatgttgaaaaaagttgtagacatggaaaacagcacagtacaagggtgatgcttattttatctggggtttattgcatgggcagaggctgtcattttcccatagtgtcttcatttattatgctaattgactttccaagctcagactggagggtgtctgccctgtgaactattctcagttggagggttttaaaagcaaacctgttttgtgcctgaatgaaacaaaaaatcaatgtgtttcttttcaaagagggagggtcaataccgtggttgtttttgttcccatccagttatgtaaccgtggggacttgtttctttgctttcaggatttgtacgaaacacattaaagttaaacaatagcggaggcttaggagtaaccctcgagctgcgccttggagtgtgtgtccctgggattgggaacctcctgtgagttccatatcaagtgctgctgtgtgtgtgtgtgtgtgtgtgtgtgcgtgtgtgtgtgtgtgtgcgcgcgcgcgcgtgtgtgtgattagccagtacgcagtacttccccagggttgtgtttcctttttcctgagatttggcgaagggtaaagggtcggagtcacatggatacaaagcttttgattaatgtccaagtcactgctgtggctgccgaagccgcttcccctc

SEQ ID NO: 130121 - DNA, 1102 bp, Homo sapiens
tgagataacactcaaaagttgaatttttcctattcattgctgaaaagacaaagaatttgagccttggcttctttccacccagattcctgggagagcatcattcaaagaaccaggagctttagtttttgtgatctcatccaaatccttctccttccaacaaccaattccatgcccccttggtctgaaggaaaatatttcaggtgccaaacttcctgcttagtgttctgaaatctgtcaactttctgcttataatcatgacagataaaattcacttcttggctgtggcaagaaggaaagaaaaatgtctcaagtgatgtaaaatgtacaggctgcgttatggttgacttctcaaaatcaatatacttgacttccaggggccacattctctgcaaatatacaggtatttgagaatatcctggtaactggtggtttatagaattattatatacttccttgtaacaaagattgtcaaaaaagtatgtttttaagatttgatttttaatagctttaaatttggctttcatgaaacttttttggtaacaaagttctttgtcttttgaagaatctgagtcatttcttacataattactctttctgaagatctgtgaacaaagtactgtgcagaatgctaatttgcagagacagttaatctaattatattaaaaaccaatttgttgatctttatttaaaatatcagtttttcttctaatcttaaacctgatcattacaacagaaaacttactgttagtatatagagttaggtaagaaagtgtggaaagtataaaataaattttccccttttataaggagaacatcatttcatgatttctttttatctctttcagaatttatgggctcttccacttttcattttctttgtgcatcatttgtgcctgtttatgtttatatgcacaaatgcactaattagtctgaatgccatcctaaataaaagtttactctggcttacaaagcctaagatctatttataatagattattagattttctttttagggtgttatttatagcaacatttactccccatggagttttcttggttacctgaagttgatgtagtcactctggttttgatattagactat

SEQ ID NO: 130122 - DNA, 4046 bp, Homo sapiens
gcatcttcccccactgccatccccaagacagcccatgagcattgcctttcttctctaagctaaggtatgggtctatctgcatcttctctgtagttgcccccaggcacacaccgctgtttgaacaaagctctgtgtcttcagctggctactctttccatggtgggctgtgcttcctcaggcctctgcctttgttcttcctggggccttccttttgtacctggtggattcctactgggctttcaaggctcagttagccccttcttcccaggtgctccttgctttgtatccactctaccctgcatttccttcttccatagtacccaaagtagttgatgtgtgcatttgtttactttggtcctcattctgttagacctccttgaggacagggacataccaccttgtgtgcctgtgctttccataattgtgtgcagtgcttgtgacattgtaggtcctcaataaatgcttgctgagtgcatgcatgaatcaatgagttgacccatcttctatcctcccactccatttttaaggatagtgcctcaatcatcctgaacattttgatttcctgttttcttccatttggtcaaaatagatagtagaattttcagttttgctcaggcacatatgaatttatgcagtcaaaaatttcaaattaaacatgtggtacctgcctttaaaacagaaacatgatttaaatcaggtattgaggtattaaagactttgcatgcactattgtttcatatattttaaatttttgtttgagatcatggataggttacactatctagattaattatttttaggtcacagataaaatggtagagagtgacataatttgcttgaatttatgttcttgttttgcttgggaaatgaaattttgtgctttattaaaatattttcaaacatttcttctaaataaatgattacatgaacctgacatccagtatttaacatccaaagtctggacaatagtaagttacaacctgtttcctgtttgcaaacctgtgacagagcctgccgagatgacagactcatgtgagtggacagagaaaaggaagacccagggctggcttcatggatgcacatcctgtgcagtggcccagggttctgagctgagaaggatgcccagcttgttttaatgctctgctattgccatcttgaaattcttgccaattttatctttgaccttgtgttttgcaaatgaagtctgatgggacggtggacatgagcagagcagatacatgaaagaaaaaagctttatatttcagtacctttaatagcattcccccacagccccctgctttttgaacaagaaacctcacatttttattttgcactgggcctggaaaattgtgtaggccatttaactgtgggtcagtggcaatgaggcaggatgaccatataatttactgtctaaactgggacacttctgagggtgaaagggagtgctattaataatgacactgggaaacagatggaaactgggattgttcctggcaaaccagaatgcatggctagtccacattgtgggcatattaaaacaatgacttcaagctatgtgtcttgtcataaaccaaatattttcaagtttgttgcctgtccaggctttgatcttggataccttggtatttgagtcccatctctaatttgctttgtgattttaaacacattcctaacttttcatgcccctttttcttcattcgtagaagggagaacaatagcatttctcaggggtattgtaaggatgatgagatatatgcattgggcttggcccatctggctcataagagggtcctataagtagttactgttattttgctgatgctacagttgttataaagagccatgcctatgatcatcattagatagaatttttgtttctgttatattccttttctaccctttctgtatgtccccacttctcttcgtttcctccttctttgttttccttttgttagtgtagtcttcttaatgatattcttataaatgctcattagttgattttaagacagtgagaaaactttatattccaggtaacaaccacagttagtatggcgccttggagtttaaacaattgcatcctcactctattattcagcttaatatatgcatgtctcttagctctttcaaattgtgctccctggagctccagaggcccttgcaagggctgctggagagctagattttatggcttcaggattgtcaccctggcttctctgtgcatggctcaacctttctcagatttgagctttcgtaaaagcagttagaaaaaacatttgtctacatggcaaattcccagagaaaagggggtttgcatttacttcctatgtatgcttttcttggcctaaacacagggctttgtaaatagcaggtgctcaagaaaacagacaaacaggcaaacaaagcaaaagcaaacaaagcagaatttgaatgcatctgaaatcaaactctttaagtcatgacctgactcttccaggcaaagatgattgattcagcacattatgcttaaggtttatgttatggactgaattgtttccctcctcaggagtcatatgttgaagtcctaatccccaatacttaagaataggactgtatttgtagatagggcctttaaataggtgatagagttaaaatgaggtcatagggtagaccttaattcagtttgactaaagtccttcaaagaagaggagatttggacacacagagagatactgtggtgtacagaggaaaggccttgggaggacatggggaaaaggcagccctctgcaagctaaggagggaagcttcaggagaaaccaaacctactgacaccttgatcttagatttctaagctttcagagttgtgagaaaatcaatttctgcttaagccatcaatctgtggtattttattatggcagcctgtgcagacaaacgcagcttatattaggtgctgggtcatcacaatactctatgggagctgcgacactagagccataagcaaagtcacgtggaggcagtagagattctttcagttggggagtcaaggaaagttttggaaagaggtgatgatagagctggctcctaaaggaggaggaggaatgtgctatactgggagaattatccatccccaaagtgctgcatgtgttatgtgacctcagcgtggcagatcctcacatttaggggtctgaaacagtcttgtaattataccctattataataccaattactttaatataaaaatagtagctattgcgattagatttgtttcttagcaagagaattctgttgacaaggttgaggaacaaagattgaagtctagttacccattaagagtctgtcattgcattagtccaggtaagaaatgtggaaagtctgatctggggtagaagcattggaaaatataaaagaacagtaacagcagaaaacccaaaccaaaccacaaacaaatcaaacgcccaactatgagggcttttttgggtagaagctttaatattttgtatactctcagaagtggaggtttaagtagaatggagaacataggatggggctaagtctctagttttgaagactagatgggtagtgtcattgactgagaattggaatgcaggggacagaacagcactaggaggaaaaggaaaatgaatttgcttttggacatgttgagctgagccacaaatactactatgatttttgaagataagaatgtggaacttgagaaataatttgggccaaaagtgagagatctaaaaattaactaatcatgtattttgaaaccatcaattgagtgagatggcataaggagagcaattagaggaagaaaatacacaaacaaaaggtaggatgttggagagtcaatgtttaaaggatagaggaagagtagagtgtgcaggtgactttgagctatcaaaggctgaaacaaagaactaggagaagttgatactttgaaagccaaggaaggatctagttttcaaagaaaggtctctttaaagtggcaggacttgagggaagtggggtgtgtgaagactgaagaggtcgctggatctggcagttagaatgtcattggggtttta

SEQ ID NO: 130123 - DNA, 1053 bp, Homo sapiens
tcgaactcctgacctcaggtgatccacctgtctcggcctcccaaagtgctgggattacaggtgtgaactaccatgcctggccaattttatatattttatatatttacaaaatgtattttgaatattctagacacaactttatctcaagttttcttgtaccacttcataatgaaacctctggcagagacttctaagtgtccccagtacccaatgttcttttcttctatagtgataaaagttttaggtccagcttaagactacatttctcagcctcccatgcagataagtgtgggcctatgtaaaggttctgggtagtggggtgtgagcagaagtggcctgggtaacttctgcagtgtgcccttattgtgaagagtgtgcattctcttttctcctttccctcttctccctggctggtatgaggatgtgatggcaggtgatggggcagcaattttagaacatgaaatggaaggtacatgttcagggtgacagagcaacaaaatagaaggagactatatctttattatttcttattaagaccatgtcttaaagcaggctaacctatgtcctgtcaaaaatgggcctataagagaaatcaatatttatttaactctgtcctaaaatcatcacattttgataccaaggcctcattgacttatgcaaatcattaatgaattggccaactttagtatcttttttctgtctttgtctaatatttttagtttattttttgttttttctttaataaatctctagttcagccataatttccccagattacgctaaaactgcacttttttgttttcaataattatactttagtttttcctttagaaaaagaatagtattttttttttacctgtacttaacatattctttttttcctgaaggccagaattttgtgtttattcgtaaggatatttgttcagctgccttaactgagaccaaataacaatagtttgaacaatgcagaaggattgtttgtggctaggaaagccatatgtaatcaacatggccttttttgcattctctcttagaactctggttatttaattt

SEQ ID NO: 130124 - DNA, 1055 bp, Homo sapiens
agcattgaacaagtggggcaggggtgggaattggagatcttgaatgtgcagcaggctctaaaagccattttatgaccattgccttagataatcccagacgtgagttaaaagctaaggtatgaggtgctttcatacatttttcttatttaaggcctttccctgaaaggggatgggaaggatcaagagtaccttgcattctgagcaaactgttgcaaggacagaaaaccaaacaccacatgttctcactcataggtgggaattgaacaatgagaacacttggacacagggtggggaacatcacacacctgagcctgtcgtggggttgggggagggatagcattaggagatatacctaatgtaaatgacgagttaatggatgcagcacaccaacacggcacaggtatgcatatgtaacaaacctgcatgttgtgcacatgtaccctagaacttaaagtataaaaaaaaaaaaaagagtaccttgcaaaccctccccggctttcttcctgtggtattgtctctctgattgccctatagaaatgactcccttgaggcttgtggacagctggaagaggcccctatgtggcctgtaaagtgctattggaagcatctgccagcgactggggaggggaaaggtcacttgaggactgtggaaaatattccctttctccttagcatcctggaacgtcggctcttgactaaattgttaatagaatctgggagctcggattctggtgctgacatttttttcagggttagttctagaaatgatatttcttaagcagccttttgcggagcttcattctttggttcactgaattcgcagcacaaagaaaaggaaatagctttattaccatcatcattaccaacttcagaataggaatgggtgaataattatattgggcttttaaaaagtataaccaaagggaaggaatttagctgtctgtatttttttgataaggttatgtgctttcttcttcctgtttctctttaaggagacctttctgtggctcatacatcataaaagttaaaaggaagtgcaaacacaattaccacag

SEQ ID NO: 130125 - DNA, 1540 bp, Homo sapiens
gctacagactcatgttttcttgatcaagaggtaatcctctttcaacttcagagtaagaaatatgaaataaatcaggagaaaatcattttcctcttctgtgattgtgaaacaactgattatcatacaggagcctattccaagtgcatgtcaggaggcttgagggtcaggacagagactggggatgcagggctcacttcatccacctgctaacatagcagcagaaaggtgctatgtgcagctgttttgcaattattattcttatatttatttacccaatgcaaacagattccctttcatctgtcgttctagtaacaaagagtaaatgcctgaggcttttggctagattttacttttcacaggaactgttgaaaaggttgtcccatttcatggtgttgcttttgtggaacagtgattaaagtggtcccattgaagagtaggtgcaggggtgtagagtggtatagggggtgataaaggtagcttggggccagatggtgaataacagtagaggtagtttaggactaattagtagacagtgtgggagctaggggagatttttgagcaaggaagtcaaaacaatgggccttggttcagaaagcgtcgtctgggaggccggcttctagccagagtgcaggaatggctctgttgggcacaggtgagacctgagagagatcaattcattaagctcaacaaaagtcagaaagactaaatcggtgaggaatattgctgatgcttggacctcggtccagaccagcttaattagaatctcagggtgcggggagagagggtggaagtcaagaattgctatttttaaaaagctccccaggtgattctaatgtgggagtagggttcagaaatacaaggaaatgaatacatgacattaatatatatattaatcaaggattgagatacatgctttccaaactgcccctaaaaaataggtaatatcataatagaatgaatgatgagaagagatgcactgacaaaatccacttataaaactaagaagtaactcaacatcgaagaggaaactaaaaagaaatgaaattagctaggaggctgcatttattggagatatagttatccattaatactttgcaatagtaatgagaaatactgttagtggaaaagatatagttaaagttttgatttaacttaggtagaaagcagtcaacaaatcattttccatgtgtctgagcaaggcaataagacaacagtgattagtgggaagtactcctgacgtgggaaaggaagtatgctactttgggaaataaggatgttgtagaaattaatattttaaagtctttggagaattcccatggaggactgatgtattttccaaagttctttgttgtgatgagatatggagaattattttctaagtgccaatttgtgaacataagcatatgcatgccaagggagatttgaagtgcaagaaactgatttctgtaaagccacttgtttgatgtgatgtccttaatggttttgttttgttttcatattttcccttatgtctaaagatataattaaagttcactgccgt

SEQ ID NO: 130126 - DNA, 1550 bp, Homo sapiens
cagacttcatgaaatttttgctccagaattgagtgtttagttttcttcatttattgaccactctttgattctccattagctattgttattattgagtgcttccttagtagtgattagggttgtgagctcttcgtgagctctgggtccacatggctgggatcaaagctgtgtgatcctagaagttcttaatctctgtctccttccattttcacatctgtaagatggggatgatattggtcccagcatcatagggttgctgtgaagattgaggtgatacctgtaaagagtgtaggacagtgcctggcacatagtagtgcacatcaatctaatgccgtgcttggtactgctctgggaatttgtattctcatgcctctgatcctgctattctccctatgttgagtgttccccgcatttcctccccaacttgaatttctgtccattctttagaatcgttctaaggtgtcagcttcttagtaaagcttttccacatcaccctttccaccttcagaaagaactgatcactccatcttctcttctacttctgaaccttgaaaataaatatttgtgcagcacactttcatgcaagtattcatatacacatccgtgtcccctactggatcatgaactcattaagaacgaagagtatgatttattcaacattgatttcttagaagctagctcagtgcctggcacatagtattcaataaataattgttgaactgtgctttttgaattgaacaggaaagcactttatcacttaatgttttaggcatgaaatccagagtatgttatcgcagtgtcatggtgatgtgcatacatacatgcatgtgtatgtatgtgtctgtggtttgattagtacatgcctgattaaggaaaataattactgtgagttgttcatttatttaactacttctggtagtttataagaaaggaatttcttcaacttcctaggtagaaatgcaagccaggacttgtggcaattcagtgccaaagatctgttactgttagcctggaagactgcaggtctgccggttccagctgtgctttaataaacaggagctcaaacacttcatgatgggaagtacagctgaggactctcgaatgcacaagctgatcatgctgaatgcttttctgggtcatgttcatttcataaaaacagccaattcccagccttcccagaagaggaaatgctgaaggtcctagctgcgatgtggggtgaggaggaaaccaggacggagagggagagggggcctcaccacctcccctttccttggcaaggaagccagcccaggcacccagcccagtcgcacgggtccctgttaggactttgggctgtgcttaagtacacaagttttttttttttttcttgccttttgtagcgactacgttgttccagtgaccagagcaacatgacatagaagcagagaaaacataccaagttcttgccagttgctaggcagagaaaaacgcttttggatgtttgaagtatgcttcctatgttgatttcctaaccatgacttgttttgaaagccaaacacaatagcatcgtg

SEQ ID NO: 130127 - DNA, 3551 bp, Homo sapiens
ccctttaattctattatcagaccatgtggtttctagcagggaacacagatctaattgaagctttaaggaaactttatgaataggaagccacacatagttgtagaaagatctcaggccagctgtcacttgggagatggaagttcaaggttaatttcacttgactggcaaaagcgttttgagagaaaagttggttttcgtaatctttcttttggttggagacaggaaaaatgggggaaaaattaatatgcctttctactatctcttttgggataaccaggttatattgatgaaaatgattttatgtacaaggcacagtgtgtgtatataaattcttttaatctccaccgtaatcccagagagtaggcactcttatagatggggaactcaggtacagagaaattagagaaattcccagaatcacccagctcggaagtagcagagcttggatttgaactgaagaagtcttgtgatggagttcctgctcttggccagtacactacattgcctgggcatgccgggagcgtagggctgctccatccatgcaggcatcctgtctacaggcatcctgtctgcaggtggcttgactacaggtggcttgtctacgtgcaaatgacgtgcttgcttgctacatgtagacatcttagctggattggcctctgagtcctctgtaatactttcatggagatttatctcattgggtttaagtcatagatttacatgtgtatcacttctatcatatagtgaacttctaatggcaggggcttgattatgagttgctggcacccagcatggtgcctttctttcgagaaccttatggagttgaagaacacagtgccaacaacctggggcagagagtaacagtaaggccaagagcttcaagtgatctctaggactctttttggctcttgtcagtactaatagagataatgtcttgtgttgcaatttggaattcacgaaaaccaaacttaaagatgttttaaaaaagaacatcactggccagggatggtggctcacagctgtaatcctagcacttcgggagactgaggtgggtggatcatgaggtcaagagatggagaccatggtgaaaccctgtctgtactaaaaatacaaaaaattagccgggcacggtgtcaggtgcctgtagtcccagctacttgggaagctgaggcaggagaatggtgtgaacctgggaggcggagcttgcagtgagcagagatcacgccactgcactccagcctgggcgacagagtgagacttcatctcaaaaaaaaaaaaaaaaaaaaaaaaaagaacaccactaactaatttctgatgtatttctttgctcctttttcaagtcattgttttcatttttttggagctatataaggccagtcaactcttttttaaagttaagctagcaaggtatttggctatcaacgctaaataaatcaattcagaaccactattagcaccataaagcttaattctttttctttgtactgtctggtcacctttagaataattcttattcctcttcaatcggctggatttctgcacaggtccaggggttgtctttctgtggggagattgatgtgcactggggcaaaatttcagttaccaagtgtgtccagcatgaagttgcagctggcattgaaaggcatccaccattcctctccaggtacatttcagattcatctcctaccttgttcccccatgtccccatcacgtgcgctggactgatcatctgtcctcacacagatctggtagcttctgcctctggatctggcctcaagtggttccctttgctagaagcgccttttcccctgcaacctcgcctgcctgctgaagccgttctcggtctgtaatgctcacactccatcttctctaagcatctgtctaggataccctccagttccatttaatatcttccttctctgtgctctgtaaattcccatttctagactttcacttgctaagacaagccccacatcaggtatttgtggatgtgtctgtcttcctcaggaattgtggcagccagggagtgtgtgtgtgtgtgtgtgtgtgtgaacacacatgcaatacacgcagtgtctttgcagtccccataggtagaagagcaggtatgcaaagatagtttttcagtgtgaataacccgtttcatttttgttccctcgcaaaatgaatgcctcatccttgtaccatagaaaatatctgaacacctctaccttctagtcatagacttttggattgcctctcttcctattcttttagtttttaaaatatgccagagcccacagttaccttactatctgcctctcctaaattctggtcagcctcttccctcactctggcatggaaccaggcttagaacagtagaattgatagtggtaagaagttgagtgtgactgcacaccacggctgaagctctgctgaaacctttatgaactggactttgaaaccaatttctctaaccaaagtccctattgctccctgagtcaggtgagctctgccatgtgcctggcacaatgcatccatcactttacttagtcctcctcacagtcctcaccagagatgaatgaaagtgccattgttcacagggaagccaggcatccaccgaggtcctacaactgagagtcccatggctgagcccctgatggaagctcaggtctacctgactcttctctttcataatagaacactggctcctgaatgcctgaaatggacacaggagacttttcccatcttctctgtttcccaaggctggtgcccactgctcactttcaccttgcaggcccccaccctacctgtggagtcttgggcgtaagttaggggccttctccttgaccagctcagccttttgtgagaaagttgggaagctcccagaagcttgacaggtcacgcgtacatgacaagaaggtggtggggaaggtgacaaggtggagagagcctgtgccccaccccatggactgtgagactcagctccagccaactatcgccaagaggcagcatggccgtagtgatcctagaacacctgattttccagagtaagttggaattctatattttcatcagagttttctaaatgtttttaaaagcaaaccaagcacgtgtattggccagattcacaggccactgttttgtgacctctgcctggggacatgagtacctgctgtcactttgctcattgtgtctgtctgctctggagccatctgagtatgtgacccccagtttaggagaaggagagaaaaattaatgaggaatggatgtgaaaaaaaagataggaaaagaaagctaatatttaatagaaaaaagtgatgctaaaataagtagaaaaagttccaaatttatatttaaatacaaaagacattataatttagtgactagaaagaataatagatttccttataatagttttttcgaattaaatagttctttttttctacctaaattttgcttaagaatggttttaaatgtatttttaaaacttctaaatcttaactattctaagaatttaaaattttcagatctggttaaatgaaatattaggttactaaataataataccattt

SEQ ID NO: 130128 - DNA, 1017 bp, Homo sapiens
cggggtgccagcatccccaagtggttgggtgagagggtgttgtatagaaacaaccactgtttaacactgaattgaaagtcaaagtgaaataagtaaactcgattttcctgttaagactcatttatttctcaaagtctgctttttgttttagtctttgaaagaataaacataaagaattgttcatcagaagatgatctctggaccaactacatcagaatcgcatagaggtcctgctcaaaatgtagatttctgggtcctaaattaatctgctgagtcagacctctggggataggaatctgcatttggaagtaactctccaagtcttaaacacaagaaaaagtttgaaacccactagcataaaaaagctattttccactgcttgatttcaaatatatgtgtgtcaagatgaagattatctgattctgatgaaattttggacaagtgggaatgaatacagagataaaacaatgtgtagaatccttcatgtatttttgtgactaggctactaatgcttccttgattgatataagaaggattaaatatgacaacagagtctgaaaggacactatagatgctggttgttaaaggatgattttgaaattacctatttattcctagctttaggaaggaagatttaaacctctcataaaaaatgtcaaatcgttttcacgattttgcgttctcagcaaacatctaaaatctgccttcactgttgtataaaatgaggaccttgggaaaaagaaatgcttggtcagaaatgctaacaagttccagatttcctttcatatacaattaaacaaaaagttccatattgtcacggaggataagaagataaaaagtcagataaagacatggtttactttcttagtttgtatgttccattctaactcatattttgatgcattgttactacttcctcactttaatttatccatttcagaatgtgactgagttcagtttatgaagaaaaggtttataaatgtagaggtgaagtttaagctttgcttgcacgagagg

SEQ ID NO: 130129 - DNA, 1134 bp, Homo sapiens
tactttgtttatgacatagttttatagtttctcaaaaatattagaaaataggatttctaaattatttttgaaattatgacatacttaaagatttgttattctgttaaagaccctagaaaaatgaaattaacatataaagatgtgcttctgttagaacaaaagtcaaattattaaaaacataaaaatttatcctcccagtaagatatttgaccattcgaaaggaggaacctaacttaatttttaaaaacaaagtaagtttgaggaaaaattaaagtgactgcaaaaatgtgcatttgggttatacttactcattgattcaaacttttatttttgatcttagaggaatttgtgatgtcacttatggaagtggctctcatgatctttgcagttttcatttcctggtcagtctgaacctgctgtaccagaaagctgaagatcaaagggcgatttgtttttttgtgtataaacaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggtacattcactttgcttgacaatcgagcttaagatagttttatgttgcaggcctcgtgcagaattactggcgttggatggaaccataaatggtcattttctcagatattacttgaggactgtagtcaattctgaaaagtgctcactttcatcattattttaaagtatctttaaggtggtggttaattgagttaaccttgacccaataagtttgtgatggagccaatagatactatgtgggctataagctttaatattttagcatttatgcatcatgatgatcctgttcctctctcaactttggccataagtacatagcctgaatcctgggagagtgaagaagggaaggaaagttcagtaggtgtgctgtgatattactttcagactctaaattaggtgttcacttaacctctttgttttgatttcttcatttataaactgaaggaactggctatgatcttatttttaaggtttattcaagatgaaaatgttatggcttcctg

SEQ ID NO: 130130 - DNA, 1051 bp, Homo sapiens
ttaacctacacgagttcttataaataacaggtgacaacatttagctgaaaacatttagctgaaaacaggcagcttgattctaaagcttatattccttactacgtgctattatatccactcagatacaaatttggcaaattctttggattaagtttgttttcctgcttgtgttttaaaagtaagttgattatcgaaattaggtttttgtcagcatttatgtggtaactgccaccacagaaaatctatagtgtatgttttatttgttcatttttgaagttatgccttttattagtataatttattatatctcggtcatataagttatgcaacattcagaacattctacaagatagtctactgaaggtaattgtggagcactgattaatatgccttggaagagaagtttattagctgtttaatcagagtcactgattcatttcatagaacaggatcatgctctgtctgtgtgttggctgattgattatgttgtaatgataactgtagcctttggagctatactgaagtattttgaaaagggagtatcaataaacattacgttgtcattaattcagctttaagtccttgatacgcttgtttggaattgatctctcaaatatggaaaacactattacgataaaagataagagaaggaattattaatatatgaaggtgttgggataaatgagattcaagataagcattgtgttttagaaagtaaagagacacagaaagaaattggacatttctttactacctttttacatggaaaaatacagtgctacgggaccatttaaaaattacttcttgttggttttggaatctgtttgctgcttccatttgattgagtttgtgcctgacagtgtattgacttcaagtcatgtttcttgttatttcatggatgtgagtcttccagagcttagtgctgggacttgtttctttttgtcctctgtacgaggtgatttggcagatacaaattcatcttctaccttgagatagaattgatttatatatagtcatatagtctttgttatttgaggataagtggttctgg

SEQ ID NO: 130131 - DNA, 1005 bp, Homo sapiens
gaaagataaaataaataagacatcttgaatgtttgagaagaaaacaccttgcatgttattcttttattgctttagaaactttgacaatatttttgtgcatagagcatgtaagtgttaattagtttgtagtgtttagtttcatgtaatgtattaacactctgagctagaaatgtccattattgagcactgacagcatccaatatgaaagcattcttaaagtttttaaatgtttatgtttttcaatatacatatgtaaagcaaagagatgttgaacaattcagtggttttggaacttttgtgtattgaatgatagtgtggatataataatattgtgtattacattttgttcatttgcctttacccattaatttacagctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtgggtgtatgaattgggcgctgttacactttgtgaagactctaacttagcataggagcagataatgggaaaacatgagaaaatggaaaggtatatgatggtcacttgatttattaggttggtgcaaaagttattgcagttttgacattgaaagcaattacttctccaccaacctaatactatgtgacgtgagcctcatactaaaagacttatttgatacttacaaaattgttatgtaatacttatatagttagcaaaataattatgttatggctggtagtgtcttttaaataatttttttaaatagaaaatttgttcaattttctttgcattttattcttgctatttctaaagcagcattgccaaatttttctttaagtgacaagcttcaataacataatgcagtgttgtaaagcctccaattgttctcagtatacttaacagaacactaaaatttcttagacccaatatgttagcttc

SEQ ID NO: 130132 - DNA, 1365 bp, Homo sapiens
ggaggatcagggttgaaagagaagatgcaggctttgctgtggaccgtgtaggccagccagtggggagtggccagcaagcggttgagagtttggggtgaagctcaggatagaaataaggtgagaaacacatttggaatcatttcaagggagtactagactcctgggaacactgacaatgaacagacagacaaaaaccaagaaagcagtgttaatgggactcaggacaaaggtttaaagaatttctatggtaaattgtgggggaggagaaaaagccagggaattattaataaatatggatgtttggctatggtattttgatgttcatttcctttcttagatactgtgcaaacaaaccagatatttcccatcttttcttatcacactgggtgttgcctacgtgatggtaccaccatccacccagctaggaatcatctttaattcctttctctccctcatgccgtcaagccctgtgagctctaccaccaaattaagtccctaaacaatgaattctgtccctttcagcatccttaccttttttctagtcgccgtcatctcctcctttgcttccacttttgttctccactcctgtagtacactctccgggtcacagctaaagagaccttttaaaacggggatatgatcaaagcatccttctgtttataaccatctaattgcttacaatcaaacttaaagaaaagttcagacctattacatgccctaaacttcttaccatgacctacaacatccgatgagataaggcccctgacttcctctcagagcctgacacctcgcattgtacctaacttgttgcactgtggccaccctgaccatctgtctctttcttcaacgctccaagatgacttcctatttaggaccttagcttttgctcttctcattcaacagttatttattaatccctaatacatgccaggagcctttctaagtggtagagacagagctgtgaatgaaaagacaaaaatctttgtattcattactcatgtcttccatgaccctttgacttttagaagcccatcctgtcctgtgattccaatgtcctattttttttttttactttgaaatctttcttcatgtatttatcactctgaaattattatgttgttttacttgtgtctttgtttattacctctttatctccctatcccttccctggcctccaataaaaatataagcaccatccaaacaagagcctcacttgttattatatagcaaatgcctggcattcccatcccatacaggtgctcaataaatatttgctgaatgaatgaataattatattttgagtgaacagatgatacttataaattgtatatgattttgcgcttgtttcattagcatcattaaaac

SEQ ID NO: 130133 - DNA, 1035 bp, Homo sapiens
cgagaatcaaatcacaatgcactagtttgagtatctgctctttgaggggcactttttgctcagctttgtagcattgtgaagaaacagaaaacacaaaatcatatatttatataaatgtacacattgtgtatacctttatacatactatatactcatgtacatatataaatacatatattatgctagctgaatgttgcaaacgtcagtttatttctcaaatcgttatatggaaactgtaatatttttaaataaaatattatcatgaatcttgctgttaaaatactcaattggtattgctgtgttagaaaagcaaatgccttttgtaaaactaaaagttttagtatttgggaataagtatttaataaatttatttgctgtttatctgcccccttttagagtatcgttattttaatatagtatttctatgttcttagttactgataaacatcaattcaaaccagaacagatgttatatagatttcgctatgatgatggaacattttatccaagaaatgagatgcaggacgtgatttcaaaggtaacgacctctcccacaacctctccaatagtagaatgcatgttgtcattcttcagaagataaaaggtagttgagaaacataaaagatttttctagtttagaaaattcttcgactatatatacaagcaagcctctttatttatttttggtatttcaagaattctaacgttcaattgttttctcattctcttacctaattctaaatggtagtagtactgctgcatcactcaccaggttatatccatggaaaacccttttacatgtagcaacatgttgtcaaaatacttgaattaaaaaaaatacaaatgtgtaaaataaatgtaatgtcagattttgtacagttgacaatactttgttgatatatgatgaacaagtattatagatgtattactgtattggtatattttgtttaatttacgttagaaattttatattttaagaaacataatttagaaaaatctttgtatgtgtgtatgtcatatatgaggaatttatag

SEQ ID NO: 130134 - DNA, 1930 bp, Homo sapiens
agggcagagctgtgagaataatactgtagtgcaaatccagccttcctggagcattcaggagcaggaataaaaggcatttctttactctacagattttgagatttttagtataatctattgtgatttaaagagaagaaattctattttattattttattaatacgatgtacagtaagttctcacttaatgtcatcaataggttcctggaacctgcaactttaaatgaaatgacatataatgaaaccaattttgccataggctaattgacataaataagagttaagttccaacagcatccagtatttcatttcacttaaagtcgcagtttccaagaacctatccacaatgttaagtgtggacttactatatttccagctaatatagcagtaataatctatttggatataagacaatgtgaaagaagagatgtcctgttttggtaacattgtgagtctcttcccttggtataagctggtggaggatttttcaggtgttttacatgcataataaacttctcttatttgcatgtaatttgggcaactaactcaggttacagtggtaaacttctctgttgcatattgatactaaatgaaaatattttcttgtgcttacctaccctcttgcttaatttttgttttttgtttgtttgtttttattttttcctttatagagataaagattaccatttaaggacctacaaatctgtggtcatggccaacaaactgatagactggttaattgcacaggtaaatagacaaatagaagttgctgagtttcacttgctgctgctttaaactctgagtgtgtgaattaggacctttattctttttcatctgtagcaggcatttaaaaaaagaagtacatacaactaataggaagcagagttaggatttgaacctagatgatcaattttagagtcctcaaacttcacttttgtgttatcctgtttctcaaaaggaagatgttcctatttttaaaatatcagatgatccatcaaaaaacactaatttgagaatctgaagaatagctatgctcatttactaaaatatttttatgttttttacactttgttttaaagtatctgtttattaatgctagcaagttattctaatctccctgtgcctttttcccttttagaaaataattgtgttttgataatgagctttaatgtctgcctgtgtccattttaaaaaagaaaggaatttattgttgttattgttgacctgcttctcaagatttagatgctgactgctagaattgagaaaatgtcattcgcttataagtaaaaaaaattagggcatcctttccatcataagagacattcaaccataaattattccaatattcaaaagtttaagtattggtattcaaatatttaaatgttttatcatactagatcaactagtaaatgataaaatgtgtttcactgattaaagaaaagatgaagaaaactgatacccactgtaactgaacttactattttgggggaggggatattgcttggttgaaatgcaagtcactatgtttagctatgtgagtcaatttcatacacacctttactttttcttaagggtggcttgctttctttgtttcaagtagataatagttgatagtttgtcataaaatgtttattttttgtttcagttgttaatacttaatccacatttggttcatctgtacacacatattttgataatttatattagttaatattatttttaggctgttcaagaacacctatttttatatttcatagcacttacatttattacatttagaagtttttagatgaaactaaacaattacctttagataaaacatcaatttatattttcagtggcttttctagcatcagagcctttcataacactgtgggcaatgtgtgtcattcgagctgatttctatgttcattattggagttggactttca

SEQ ID NO: 130135 - DNA, 1047 bp, Homo sapiens
gaggtttttgtttgtttgtttgttttttgtttttcatgtaagggtctctttcttccaagactctgaaatgataatattgaatgtccagtatggactgagacactgaattgatttggacggttttagaacacagagtaaaaaaactggctctactatgattggagtatattctagagcctatagtttttctcttattctgcaatatattgtgcgatgtcatcttggaagacaaaatgagtgttgtgttcttctgagtacatttttcattcactgttgttgtgctgcttctattatagtataatggtttgtaataaaataccctgtttcacaaagttaaattcttatttggcatgtgcagtaatatacctttaaaacatcattcaattcctgtacgttgtgatttgggtatggatcactcatagttcataattaaataatgccttgcttcttcacatccatgcggtcttactgtgctttttctaaatgctcaccaggtgcatatggcacaaggaggattttaaaagagcataggaaacccagaacatgttaggctatgttttttacaccattatgttcaataatattagtctggccagtgtttcatttgaataatcaatcaaataaagcaatcaaatgtcagtgattattaaacaagcttttcttgtaagcttaatgttcaagcaagtgctttgatgatagaatacacaaacaaagcaggaagcaatcatgatttctgccttgaagtgatgttggtcaattgggctaattttcatgtaccctctaaagctctgctgcagcgtcatcacccccaggaagcctcgccagatcctctagcctaggctcagggtcaccttctgtggtcccagatccccaggtatatctgcctcattgggaatatggattaaattggttattggtaaagtacttaccttttaatgaccaaatcctaccctagatttgcattacctcagagcagggaattattttgtgcttgagtggtttaatatattttttctatcacttggcacaatatgtagaaaaaataag

SEQ ID NO: 130136 - DNA, 1054 bp, Homo sapiens
taccccagatctactgagtcagaattctcattttaactagatttgatttgtatgcatattaaaattcgagaagccctgctctagaagattcttttttacttttactgtattctaacattgacagtaaggaaaggagcaaactagtagtgtgaaaatgagagagaaacagagagagagggagagagagatcttttgataaggacggttatcatttctgtttcctcaatggagtaaaccagcaaatggctctgttcagtggcttctttgccaagggcgacagaggcaattacatttatgtctgcaattgacaaataccttaaattattgtttcaaaacgttttcacagaagcccatgaatcacctcttatattttcttggtgtctttccactcatattattggtggatgtctctggatatctttgttacactattaggttcctcccaaccagcacagctggagaataattccctattctgaggtgttttcattcaaaacccttctgacatcctgtatgtgtggggttttcccccataccaaccaattccccaaatctcctaacaccaactgggtgtcctacaattcaatttagttgtaaagccaggtgttagcacagacacacaggttaggggatcagccccacaaggttgcccccatttcaggcgcctgtcacatgtcccaggctttcacctgtatttctgaccaactggctatatattcagcgggttcccacatcccttccttgggttcagttatttgctagaacagctcagggaacccagaaacttacaatcactggtttattataaaggataagaagtgaaaagcctgatgaagagataaatagggcgatgtctggaagagtgctgagcaccgagctgtgtagtgggaagctctgtgaggggttggggtgtgccaccctccagacacgtgggtgtgttcactcactcagaagctctccaattcctgtcatttagggatttttatggaggttccattccttagacgtgattcattaaatcatcagccattggtgactaaacttgaactctagc

SEQ ID NO: 130137 - DNA, 1008 bp, Homo sapiens
aacatacttgttaaatgagtaaatgcaaaattatgtatctctaggacgaatttttttttctgttctgattgaattgacagcctgctaagcaataacccaaatacctgtgccagtatttttaaccaagagaaggtggaggcagttaatgagcacttttccaaataaatcagttctaattcttatgtaagaatatgatggttggagaattgcctgagcttggtaggatggtttgtcatatcatggtataggacgatgcttcacatctagtccagacagctctgtatagtcagaacagcatggggtttgaggtagctcagtttctcatctacagaagtgactgagtaataataatgaattacaagtttgtggtcatgaaaattatacaaattaatatagaaagtaatcagcacactgcctaatatagtgcttgctcatccattcaagggatggaaattattgaatatatcccaaattggcagattctgaaaataatagaaatactgttatcttctttttattgtactctcttcgtgaagttgttgatttaaatggctacggatgtgaactcttttaacttcacacacacacctatcatcctgtacttcatggataattcagttttgacacaaaatatttagaacttattccaagcctttgttgtaattagacattatacggatgaagtcataattgacacgatctctcattttacacatttttgaaatttagagatcaaaatcacattagatgcatcatattttaaaaattatcctcaatatttagtatttactttgctaattttctgaagttttatgagtgatttagaattaagattttgtttttctatttctaatatgctagttttgtatattatactgtgacttttcccatttacagatgaattaaaccgttcaagattgctaagagaaaaggagagtatttttttaagcaattgcatgacatctttgaattgtgttggaatccttgtgacagcagtttatattttag

SEQ ID NO: 130138 - DNA, 1068 bp, Homo sapiens
gaagctgaagcccagagggctgatatcatttacctatgagaccaggtggtctggcttcccagtttgtctcttaaccactctactattccaatttctatgtttccaaaaaggatcttaatgaacacataagaattattctagagatttaataatagatcagacagattaaccacttttatcacttcatttacttttcacttctaagcatcccaacctgctctttaataggaatctgtagagtttttcccagtgggaaattacatgtctaaaaatactttcttacctcaagttctagttatcagataattaaaattaccctgacagtttccctctaggctaagatagaaattttaaatgtaaatttaaagttaaggacgtcctttttacttattctgagaggaaagaaaatactttatctcctgcactatttctgaaatttgtccctgttcacacacaaacatattgaacctttctttccttgggcattcatcattatcaagcacttccctgtgctaaaagctctgaggtggagacagacaagtttcctgtcctccctaaggaagctcagagtgtaaccaataagttatgatttaagccaccagaaagggacagaaatcacagaacagtattttgtctctattagcaagttatctaattactggcatgtatcatgaaacagattataaagaattttaagtttggcatgactcctagttttatagctaactgcccttaaaaaatcatttaggattagattatatgatacaagaaaatttgaaatataattgaatcaaaaatatgccatctttggccgggcgtggtggctcacgcctgtaatcccagcactttgggaggccgaggtgggcggatcacaaggtcaggagatggagaccatcctggctaacatggtgaaaccctgtctctactaaaaatacaaaaaattagcctggtgtggtggcgggcgcctgtagtcccagctactcgggaggctgaggcaggagaatggcgtgaaccctgcaggcggagcttgcagtgagccgagatcgcaccactgcactccagtctggg

SEQ ID NO: 130139 - DNA, 1033 bp, Homo sapiens
cccaaagtgctgggattacaggcatgagccaccacgcccggccccctctgctttcttttaagctactcggaaacccttgtcttccagctctcgggctatgactcatagaaacccagtatggtcataggaagatttcaccagggctgtccttttaacaagagtcaaatgatcaatcatattgaaagtatcaataaatattgggaggttatttctataaattatactaaaaacttgcctgagtaactactggcttttgaattgcagttgttagcctgtcattcaaagtttcctaaaaagagagtatcaatatttaataatttagataagagaacttgttgctgaaacaaatagtctgtttgtcctttttttctccacataaaagtatttatgtgtttcatttaaaagctgcttctgtcctacaggaaaataataacttaagtgtttgggtttttcacattctcactgacttgtagcaattttctcaagactttcgcttgtcaccaaagccttgctcagggtgaataaggtgggaaagtcaataggtcagctgcaggcttttccgtatttattttgcagtctctgcctatgtagaaccgtaccagcaacgtggggattgatcactatttaacagactgcattagtcctcagatgtacaattcttcctccatggaaggtaatgaaagggatcagggaaaatataactgcaaaaccttagagaattagtttcttcaatcaggtgcttcattctagctgtcaatagacttttcacagtcgtgctctgtaaaagtaattagaagccagaataaatgtgatcattacaggaatgaacacactttacacagaacggtgcattttatgcagaaaaacgcaaatctttagtcaagaaggaacacattctcccttcaatttatttttactacttgatcactttacaatcaatatacttacttagcatgcttcaaacctagtttctttttaatcatgaactcattttagtatgatgaagtctacattcacagtgaagtaatttgga

SEQ ID NO: 130140 - DNA, 1034 bp, Homo sapiens
ataaagaaaaaaatattagagatttaaaaattaaccaccatgcctcctctcccattcattaaaatggttttattatgcttgttttcatctttcccaagtggacacatgtaataatggagagttcctcttgaagaaggccattattgaagaaacctggcgacatcttgcaaatcatcatgagaaatgttaaggacaatatagactgtgtgctatacattttcagtcccccatttgcaagagagaaagtcattaatgtgtaaaaggtggaaaagcatgctttactctttctcctaagggcttatttcttattagaggagaagaaagctgactaaggcctccagcaggactcactttcttctagctgcctttgggcatcctttattcttgtggacagctctagcaaatcaatgctatttttggtgtctgcaatgggcatggcttccttgggccatgaatactgggtgctgtgccataatggccctggggatcagggaagtgccctggggatcagggaggggaaccaggatgaagaaggggactgtaagcctattttaaaactaaacctttaagttagatacctaaaactcttaattttatgaaggctctcatatgagaggtcagactcttcaaagaatacaccatcatgagaatttttctgttaagatatatgtataagatatgaaaataaggctttatttgtactttaaaaggaccattaggggacttgtaatttatggatgcacaaggtgtattctatccttattctaaagtatatgtaatgtttatcatttctacattgatgcaataacattgtttttagcatagtaaatacagtaatatttattttaaatccataattttcaaacaaaacactcatgattgtgataattatatgggtttacactaatttagtatgtgaaatgcttttcatatctaaattatgtgcaaactattattaattttttttttattttttgaaactgagtctcactctgttacccagactggagtgcggtggtgcaatcttggctcac

SEQ ID NO: 130141 - DNA, 1030 bp, Homo sapiens
attaatttaaattttgggatcattacattcagaatgaaatgaaattgaccttgatactaactttgagagccaaaaaaatgaatgggtaaacaaagcctaagggtcatgttaattaatttaacaaaacacactattttcagtcctttgggcttgtacattttatagacaaaattagcatttattgatttggaagtgttcaattgagagtaaatgactctgtgttttgaaactaatacctttgcatttaaaatactgaagtattattttgttagttgaagtagatcttttcctgtgtagcatgatttaatgcagagcagttattcacttatacttctgaaaagccataatattgaaatttaaaatgaatagtcttactttaaggtcacttttactttacattttactttaaaggtcgtttttagactttatgcactagtggtattgaaactaacctttaatatttgactaaattgcttgtgaatttttggaaactatgtttaatttttaaagacattgttatgtgaattatcttactaaattatcacttaagaactctctcatagcagtaatttcattaacacatatatatactaaccaatttgctaaatgaattgtcggttgtcctgcttaagtactagggccaagctttgaaatgacttaaagtgatctgaattttgattgagaaaaataatctgtcttctatcgaatgtttgaacttttagtgatgagcctcagcaaagtttcaccctgcatgaagcagaacaggtgggggaaaattacaagaggggtctgtaccaaaaatggccccaggatattccattgaacaaatattgaccattatcttcctaggtgctacaactccatactagtcattacagttagtctttggtttcacaaaaatgttactgcttcaaaggcttggcattaacagtgatgtcagcattcatactgccaacagtctgctggtcatacatggaagactgttaaagtgtggtctgtgcatcattgagcaattgttatgtagacacaa

SEQ ID NO: 130142 - DNA, 1074 bp, Homo sapiens
ttaaaattgcatttctactagaaatagctttggagagttaattttaggtgcgaataacaggataaatgctatctgatcaagcattcatccgaaaaatgtttttgagaattcactttgtgcaaggcacagctgttggggctggtatatgtgtggacatgtttgatttgaaaaccttcgtggtgtctctgtgtgttattgatcatctgtgtcttttgcttaaaatggcattatttgtaacacaaacctaatatcatatatacaaatatactgtatgtagccaagaacactaaattggtaagacgctttagaaaatatgcatttgaatttgaatatctaatgcctcaagcaaatttattagagtttcagatgaatatatatttttgtaactggcaagtaaatgagtagaacagagctttttgcctaaaaatatttttataagtactcatttacatagtattcattattttaaatgacaaaatatcaaattggttctataaatagtaattgttttgaatatatccatacttaacatcatatgaaatccaaaatttaatgataaatttcatctggatgtgttattataaaagtcatctttttttcctttgtaaaatatccatgtaacatagcttccattactccatattttatgtatggttaaaattatcaaagtgcattatgtattttatattgtttatttttgtctgcatgaaagattggaatagtaaccgtgtatgataaatgttaataataataaagtgaaatgtagtatgaccaattcagcttctttccatttaaacttaattcctattatgttcttacctatttggaggacaaaaaccgttaaacacagattttcacccttcaagcattcacaagctcgatagaagaaacttgacacacgtatgaaacaaattctacaaatatgagctggagggacagtaactgctaggaaggaatgagagagaagcttaatatgggccacagcataggaaaacttcacgagagaaaagagacttacactgtcccctgaattaactagccaacctatcaaggtttatttagtacttattatgt

SEQ ID NO: 130143 - DNA, 1033 bp, Homo sapiens
agcctcctgagtagctgggattacaggcatgcaccaccacacccagctaatttttgtatttttagtagagaggtgatttcaccatgttggtcaggctggtctcgaactcctgacctcatgatcagcctgcctcagcctcccaaagtgctgggattacaggcaccacttatttctataagctaccctacctcacagtctttatggtcaccaatgctacagtaatggtcaaatgtaacagccacttggttctccaaaatactggcttctgtaagaacttcatcacaatcaaacacaggctataatatttttaatgaagaagcctctgcatgtcacataattgttagtattataatttccactggcaaagagtttcacattgtgattcaaggccaaacatggccaagctaatcatgaagttccatctctgaggttcttgatcctaaatactttatcaatcaggagtcagttagaaaacggaaaccacatttggtagttcaaaagacataattcattacagagaattgatggcataggagttggaagactgaaaaagcaaacagggaaaaactgggataacatgaggttattaataacttcaggaagcagctacccctaaagcccagggaaacacaggaaagaaactgaggttgtcagaacttaaatctcagagacccagtccctcctgctgagaagaaagcttagcctagatgttgctggtccctctgaggacttgtaatgagaatggttctccaatgccaaagaagctagagatggttctctggtgggccaaggggttatattaataggaatagcaagcaatcaagagggagtaagtccctcctctcctcttcctgttttcccatttttgcaactctccctaggagcataacttactattattatactttaagttctgggatacatgtgcagaatgtgcaggtttgttacataggtatacacgtgctgtggtggtttgctgcacccatcaacccgtcatctacattaagtatttctcctaatgctgtccctcccc

SEQ ID NO: 130144 - DNA, 1042 bp, Homo sapiens
cagtctcgctatttttcccaggatggtcttgcgctactggcctcaagtaattcttccacctcgacctcccaaagtgctaggattgcaggcacgagccaccacacctggcctataattctttcttactatgattgtactttagaattttttttaatgtgaagcttatattaaaatatgtttgtatcccgtatggtgtgttttggatacatctacagctaaggtaagatgggagcttttaacccttcatattcagcttctcctctcattaaatccagtttaaagttttccccaatgctgactagggcacagtaggtgcaaattaattttattatttgcatttgacaggattcattgtagttcaaacttaccagacacagatattgtttgaggtttcagctgttcaccaaacacaaatgaaaatatttgaacttcattgtaattattcaacgcaagctttgaaattaggagagtgaacccttgtggataccatatagctcctaaaacattaacgtatttctcccagtgctacagagtctctaagtaaaatatactaaccaaccagaaagtagttattattatcatttcctttcaaaaaataaaaaaatgtaaacagtttaaataattggcccaaggttgcatccaagtactaaaattattattttgtcttaggggaaaatgcttggaatatgcaattaaaaattattcaaataccagtttctctttttattagaagtgtaacattagggagttctataactctctgaactttgatttactcaatgataaagtaaggtaaatattctctaccttaatgtgttgttgtgaagattaaatagggatttatgttttgacatagcaactactgcaaaataagatggcaataaatggtagtttttacttctttcttcatgtaggaaaagatgtgatagaatcaacattaataatattctctgagatgttttcctaattctttagcagagatggatctgtgattacttatccacatcctcttattggactagctcaattttatgccctatat

SEQ ID NO: 130145 - DNA, 1104 bp, Homo sapiens
cagcacagtggtgtgtcaagacgggctgcccaatccaattgctggggctgggtgtctcttacggattggaggctgagggcagggctgaaactggaggtctgagaactcccagtcaagtaacctgagattttcagagagaaaggactgctataaaaagaggagaagtgggaggtgctacagagaaggtggagggaatgaattattctgatgaccagttgtgcgttacttttcacaactcctcgtgctccccctgagatgatggggaccctcagtgggatgcacagaaaccctaaacatttttactgcccgtctatggaagggccatctcagcaagacgttttcccttccataggagataaaaggttcatcttgacttgctgataaagggttaatgtaggagtagttggcactgaaatgtgacatctacattttgaaatctaaactcctacctttctttgattagatcgtggctgcctccaacattcttggcaaggagggggtgggggcgcagctaagagcagaaacttctctattcccacacacagctcttcactgtttgccacaggctgaacttcagaaatagtcaatgaaaatcattttcgtttctactcatgtaaaatagcacgcgctcccatagataaaggtggcttttttaatcacttgctgctttcacagacatctctttgtaaaagcactttggtaccagagggctgcactctgtcattgattatttttattggcttctagttaattgcacttataatgtccatatagctcaaacagctcattaacaattttgctttgaaatgttttcaatttttggtcatttcaataccttcttcttaggggcattttttttttttttttggttttctgaactgtttaatgaaagtaagtactttgacagcagtctgaaccagaaaatggctatacttgttacagtactttaagaagatatctggaaatcaattaattgccacaaatctcacaatttcaaaaattccatcagatatctaaggaattttgataaactgaaagagaaaataggaattttaaacactaccaacttcctgacagtgtctgtgggaagccaacattttaagt

SEQ ID NO: 130146 - DNA, 1113 bp, Homo sapiens
cctctctgaccgctacctcttccagcaatgcttttcttcccttcatgttgaccactggttatctatggattgcacttaaaacaattgctttattttttattctgctctatagtttgcttctttattccttgacttctcaggtggagtgacagggactggcctggtccactttaatgacccacagaagaccctaataagtgtgcttactaaactcaccaggacattcgaacactcaagacactttcctctctagagttaccccaatttagagccattcactggctccggtagcttcctccccacccaggacaggaaacgaaaaaaaaaaaaatgaaactcagtgggttttatttgggggaaacttaaggaaaatgcccctaaggcagaaagtgaaataattgccccagattaagcttgagtattatatgaaaaatccctatgaagttcagctttaactgtagtagaaattacatgtattggctgctgctctatcataaaatcccaaatatggctttggagcaggagagtacaggctctgggttcaaacagacctgtgttctaatccagggaccacctctctagctgtgtggccttggacagcgaactgacccattctgagattcagctccttcctctgtaaaatacagataggagtacttatcttgggaacattttaaagaaaacacataaatcacctagctcagtgcatatccaatattgtatgttcaataaatggaagtgagagagggttgattggtgcatatgtagatccagacctaggatgcaggaatgacaaacgttcagctatgtcagtcattaatcctatgtatctatgatgtgccttcctttagcattttcttctgccaccaaaggcaggggaataaggaaaggagggagagagcaagggagagaaagtgagagagagagagagagagaaggagggaggtgctcttggcatttagggatttggagcaactgagctaatggctctgtagggacagtagtgacagttaaatacacgttgagggagaaatgaagcatgaagccctgggtcctgcaccaaggataataaagagcaggccctgggccactgtgctatgctgttggggaaca

SEQ ID NO: 130147 - DNA, 1822 bp, Homo sapiens
ggctcaagtgatcctcctgcctcagtctcatgagtagctaggattgccagcatgcaccaccatacccagctattttttatttttaattttttagagactgggtctcactatggtacccaggctggtctcaaactcttagcctcaagtggtcctcccagttcagcctcccaaagtgctggtattacaggtgtgagcaaccacaccggccctaagccacttttaattaaaaaaaaaaatgtagctcttcgctttaccttcaaaggttaaatttttcttttgctgttttatttttgtttttgtttactacacaggtacaaacctgtaggaaactatgtctacgttttctaaaatatgaatctaagggacttggacatgctactgtttaactgctgtcggtgagattaatactaaatctctgtgcggaataaatgaacagacagattgtgtttctcaatcaaaagttttaattgtaaaaggtagactctctcaaaataaatctataaattttgggtcgtactaatcaaattctaaaataaagttagaaggcttgtgatgggagtggagtttgggaactggcaagagtccacatggctcttgttgaatataaactaaaaaacattctaaagctggatggacaatcaattcatgagcaagcctagacattttcataaaacagtatccttgtaagatggggatttgtcttattacatatccaatcacattataccataacaattgaattgtctgttcttaagcaatggactctgatgtagatttcatctactgtcatgtagttttcctcttgctcttctttgttttgctctattcttttgttggcattgaccaaatcttcagctgagcaacaaactgctgtaaccagatgctagttctgttgctagaattaatggaaactctgaactaatttttttattttgtcctatgatctttccaatcagtaaatagtgttactaatacatgcaactttttccacttcatagtacgcaaataatttctgagacaggtttgtttcaagaactcaggaaaatctccttgtattcctttgatgacagaggctcaaagattattcagtctaagtgtcttcccattttcctgaacaacactggcacatttagcccattcttaaaaaccaaaatggaaatctgaaatacaaagagttctgtttattgtccagtttttttggtatgatgttacaggcataatctgctatattaatttaaagtaaaactaaaggttacacaattaaaagatattagctataccagaattatggtgggaaaagactaattgcattccaatgtacatttattgatcagttactttagaagtgtgcacctctagatattatcttcaaactcctatcacaaatatgcctttgcttcccaatcacctttctgtcatataacatgtgttctgaatagacttcttgccaatttaaagtttcacccttaaccttcacctgccaataatcaatcttctcctgaatagaatgtccctgtaaacagatgtgctttaccgtgcatccagaaattcttgaaaccagcttttaactttcatcttataaaaagtgcatcccacaaaagacaggccccctacaaatcatgttctctttttttcttctgagaactttatgctggtaaaagaaaagaaagttttccgaatataacagataaataaaagcataggacatgtaatattttttacttgggatgcctagaggctttacatgtgttatcacattctttttcatatgtgatattgagatttagtaaaggagatttatgatatggacccaatatcaaac

SEQ ID NO: 130148 - DNA, 1019 bp, Homo sapiens
ctttggggaagttacggatattcgagtcaaaatactcaactacatctgcataacacctatataattctcttcttttgactaagagactgttagtggagcggaacatgaaatttaaaaagtctagaggcaagaagagatgaaatatttaagttgcctatgctcacaaaccttcatattctaccttggaggaggctgattgacatcctttcacagaatgtaccaatgacttattcacaaatgaaatacacgttcccttcttcactacaaagacaaatcatccttaattttatgatttgggaatggtttccccattcccctgcttttctttctatccccttttgttttgtccttttttgttttatttgtttcaaccatttcctattcaaaataagagggccattctctagtcaagtcttcctactaaatcaatgggcagttttcagaactaggtatagatttcttagaagtagaagattgtgtttgccttttcaaactcgtgcattatatgttggaggcagcatgactgaaagaatacagagcttgagtcagcaaaatctggaactgaaatgtagccctgttactgaaaatttgtgggaatagcattgaccatggagacttgacagcattttcgttcctcaaaagagacttgggtcccattcaagtttttaatgaagactttggcctgttctatgttacccaactgggttttctgaaccatattccctagttcccctggaagaaacgccagcctaagtatcagcacctgtaatctatttctcactcagggttgccagacatgagggattaattgacatgagccagtttatatttggaagccattaatggctagcaactgaattgttgagacatccagtgcaacgaaccagagaggaaagaataacacacaagtgccatagttagatcaataaacatcatcttcggcaagcacaaacgttgggtttagctgccaaacttaaaactaggtctcttcatctagtacccacttaggtcaatgggcc

SEQ ID NO: 130149 - DNA, 1022 bp, Homo sapiens
gtactccttatggaaaatctgttctaattgagatcaccaagcaccgttgctatggatgatctgtgcaaacatgcagctttatcatagagaaacttctttgtaaaagcattttttaacatacacttaaagaacacactatccactgttgatgatgacaatattaaccattacgacttcaaaacaattttcacttgcactaaaccactggaacttgtaatatttgagtaaggaaagcagtgtgtcatttctgtacaccagaaaactgaagctgagggacagcatgccatttgcctgagtctaaacacctgagtgaggtaattagtgttagaactcatgtcttctggatcccacttcactgcctaatacttcaaatgatttcaaatataccatatttggtcaatattagggatacctattgcattagaacagttgaactgtccccttagtaatgtcaccttactgggaaataaacatttgaatacttcctcaagtactggaactttcccaagagaagtatatgagcaatattcttcatagcttaataaattacatgattgtatatacaattatgcatctatataatttgcatttgaagctgatttatttgtaaaagaagtagcagtattcattattagattataaatgtatttcctagtcataacttccatttgttattttgtactataaggaataacaatttaataactcaaaataaaaagattaatttagaatatcctaagtatgattctgactttttaaaaaagttttgtttttcactgcatgttctcactcataggtgggaattgaacaatgagaacacatggacacaggaaggggaacatcacactctggggactgttgtgggatgggggaggggggagggatagcattaggagatatacctaatgctaaatgatgagttaatgggtgcagcacaccagcatggcacatgtatacatatgtaacaaacctgcacattgtgcacatgtaccctaaaacttaaagtataataataataaaat

SEQ ID NO: 130150 - DNA, 1710 bp, Homo sapiens
tactttaaaaagaaagaagacaaactttccttcctgtccctgtccttttcgtattatttattcattattcatcatattattattcattatattctcagatgatggaaagtatgtttctggccaaagtcttccacccaaatttggtcccttgtaatgataataagaggggaaagaggtttctgttgataattaattcacttaacaaaatagtacccaggcgaggtactgaaattggccactttcacagcattctggtgatgtctggctgttgatacacaccacacacacacacacacaacactacacacacacacacacacacacacacacacacacacacacactcctttttgcccttaagaggagccctagtcacctggcttgttagacaaggagaaatgatgccactttggtcttcagtttctctgccttgggtactcacaatttcaatcagttgtaattgttgaaagtttcttttcacactacgaaataaatcccatctttcagtgcaggcttgaaacttgcactggcttgggtaaactgtacaaaacactgtagctatagtggacatgtgaatttttattaaatttttcactgcataaccgaaggttctaatattaaagaaacatggacactaactttttaagcacaggcaaaactcaaagccctgttatcaaactatgtgtcttaaagagtgctgaattaacagagtactcttctcagagattatgctcactgctttgagaaactgcttttcaacaagaggtgaatttaaaactctagaataacatgaagaaagacacaacttctgaatacttagcaactctgacttgctatttgaacaagccaaaaaacaaagggtctattttgggcaattgtacaatttgcatttataaaaccgtgattataacttggtatgctatgagatacagagatttattgttttaataagatttcaggtaagaaaactaagaactataaattggtaataatgtagaaaagcaaggcctctcacttttaatgctgtaagtgctgtgattcatttgtaaggctttatcatctttacctctagatgaatagatgtgaaaaccatgtatagtatgtatgtatatgttagtgtgtatatgtgtctttatcttaaattcttacatttgttgtatctatctagtgctcagtatgttatatgatagtacaacatccaaaatggatcaagtggagaaatttatttcacatcaactttcagattgcaatgtttattcagtatttattaacacacatgggaaatattataaaattatgtctttttttagattctctttaaatgatattttcccttagaattctctgtggctcccatgaaattctaaggtataattaaagtcaaaaataagattggattctagttgcttttacccctaaatttaaaagtgatatttcaacactaaattctatactttacctaatttgattacaaagatgaaccacataatctcagcattagcctcaaaggcaaactcaatcataatagaaggaacacaagctttgatgagatctggatttcaggcttagtttggtcaaactgaattaactgagccttgtgacacacacctgtagtcttagctactccggtgactgaggcaagaggatcgcttgagcctagaaggtggagactagagtgagttgcgtttgtgccactgcacctcagcctgg

SEQ ID NO: 130151 - DNA, 2273 bp, Homo sapiens
tataagcaaatctcagaagctgcccaagcatttcctgtctttcagattgccagattgtcccttgttccaaggagagataggttgtattcacatatgagaagacaccaaaaggacaattaaatttcacagcttgggggagattttgagggttctcatcaaaaatgtttacacctatggaacagattgcttttgtgtatgtgtgtgaagcctggttttcagcttaaaatacacctgccaaaatatgaatggcctttattgtaccttctggacactaatattgcactgttggacaaggtttggtgcgcacagatgggataacttagaacagcaactatgttgtttttgagaaaattaagatttttcctagccttgttaatacctatttgggatggaaaattttattataaggatggcttagctgtgcctggcactttatttttaatattattttaattattaagttaaatttagtatattaatctaaatgtaggtggtttttaaaattgcccgtagactgtaacagtaaactaaaccttttcaaggaatcaatatcagatgtggaccctaaaacttatccttgtcttgctttaagtgcatattggataccaagacaatgataatttgtcttgctgcagaatatagagacctatatttgggggtgctaaaaagtagactcttttcctttgtgattccccttacatattttgaaacatttctcattgaagaggacaatttattacacagaatatcaactcatttaaaattaggtatttgttgtaaaaaccatataacagtcgcttaagagttttttttttttaaatcacacacttaacccaaatcagttggtcttttctttataagtatatactaagtagaatcatagaaaattgcttctatttaactattgttggcctacaaaagcagtgatttcatagggtattatctaatattttataaaattggaaacatggagaatgtacaatgtttattgttttgttttcacctacctttgtgtcaaaacggttcatacaatttctgcattgtctttttagttcttttaaatttgtgcattgtgttccattacatggatgtgggacatataagttgctcatgctttttctttataagagagataacactaaacatacacacacacacacacacacacacaatcaatacctcccttcacgtagccattctgtttagttgcattttaatgatggtttttaaattgtcttctcctgcaccatcctcttatccctttgagactaatcactttcacatgtgagacttcaatgcaaatctaagtgataagcaaatgttagtatgtacaagcacacagatttgcacccatgtatgtacatagctaaatggatctgcttagaccacagtcctcaaagccagtgagcttatgtttaaagaaaatgccaaactccaattggatgagaaacattgtgcccatcaggctgtgccatcttttgcaggctcctctctcctcccatctgactgagacctgtcccagcaggtggctctgtcagtatgcttcggctgccagtaaaattgtgctttgcctgataatggtgaggaagcaaactccagagatgttgaccaacccaaggaaaactctttgctcttgccataatgatacattcaggcaggaagttaagagaaaaatagctcttcccctggcaaggaaaggagtttaattacgatgagggtggggactgggggacattcacaagtggatattaaggaaaaagaatgggatgatgtcattctttactgaggcagtcactaaaatgaaatcagctcacacaacaatggtcttgttctatgctcaaaagcgcaagttggtatgagacattactttgcggtgatgctctcaggaagggcctaaggggccgtgctcacatgaaactatttccccaaacatcttgaagacaggtcaagaagtgcagaatcattccatccagtgctgaaatggcccacactggaccatcatttgtttcagatcaccatgccacagtttaggatagaaaaagtgtctggattcttacaacaccatgaattcaaagaggcagaatatagtggttcaatctggtatcaggccagatgttttaaattggttccttttttgcaggataattttaaatggcatactgaaattaacatggaatatattcctcagtggaaggtttcaggaagtcacttcccaagaagaaatactgccttgtatcgtgctagagaatttgtagggctgattaattccactt

SEQ ID NO: 130152 - DNA, 1002 bp, Homo sapiens
cccttctcttggggatcacagcctgttcaatgtctgagagttgcttcatatgtcatttgtccagttttctggctgtttatggcaggaggaccagtctggtaccagttatactatcataactggaaaaataagtcccaccacattcatattcaaactttgtttctgtttcttttctccccgcaaggcagtgagacccttcaaggcagtgacagggactcattcatctctgcattctcagtatctaacatatgaagcatagcatatatcaggcataataaatattattgaataaaagaataattgaccattgttaaaccaatccataatacttatggtatctatatttaagtaatttacatgaatatctaagtgcttctgtaacatgtggggtttttttaagcaactgagaataatctattaaattactgaatatatgtaagctagagatcaatgctagagtcaggttagttctatgctaaccttacataacattccttgtagctgtaagatgccagtgtccagaagcaaatatcatatgtgttcaggtatctctaggacaataatgacacgttattctagaataaaaagtagcagggctgttttcagcattcagtctatgaagttgacaaatagagtatctaccttcagagatttctgcctctatgcaagcaaaagggttaaaaactttcagactatagtttcatttatgttagtcttctaaaggactacggtggcttttaatttaaatagcaagatgcattgagttggtcttttaaaagtctatgcagctatcttctaataattaaaaagtagactcacaaaataagaattacagtcagactgctgtaaactacagaaattgggaaggaaagaagtcttgcattttcacattaaaggtttctttctgaaatcttaatacaacatctgtacaagaggtttcgtataagaaatatctgcatctggaaggatgaagtcttaaaaatctatgacgcttaaaatctg

SEQ ID NO: 130153 - DNA, 1953 bp, Homo sapiens
agcataatgtcaacaagtatgtgagtatagacagggaaaagcactaaagtctaaccgccgaaatactccagcattcaaaagtcaaagagaagaggagagaagagctccagtaaagtaggatgaagacaaatgggtggaggagttttgggtgccttggaagccgaatgaagacagtgtttcaaggaggagaatgttatcaactgcatgtggcagtatgatgaggattgaaaactgatcattggatttatccattggaggtcatcggtgacatgtataaaagcaacaatggtgaagtagagagagagaaagcctgattatttaggcaaagataaaatggaagaagaaaaaaacaagaaatatgacaactctttcagggagtttgctgcaaatggagcagagagaaggacagtagctgataagagaagcacagtaaaatatgtgtttaaataatggaagacataaccacctgtttatatggtaacacgagtgatataattttgaggagaagcatgatcatctgggtaaaaaagaagagtattgctggagctgtggttctgaatagatgagaagaggtagaatctggcccatgggtagaagaatcagcttcagacagagagaatatgcagaacctatctactccgatagaagaacatacgtgtagtggagtagatgctggcgggtgaacaagttgaggagttggggagacctgtggaagttctcctccagttgcttctatttccccagtgaagtataaaccaaggttatgagtgaaggtcagggaagagtatgaggagggatgaggtggtgtgaaacagatatttgagagaatggaagagtcgtgggattagggcaataaagtatgtttgcgaggcagtattaggacctctttgaagttcatggcactgaacataacatgagaccatttaggggattctatgttcttctccaggcacatagagttgcacaggtgcagatacggagcagccagagagctggatttaactcaagtttggggaaaccaagcaaggatggtgaagtgagagagggggaaggaggttgagaatgtttacaaaggactgatgataatgactgtcggtggaattataattcactaccctcccctgataaggaggggaattaagacatcaggggccggtgaaggagtgggaggatcaaggattgaagagccctgccttgtcaaaggattgttggggttggcatactaagagcaatgatcagagagtgggatgcatggaaccaagatgatggagcgggcagttaccagtactcataagggctagggttgattagattggccagggagtggcttggggagaggaggggtgatccagaaaggaagaggcaattgtgttcatgagctcacatccaagagctttgaaatcttcaaaaattcagacaggaagaaatgacagcgaagcaggagctgaaatcatttagaaattaggaacaacgtcctagggtcagtcaataactagggaagtagtaggctatgtaatatgataagattagagataagaaagctaagagatttgaggtggacaatagagagcatggagggagggagaaagggacagagaagaaaagcaggccggcaggctttaagaaagattttggcatgacactgattcaacggtatgttcatccattcttgccttgctataaagaaatacctgaggctgggtaagttataaagtaaagaggttcaattggcttacatttcctcaagcagtacaggaaacatggtgctggcatatacttctggtgaggcttacagtcatggcggaaagcaaagagggagcaagcagttcacatggtgagagaggaagcaagagagtgagcggtgaggtgccgtgctcttttcaatgaccaggtcttgcatgaactcaaagcaagaactcactcattcccatgaggatggcaccaagtattcat

SEQ ID NO: 130154 - DNA, 1050 bp, Homo sapiens
aaacgaaagacgtctgcttctaacagtgacatttttaaagcaagcacagtaatctctgaacatgtatttgaaagtacagatttcttgttcaaatagggtaccacagaaacacagaaccctaaaatgctcacaggtagaaaagctcaggaagaatgtctttgttttcaaatatttgttagggacaggaagccattaaataagatatgtgggtattgttagtgtatgacatatgggtaaataatgatgtttgttttctagagtggttactacaaaacttaacttcttaattaaaaaaaggaataaagatggaaatggtttaagctcagaactgtgaaggcaccaatttgtagatcactgaaaatatttgatcttccattctttctcaacacttcatccaagctattgatgggaaggaactggagagggagtggaagaggaatatgaggaaggtgtgtccttacttaaacttgaggcttactgacctggaattatacattttctttacagcgctgtcattcatttaaaggtctggaggataggcatgtcccctaacaccttcttcccagagagctggtgacatacagttatattccattcttcttcccataccttcctcattgacataacttctggaggtcactactgtaagaccttgagagttctgcatatgctgaagaatattggggagggcttcacagtgtttaaatatgtggttatgatggaagcagaagacatttcttcacaacatatgcaacttactcatctgagaaaattccttaacccgagacagaactggcttcagtgaaaatattcacagaacatgaaggaaactgctttgcatcaagtgcaatgtgtgtccccagtgtggtcatgatggagtgttctgtggtgtagcagaaaggtacgagatatggcttccttctccactttgagaaacagtgatttgggcttagccatttcacctctccgaatctgttttgacccccgagaaatggggataccaacagtgctgccgagagttactggaggatccaaattagaacaagtatg

SEQ ID NO: 130155 - DNA, 1082 bp, Homo sapiens
tgcattggctattttccctaatgctctccccaacccccaccctcccctcacagaccttagtgtgtgctgtttccctccctgtatccatgtgttctcattgctcagctcccacttataagtgagaacatgcagtgttttgttttctgttcctgcattagtttgctgaggataatggtttccagcttcatccatgtccctgcaaaggacatgatcttgttcttttttatggctgcgtagtattccacaatgtatatgtaccacatttcctttatccagtctatcactgatgggcatttgggttgattccatgtctttagaagcccctgatttttttaatcatctgtgttcaatacctttacatcttttttttgacaaatagccacatcatttaggaatccttatagcccaattgattctctagactgtagcatcctagcatcactctgtgttggcagtgggccacaaatggatgacagatgtgtcaagatgtgaactacaggtgtaccaagatatctacctgctcagcctcaggatggctgggcagttctgggatggccagagccccttggactgtgagtggcctcatctgcttatcccagtgtgctgtatataatcaatgtcagtattttccatgacaggaaacactttgaggatcatagtctaaactaatcaagtttatcaaattatattcatttcatggtagttatgcataaatcaaattggctaaggtgtttcgatttacacattcatgtttctctttctaaactttgctagtttattaataactttagagtttagtaattactataaaatcagtttcacaagtctaagaatagtgtgttgtaatgtattaatttgagtttttggaatcctaatttgaggtataactgagacatttatacaaaacaaatgtttttttttgtttgtttttttgtttgtttttttttgagatggagtctcgttctgtcacccaggttggagtacagtgccacgatctcggctcactacaacctctacctcccgggttcaggcgattctcctacctcagcctcctgagtagctgggattacaggcatgcgcca

SEQ ID NO: 130156 - DNA, 1049 bp, Homo sapiens
ttttcctctttccccacctggagaaaccctacctgttcttcataacccagttcatgtcatgcgcttggtgttcccaaaacaaaaccaccctcccctccagcagcattgatggaactttcctttgcaccccgagaacacgactccagcatggtgctcattccaccatagccttccatgcctgtcccttccacttgaccaagatcaaccagagagcaagggtgtgttttatgttgcactcctcatgcactcctagtgcctgggaatatagtgggcactaaactaacttgaaatggacccataaggctctaaacaagctaaaattcccagaaataaatataagtattcatcatcatctacctcttcaatatacagcactgtctttaaaatatattaagaaattgctcataactttcttttttaacagaattcaaattttcagccttgtcctatagttcatttattcatccagtaaatattttctgagcagttaccaagtattgccttctgttggaggcatgtgactatcatggtgaagggttatagaccaggctcagccaacccagatatttcctacatatttgcctttaactccttccttgattttctagccagataacatgctaagaactagctcattggctgggtgtggtcattctcgcctataatcccagcacttcgggaggctgaggcaggcggatcacctgaggtcaggagttcaagaccagcctggccaacatagtgaaaccccgtctgtactaacagtacaaaaattagccaggcatggtggcaggcacctgtaatcccagctactctggaggctgaggcaggagaattgcttgacccgtgaggcagaggttgcagtgagccgagatcacaccattgcactccagcctgggctacagagcgagactccatttcaaaacaaaaaaagaactagcttgtttaactctcacagtaactctaggaagtagttactattctctctttaatttaggtatgagaaaaatgaggctcagagaagtcatgtagcttgtggtgagcaagtaaat

SEQ ID NO: 130157 - DNA, 1105 bp, Homo sapiens
ttctactttctgtctctgtggatttgactactctaggtatcttatatgggtgaaatcatacagcatttatctttttatgactggcttattttacttaccctcatgtcctcaaggctcatccatgttgtaacatgtgtcagagtgtccttcctttttaatgctgaataacttttcattgcatatatgtaccacatttttttaacccattcatccactgttggaaatttgagttgcttcctccttttccctattgtggataatgctgctgtgaacatgggtgtacaaagagctcttcgagaccttgcttttagttattttggagctatacccagaagtggaattgctggatcatatgatactcttatttttattattttgaggaaccaccttactgttctccatagcaactcaccttgttacgttccctccaactgagcacaagtgtcataatttttccacatccatgcccacacttgttattttctggttttgtttttaatagtagccatcctaatgggcatgaagtgttatctcattgtcactttgatatggttaggttttgttttgttttttactccagtgcaattttctttgccaagtgctttaataaatcttcacctaatgcaaacctttttgcacctgtaatgctgtaggcaattttggctactgtgcctccaaaaagaaagtaacagacttagtaaagacttagaagaacaattatgaaaattctaatagaatacttttctcactgggaaagcataaaacaatcctatctgtttatctagaaagatgaaggctgagaagggctataatcaaagtttataaaatcgagccagggaggaaagtactagttcattatgagcaggagcccttcccttcactttcaggacaaataaactattactctgtaaagggagtaagacacataaggaattcattaataaaagtactagaaccttgcatatggataacactttatcttttcccaaagaacattttgttcacattattgtgaatgaatattgccatctcacatgagttgggtgggtaggacaaagatcatcatcccaggaggaaacagcctgtggaaagatgaaatggctta

SEQ ID NO: 130158 - DNA, 1071 bp, Homo sapiens
tacagaagtgaagagcttcagcttaaaacaaaactgagcccttccacttatcggacagacattgtcctgtccactgctctcaacagctgtgaataaataactatgagttttattacagaatcatttttagtaaggtttgccaataaaaaaatcaatggcacaatcacagtgggaatatatacagggtaaggcagtgttattgactgacattaatcattgcacagccattaaaaggtgctcgatgctttccttactggtacacactaacacagtggagtgaagagattcagattcctgcacaccgtcatctgtctctacccagagaatccatagagatcagaggcaacaattaacgccaccatggcagtcagcagctaaagacagacagatccacagcccactcatgcctcatctgtgcctgagccactgagaccatttcagccttgaggggagggtaggagacaggtgttaatgtcagtcagtatctcctctaagaggcgagaagaatcaaaagatgagagtgcagaaagagagacctatcgcgactgcaagcagacgtcaattctgtttctcatcttgaaaatgtcaatgtcacagccagcattcagcctagatagagctcaagagcatggtctctgggaagactgcctgcatttacttctgggttctgctactgagggtctgtgtggccctaggcacagcatgatttagccttctgcacctccatttcattatctgtgatataggaataatagctactagcacccaccacaaaggattattgtctggatcaaattaattgctcatgtgaagcacttagaagagaacctggctgagagtaagtagaaaatcgatgtttctttttcctgtctacaatataccttatagtcttggcagtgatctaagccacctagatcactcaaaattaggcacccactacagtctcttccagctctaggcttccctgattctgtgtccaacctagaatactttttcaggtgagattcactgagaggcagcttcggcttcacccaggtttcattagaaacacaaattctcaggccccatcct

SEQ ID NO: 130159 - DNA, 2187 bp, Homo sapiens
ccacctccagagcatcacacatgtcactcgctgcaatcccccaatgatatacttcacccatccgacatttacttcctcctttttttccatctgtcctcatctctcatttcagaactcttattaagccatcaatccaagttccctctatttttatatgccctgctactgctgtattcacattgttacgtgtgcattgctttgcaaatatccccaagtgatttttctatgtaggttctcctctagagaatttattactgaagaccagaggcagaaaatttcccatttcttttgtttatgctacacttgggagatcagcccggaatgctgaggttgatagaatgttttgcatgaagtaggcactcaagacatgttattcattgactacaaaaggttgcttgatgccctgaagacaaccagaagagaaagagcagttaggattgctcctagccgaggcatattttagggagctctaatgagacccaattagaaaccctcctcctgttctcatatgcgtcatgtgaacggtaaaagctagtatatgaagacacggggctaactgtggctttttggactgttgcatgcttctcttctgccctgaatgcttgcctggtttgcattacgatttccttccttgctggaaaacatagactttcttcctttctttggaagaagtgggacctgttggaaatctgaggctccaagattcaaatgcaatgggcttggctgtagtgctctgtagtacacttcttgacaagtcctgaaaagactattgaattctggcctgtgcttttctgcagtgtttggatgtgtttcagctgcagtgtttggctggacagagtaatcgaaatagtttttttttttttttccttcctcagcaatcttacgttaccagttgatccttaaagttaaaatggaatattttacaaccctgcaaatactttcgagtgcaatcgaattatagctctttcacaagcaaacagcctatctttaaaaaattgtgcataaataggtcaaaatataaattgatgttgttatcctaatagaaaaactggcaaacatttggtgagcttgctagaggataccaacttgcattgaagatcttttttaattattattaaacaaacacaggcattttgatgggacttaatatggaagaaatttttttctcttttctttcatacgattaaaatgctatagtagtaatctacactagtaatctagtagcaatgtcactagtagattgcatttgtgctgggctgggggttttgatgctctgtgtatcaggctattgttctctggtaatcttcaaagggctgctggcctttgaatctgctccatatctaaaattctagctttaattatcagattagcctgcatttttttttcttcgtgattacagggaggagaagtgtatgtttattattctgcaaaatacttgagatggtaggatctcaaatgcttaattttgttgtagaaatgagagctgatcaaattatagactcctttaagctaaggaaaggaaatgaataagtcagggaaacagaggcactgaggggcacaatcgaaataggcattcatgtgctgcactttgctaaacaatgctggcactgtgcctttcagggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggtaagggatgacgtttctagcccatgaacgtcttgtaatatgtcttagactcaggaagaagtgtcatgtaatgaaatgcatgaagttccaacaaatacctaaaaaaggatcaagtgtttttaaactgcttgacatctaccccagggtctgggacacagtaaatgatcaaaattatttattatttattaattaatgaaaaactgatgggtaaatcaatcatgtgtaccttgttgattcatgtatttgttcattcataattaataggatttggaaagtttctttagcttgtggttgtttttaggtctcaaatgttcacttctaccttcc

SEQ ID NO: 130160 - DNA, 1791 bp, Homo sapiens
gacatgccaaagttataaatgtgaaggccttccagtggcttttttagtgaactgtggtgtctttgtgacacatacacttctactatactataattgtatgaaaattagtaatctatgtagtaactctatgttgacagaatttttattatcgataatagatgtatacattcataaaatacacataacataaacacccattacatactatacatgtgatataaaccctgaccatatcccataaaaatggagtttaccatggttccctggtttggaaaatttgtactctctggatatgtaaaaacgaaaataagcttttcaatagtgtttttataattcacaattctcaaatagtaagttagaaaacttatcacaaagactgaactttcagttctccaacacctgcccggtggttgcattccaaatctcacgctacttctctgattgttccatcaacttaacaaaagagcatagcctgattttactccagtaggaccataagaaatgaatgcacccagagtgctgtgatcattatgatggtttcattgagctgtaatccatgtacttggatactacttctatttattttttaaaaatgtgtttgtgtcactttgccaaaggattggagtattacactaatgtcattttggcattcactattacctagggcaacttttgttttaccgtctctttttcaagtcataattttatacttatccatttatttatgattaatcattttacgtgaaaaaaataattcttttttcccactgcagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggtaattttcaggcacttttacactgcatcaatttactttgtgcataatggggaaaagccattttcagtgagttaaactatccacaagattggctttctatgttctcacaatgttagcatgagaaatgttaaggtaattttaaactctaggcaaggaaaagactctcaaggaacgctgcctttgtgtagtgatttccctcattaggatgaaaggcaatcaggctttgatgaaagtatcatcaagaaaatcagaattctctgctctcttatgataatttttgtcctcccagttcccccggacccaaccaaggacttgtccacataatcaaatgttcatcttgtactgttttacttttcactgggacaaaagtatattttgtctgtggcttcagatttaggcacaagcataagagcaaataaatatgataattaaagtttgaaaaaccacattccttgcttttactcctgtctgaccaagcttagtatacgtgacaaggacaccttccctatcacggcaagcatccacaaaagtctctaatgctatcaattctaggattttcaaatcagttcagagaaactgaaatcaacatgtcccatagttctttgaccagtgggttctagttttgacttaaaaattcacaaagattttgtgatagctgacttaagtttaaatttttttcaaatcataagaatgaaggggaaaatatcttcgaatttagcatgcttatttgccaaaatatccccttcccttccagccatacccatctcttcttcatttatctagaagaagccgagaatctgctctatctagcaacctctcccaacaggctagatcacttggtagaaatcggaaggagagaacttgat

SEQ ID NO: 130161 - DNA, 1671 bp, Homo sapiens
atgcggcacacaccatccctctgatactgcttttgcagctgttctggtccttaaatccacaacatgtgattagccatgcctggaagccttcaacatttgcaaatattgcctaaacactttctgaataaagtttatactggagctccaagccaatgacacacacttaaaagaagcaggtggtttaagttttcatcttttctttccttttcattccatttcctccctccctcttacagacctgcatcagccccccctgactgtgggttaagtcattttattagcaagtcaggctctaatcccagcagctgtattgctttagttgtgcaattaacacagtataatctgcaggaaatcaactgctccctattcaagtgtttcaagtaaattaactgatcaaatgttgcagcttttccctgtgctcctggattttggccatggctttgattactgattattgtaattcccacaggtggatttttcgtttgaagaaaatatcttttcttgtgtttatgtattcatgggcgtgtgtgtgtgagcgtgtgtgtatgtatgtgtgtgtgttctgcaactgtaaatttgaagtgggcgtgggtgtttcctgcccttaaagtaattaaattttttgccaaggaattacatcaatgaaacctgagactgaaatatgtatccggtgtttcatgtgttctagtacttttatcgccagattaatcattatcttgggcaaacacgacttgactttttttttccccattgctaagttgtgtattacttaaaatccatttttcgtatgttaccaagctagcaaccctagaaaacaactggcagctgattttctctattatcgaaaatgttcggctgccttgggaggtgcagccttccttcctgctgtagaccttgccacttcgtgcagtgaattgcttctgaggaaagcagttattcaaatgcgatctgatgaatgtcaccttttgtaatttttgttttgtgtcaaatgtatgtttcaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacatgtaagtaacaaactcaactctgcgacctgccgaacatgcctttcccttttctcctcatcccactcctctcctttaccccgtttccttccaccctgcgtatccacaaggctttcttcatgaaaggataacttaagagcagaccacggaacaggcagagccgctgagcctgaaagaaagcgccttatctgggtggtttgaggaggaatcaaatttccagcatttacaagtagctaaatagaaaggaagagatgcacatagagtgaatgggggcaagttttacaagagtttcctttcgttgtcttaaataatattcgtgtgtctgatctaataatgatgatgatcaaatagtatgcttttcatagctgcacagtggggacctctggtctggttatagaaacatggatttattttccaggcgaataccgtagcagctttgctgcagacgtgcaattagaattcctgcagaaggcagcttgagtggcttgcccaagagggcttct

SEQ ID NO: 130162 - DNA, 1050 bp, Homo sapiens
gaaaatataatagcaggtggcatttatatgacccagtgtgcatggcagtgtcccagggtatcaccgtgaatctcagaaactccaggctttccccatgggaaatccacaccaccacagatccagtggaggactcggtcaagactcctgaaatcaaagaactcacagtgactgattctttccctagttttataatataaataatggcatggggtcacattcagccgtcattatccacatcatttcactgatgggatcctcctcagacagagattgggaatcagatttctcggtcacataaactgttgctcattctgtgaggctgcctatttgtaaagttgtggttcttattaaaagcaatctcagacgtagcaagcacccctcacttcccttctcattcattttgttaaagcaaatgggctttggaattcaggcctgtttctaccacttactaatgttgttaatttggaggagttcctcaactttgccaaggcttgattttctctgctgtaaagagggaataataaacctattttacagagcagctgagacaattaggtgagttaatgtatataaaatggtttgcataatacccaacacatattaaactctcactcggtttttaatattaacctctatgtgcttaataacattgaagaagaagattcaagtagattatagtctgttaaagagttcaaatataaataaataattctcagggtgagaattgccatagcatagatatgttacgtacccatggcagagcgtgaggtggcagcatctaatggttgagggagttgggtgagacatcaagagaaggtgacatatttttttgagtacccagtggaaggcatgggataccatgtggatctctgcagtagattaaatatagacttgaactaacctatcctggaacaataggacaatatccttgtggcttacagaaattattccctgcacctatattgatttgtttattaaacgaatagctttattggtaaacatgtatattgcggaagtagacttggttatcattcccacaagtccagttaa

SEQ ID NO: 130163 - DNA, 1028 bp, Homo sapiens
taagtaatcaataaaatactcttctcaagtattcaggagaaaaaatgtgttgaaatgatgattcatcattccacataacgtatttgtgactacatttaatagcctcattagcaataaaatttttatgagttaacatcatatgaggatattcccttgtaccttaccgagactttatctgtagatttgtaacataaccataatcatcttggtatgtttcttacacattttattcagtgaacccaaatgaacttctaattacatgttcagctgccagtcatggttttatatgtttgaatatatataccttcagaggatatttgctctttggggtggtgaagacttcatcttcttataaatgcaaacagaagatagttggaagaggaaaatgttttagcagtgtctcaattatctctccttaatgattatttcacaacctcgagatattttcctaaaagactaagtaagaaatatatagtaagattcctttctggatattttcagaactcctagttataactatgcaccaaatatggataaacactggattatgcagtacacaggaccaatgctgcccatccacatggaatttacaaacattctacagcgcaaaaggctccagactttgatgtcagtggatgattctgtggagagggtaagcacatgaacctacctcagtgatagtttttggcccagcttcctttgtgtagacttattcttgccaatcctgtttggttttttccccttcattttccagcatcattttgagagagaaagaaagagagagagtatgtgtttagtggcttaatcatccctcccttatcttgtcctcattccatctacctctccagggttggtttcttatggagccagtaaaaaagaggagagaaaaatcaaatcagcgtagatcaggggccacatcctcaaaggcaataaagaattgatggagcttgtgctgaacttgaactttaagttaagggccccatctaaaggaacagcaattactcagctccagctaaattttgccatgt

SEQ ID NO: 130164 - DNA, 1020 bp, Homo sapiens
gatatgtgatgataattttaacaatggattttcaaagtacaacctataaagtttgatggtagaggttgttgtgcggggtgtttttgtttttgttctaccaaacaagcaaacaaaaagcctaaaagtagaatgtgctagattccaaaaagttacatttcacctttaccattggacctttccctcccagactgtaagcaaatagaaaatgtggataatgttattaaagcaactcttgccttttaaaaataacaggaaaaagatttgggggcaatcgtggcaacactattgagcatcatcttataccagcacaattgattctgacttgttcctttgctgtatttcagctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtacgtatttctctgtttgcaacattcaactgtcgtacctcaagtgtgtctaagataattcaattaccagtctcagtatctggtttcctttcatccaaaacaaaaaaggatgtgtgtaggctggttaatttcgaagatgaaaaccttttcctccctgccacatcttaaattagctcaagtatactacttaaagagaaaggaaaaataagtgtatcaatgactaattctctcaaattgactggaatctatgtctttttggtctgtgtgcacagacaggatgtgatcttctgggatatcacccttctttgaatcagagatacgctgtcatttaaaaaaaaaacctgacaccatccttttagtgtttaacttttaaaaattattccgaaagaaatgtttttaaaagataaattttgaaaagctggcttttcttttaaaggaaaaagagctaaaggactaggctgctatttctgtcactgtaggcaggtcactgcttctctttg

SEQ ID NO: 130165 - DNA, 1027 bp, Homo sapiens
tctttgaagaatgttattgtgcttcctaagattattagaaacaccctgagaattgtcagatctatatctagaaggctttatgttttaaggactagatagcatagattgaattcaactgtaaaaactgtacatccttttttaaaatattgattttaaagctcttgttcaacggaaaagttatggactattgggttttaagcaaaagtatgcttgctgcaaaaaccatgtatcaggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagt

SEQ ID NO: 130166 - DNA, 1050 bp, Homo sapiens
atgtatgccattgtaattatttccattgtcacttctgggtttccccttttggttcattaatacccattgccttgtttttctctgtacataaattaggagagagaaaatatttgtataatttttttaacaaaaggaactttgagcatgtaaaatgaaacatgtatgcccaaattttgaaattaatgcttttgggaagaacgaatcttttcctgacctctcatcttcatcctacccagtttgtcattttcataaaggacccatcaaatgttgaactcctgtagacagagctttaacatctatttcttgctgtttaaagaatgtggagtcatgtgacagggtaaaaaaaaaaagggggcaggactcagggaccgtaattcagatcacttctcatgtacgaagcttttccctttttgtcgaagcaaatttctacgtaagaaggaagaatccagcaagaatatccaacagtcaaatcacttgcccaaatatgaacgggtcaaagaactatgccagcaggccaggtaccagacagcctgtgaacaaccggggcaggtgagtgacgcaggctttctttaccaccactcatgtgcttctccatctctaatttagaaaattgtccacatataaaagaatgtacatttgtgtataaataagcttttcctagtggccttgagggcaagctcactgagacacctctccgcggacagaattacgtaactggttcaggctgggcctccccattactacttgggctccctccagttaaaaaagatgatgatctcagagaaagttctatgccaaaagacactggtttcctctgaggagaagattcctgttatagtccctgttaactagtcactgaagagttgccaaaaggctacttagtcaaagcacaggtacgtgctgagcctcttggcagtgaaccaccccaagagacatgatagggccttcaccctaggctaaagtcagaatgtcatcttacccccagtagaggacagagcctgtgaccaagcttgaggaatgagaagagaaaccatattctgtttgtttatt

SEQ ID NO: 130167 - DNA, 1154 bp, Homo sapiens
tggctcgccccatgatgggctccaattaaattcatctctgtcttcctcatgtgccattcttccctggctcacattagaaattcaggagcggagaacaaagcagccaagtttgtttttccagagcaagaggggtctggtgaaagcagtcctgacagctgcaccgtgtgtcttggtgaactaacggcttttacgtgtttcattcaagactgtttagtctgcgtgctaaggattcatatatcagtttttggctctagtgacattgaggtagtttgatttccaatgatttcgttgtcatctgtatttgcctacagtgaaagaaataactgagagtcgagttagtgcagggtcacttaaaagcttgcctttcttcattcactctccttaatgatattgccagtgcttctaaaaaaaagaaaaaagaaaaaaactaaggcagcagctcttaataaataacacctggagcagaatcggtaaactgctttcacgttggcttttgcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaagtaagccacgcttttgtgaccatctcaatggtggcctaggcctgtgggaataaacaatagagagacgaaagggttgctccttctacattttagatattatcaatgcatcattttcaggctaaaagcacatcattgctctatttaaaataagaaagctaagactaatgtgacattttgctttgtaaacattttcacttaagcatagaatgaaaatatagttcataaaagcaccagatgcaaaacatatgcacacataaaagagtttataaaatggttattccaaaaggtaaaggatatggtttaagtccattttattttatcgtaatgccaacatctcctgacttgtctgcctgaagttgcttttaaaaaatagtaaatacaaggtttcagtgtgtatgcatttaattttaagaggaaaagcataaacacttttttaag

SEQ ID NO: 130168 - DNA, 1049 bp, Homo sapiens
tgagcatttccttccaatatctcccacaggtctattctattagtaaaccttgattcctgatagaagcatctgttggaagatgacacgaaagcgttaggtatttgtttgttattgctgtcaacagtctgaagatatactctgagtaaaccaggatattctctttttttaagagaactttgatggaaagacacaatgctctatttctgctgtcccagtttggagttcccccagttggatccctgcctatgacactgaattagatttcttttgccagtatttttcgtctgaaactagagatattggagcagttcattaacttgggatctaaaaatataagaggatctgaatggaatcagccagatgttccttcccagctatgtgtgttaaactggcttatttctcctttgtttcatggagatgcagttcttttcagtgtccgccccagctcttttctggttaatgaaaatactcatttcctcctcatgatgtctgcagaaatgtaaataccagctgtccatacaaggaaggaggaagaactaaagctggcaagggcatggaccttggcatggcatgccaactccagaagggtgaagagctggactcacaggcacttgggtgcagtttgcaggagctttttgtggtgccgctgggttttctctgtgagtctggtgcagagccagtgtcatcaacagtaaaagtgggcagctttctgggtcacatgccttgaaaggggtagggattcccatcccagaatgatcaatatcaccacctgtcatctcctttccactgcagggtcacaaaggcttttgagttctgggagtcccctaagaaaatataaatcctcagttctcaatcaacacctctcaattaacacttagtggaatcagttgtcagtcaagagcagactgtacttgcaaaataggtcttttggtcactgaccccactcggctcaaatcttttcaaatatcctgcttatctgttgaccttttcctcaaatcttacaaaaaaaagagagagagagagggagggagggagagagagagagagga

SEQ ID NO: 130169 - DNA, 1032 bp, Homo sapiens
ataacaactctacttagtgaaatctgatcgagtcccttaatggtgaaatgacacactgggtggagccagttatgctgtttcacttcaagccgtcctctccaccttccagactattcctatgggagatgattattagcccgtttttttccaatgttttgtctaaaaataaccaaaatttaacttttcctgagaattacatggacttctggaagtacttttcccactgcttttaagtgggctctcctccctttaacacccacccatttttttcatatgaactcttatttttttttttatcttaaaccttttcattcatagctttcaatctgcattttgaacctaataggaaatctctgttgggcttcagcactgtctgtatttaacaccatgtgtttctttctaggatttagatgttgtgcatgaaaaactatatagtgaatggttttataagttctaaagctaacagaaattactcttgtattttcctatatcaggaaataaagatggaggaagctatgacctacacaggtattcacacttttttattcttctcaacagcttcttccccaataattgcatgatccagtggtttcaactaatttctgtttcttaccgtgttgcacagagcaaagctgggggtgcatgcttgttctaacagcattctccactatgttttgtcattgatcacagaactgtcattttgcttttaaatcagctcactgtcccatcaagatgttccagagcatttactcactcccatgcttgtttgcttgttggatgatgcttttaagcatggaatgatgtgaaggaaaaaaaacagaatggcctttgggagccccgggaaagggtgggagatttattttctttgtggtacttacacattgatttggtgggggagcttcatgaaaatgggttggagatttttattaaatatagcatcaaaggcacaaaatgactaatgagaattttaagagcactgtaaggccgaagttgaaggaaacaaggaatttctttgttgatgttcattcatta

SEQ ID NO: 130170 - DNA, 1044 bp, Homo sapiens
ggctcaagcgattctcccatctctcaacctcccgaattgctgggattacagtcatgaaccatcgtgcctggctcctcctgcatttcttaggtagtattgtactgtaaagaagagatttcccggccagatatggaggctcacacctgtaatcccagcactttggaaggctgaggtgggaggaatacgtgcttgagctcagaagttcaagaccggcctgagcagcatagcaagaccttatctctactaaaaatacaacattcaaaacattagctgggcttagtcccagcacctgttgtcccagttactcagaggcagagcttgcagtgagctgagatagcaccactacattccaacctggatgacagagccagaccctgtttcaaaaatatgaaagaagagattttcctcctctcctgcgtatttatttctatcagtatggacttagattctcagtttattccatggatattctcttgctatcattatttattttgatgattaaagtgtcttagattggccactggtgtccctgcacctggattccgtgtacttttgaagcatcctcatcattttttgaccacctcgttgctttctggcctaaaagcatgttccaggttcatatggcatttttgccactccacatttggaaacagccatttctccaaagggccccagttccttttaaaggggaatggcatttgaacaccaagatctgggtctgaggtgtataaaattgctgctgaggtgtcttggcatatagatccttttgatggatagagctaagagacacactggcatctatcaacatctattcttttttttcttttctttttttttttttttgagacagagttttgctctgtctcccaagctggagtgcagtggcatgatcttggctcactgtaacctccactttctgggttcaagccattcttcttcctcccctcccgagtagctgggattgcaggcacctgccaccatgcccagctaatttttgtatttttagtagagacagggtttcaccatgttggccaggctggtctt

SEQ ID NO: 130171 - DNA, 1064 bp, Homo sapiens
tttcattcctgaaataaattccactgggtcattgtgtgttgctttcgtaatattgaattctgttcactaatattttatttaagatttttgtatcatatttttaaatgataccaatctgtgatttcctttttgtttttaccagcattatctcttagatatattagtttcttattactgctgtaataaattaccactgtgcctttaaaacaacacaaatttattctcttgtgtttctaggggtcagaaattcgaaatgaatcttactgggctgaaatcttctgggggctcgaggcaagaatgtccttgcttttccagtttctagaggctgcctgcattcctcattcatggtctcttctgccatcttcaaatacaaaaatgtagccaatcttcaaatcagtctctcccccaacccccaccttcctctgttttctggggtcacatctcgttctctacccctccttcctaccacctccctttccctttataaggactcttgagatcccactggccccacctggatgctccaggatactcccccaccccaatctcaggatccatgacttagtcacatttgcagagtccctttggccaggtaaaggaacttgtccatagtttccaggaatttggatgtggacatctttgccgggtggagtccactattctgcctatcacagctatcaatgttatccttgcttcgtgaaaagagtttggaagttttcttgagttatctgctctagaacagtctattagtattctcttttcattgaagatttgttaaacttctcctgtgaaagtccacagacctgatgcatctttgcacagtggttctttgggcttgctttttcttctatggaaactgttctatttaagctttctatctatattgggttgttaaatcaagtttagcctaaatctgcctcctcacatattttaagttcagcctaaaggtttctctgtatatcgtgaactataacctaaatagagttgtatacagactgtagcctactcttgtgcccatcactgagttttggcccttcaaaggtggccaactgctcaaactctgt

SEQ ID NO: 130172 - DNA, 1313 bp, Homo sapiens
aagactcagagggactcactcacatgctcttctggttgcaaagttgatttgagtggggccaggagtgaaacccaaatcccctggctgaaaggaccgtgccattttcagcactaaccatgcttagtcatagatgttttcacgaatgtgatcttttttttccccaattttctgttgtttaatcacctgtaacctaaggccactctgtgataacaaatgactaggggaaaatgcttttgagtgtcatacttctcattgattaactctgtaaaaacaatgtaagttgcttgtccaggtaagtagaaagccttttctccactaatgattcaccttcttctctcttttcacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgt

SEQ ID NO: 130173 - DNA, 1029 bp, Homo sapiens
tgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttttttctgtttcagagaaatgaacttaaccaagtttttgtggtacacccatttcttgcaagtaaaattgagtcatgatctctatttacatgattgaatactaaccaaacttataaaatggagctgaagtcaatgtgtt

SEQ ID NO: 130174 - DNA, 1062 bp, Homo sapiens
ccaaaagcctttaaccctctaccagtatttttgtagaaacaattagagatagtcagagtttctttgatgtctacattgggaaaacctttattcagggatttagccaccagcaatcttgtgtggctattgttagtaaataatagtgaattaaatattttggcatggcatctttagtccctggctctgcacaaagccgacttgatttgacattcattttcttggggctactatttaaaatgcatttccttctttcccttcactgtaggtccgtagaagatgaggagagaccttttgcactgggaatgcagtttgttttgttgcgaacacttggtacgtccctgaatttccaagtgtacctcttagttcctctttgcagatggcaaattttcactgtcctttaaaaatggcaagtcatgtcatttattaccatgaataagattttacaggctagtggtgagggtacaacttccttgttttctgatttgaactagaagctgacaggttctgttgtttgatgaaacaaaacaaaaccaacgttaggttagtttctttttcattatgaacataaacttggacaaaattccccagaattttgcacagtaagaaataggaaatcaagcaatttgtgaagaatttgtaatcctagcattttgacccctttatgcctttttactatgaaagcagtagaaattggtctttatttgtgaagttttcaatgcctcacttctttacagtaattttattggactaaacaaagagtatacctatcaagttttctgagaaaaagaaaaaactttaaaaaggaaaagaaaggtctccaaagtgacatatagggactgccttgtaagtatttacttatcaacaagagaagctcagtagtgctgtgtccatgtgataaaccacagagtacatttgtacgggtggaacataggtcttatttttacaaacaccacatccctctgtgagttcttgagacaatgggaaataagcatgtaacatacaacattcctttgatcagtttcaatgtattttaaattgacgtctttgtcatcaagcttattt

SEQ ID NO: 130175 - DNA, 1048 bp, Homo sapiens
tgaaacagttgttatggaggcctgccacgctgatacattcacatcggtgtgttgatatttacagtaaggactgcagtggacaaaggaactgggcagcgtggtgaagccagaagagctcacccatgggtctgggcagcttctgcccagattagggggtgcagtgcagggaaggggattaggggggattagggggtgcagtgcagggaaggaatgaagaaagggagtcagttcttactctttctccaggctcctcagatgccacaatgctgggcaccttgcaggaagcacctgctgagatgtcattgcttagcaagggcagttggctgcaccagatgtattctggcttccttcccacttggtgctgaatcaggcatttcccagcaaagctgttccttgacagccagatagtagtgcatgaaaggcccactggtttgtttactcagttcttccagcagcagatatttatggaataacaacctgtgtgcagcactttgcaaattgctctgagaaataaagaaattggggaaaaggtgacaagggcactggtcttgggaaagttcctattatataccatactctcatgggtatgtgatggagaggttaaggtactgcagcattaaaaagacatgaatcattcataaatttactcaaataatcttattctttgcactttaattcctcaagagatgttaaataacccattggctactttttcttttggtgttcataaatggcaaatcgccagttggcttctaacctaaaatttcagaaaaggagccctttaatctttgctaattacagaaccagttgactccaatcttcctgtcacatgggaataacttggagtataagtttttaaaaaagaaaaaaagatgtggttggagggcttatgcttcctctgatctttgacttgtttcctatacattttttgaatatacttttattctttactcttctttcttcctgttttggaagaattattggagtaattttcaatgtatgcatctaccactctggaagatgcaggcacacaggcaaaaaaacaaaa

SEQ ID NO: 130176 - DNA, 1083 bp, Homo sapiens
tttctctaaaatggacaaattattaatttcaagacctttcctatgagttttattttggtaagtgttgctcatgatctgcttctcttctctcttagaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactggggtgagtatatttcacaagttcctcttctgttagtccaacatcctgtgacaaggatgtgatgaaattcctatgcagctacaatgacttcagtctttcttttcaagaggctccaagtaacctacaaaatacctctgatgaaaacctagaggaaagaaaattatgcattgctattatttttttttccagggatgactggaacatttgggtgcagggattttgttccatatcagccttctcctactttatattctgcgccaagtcagtgaaacttgataaggttgagctctaggcctgccatttgtttctctgacagggcccttgtgatggatttgaaggtcaagatgaccacatttggtgctgataaaaaagtataggaaagcacctcccctgactggagtctgtgaagatgggtgatggccatttttcatagactatatcagttcagttccggcttaaaaaaaaactttcaaagtaaagatatttctgacagttcaagaataggctattttgagaattccctttcctgtaaattataaatgggctgtaatactgtgggagaaggttttcatattctactgtttcttttttttgagatggagttttgctcttgttgcccaggctggagtgcaatggcatgatctcggctcacctcaacctccgcctcccaggttgaagtgattctcctgcctcagcctccctagtagttgggattataggcatgtgccaccatgcctggctaattttgtatttttagtagagacggggtttctccatgttggtcaggctggtttcgaactcccgacctcaggtgatctgcctgccttggcc

SEQ ID NO: 130177 - DNA, 1050 bp, Homo sapiens
gctaacttagtcttctaaattttgtgtttttgaaataattttgaatttacatgaaagctatagaaatagcacagggcaccagtgtaccctacatcctgattccccaattgttaacatttctgagaaattgagggtgtggtactctactgtccctaatacttcagtgtatgtttcctaagtacaagaacactctcctatataaccacaggacagccataagaatcaggcaattcacattgatctggtgctatcatctaaaccataggccccagtcaaattttgctgattatcccaataatgcccatgatgtccaagattcaatccaggatcacatgcgtttagtttttgtgccctttagtctccttcaacctaaatcagttactcatccttttttgtttctcatgaccttggtcttttaaaaaaggtacaagcaagtaactttgtatatccattaactttgaatatccattaactttgaatatccttcaatttggatttggtgatatttcctgatttatgcatgtttgcaggcacaccactgaaatgatgctatgctcagtacataggagcagagacatatagtgttaatttgccctatcactaataggcttttatcactgggataagatagtatttgccaggttccttcattctaaagttaataagtataatgtattattaatcaatgagtaattaaaaagaactttgtggggaaatattttgaggctatgtaaatacatttgacacctattatttgtggcagctatgttctataaagtcactgtgaacactggattagcctggactgaacttcactcctacggagggtacagggttgggttcctattacaacataatcgtcaaccagtcaatcaatacatgacctcgctttatgtatctttctgtttaaagactccttatttaatatatagggttgattcattatcattgaacttatggtcaattgcactgtaactcatgcctgaaggaagcttatctaacatgagtattttctccgtaaggcacatcatagtcttttgcactttagga

SEQ ID NO: 130178 - DNA, 1007 bp, Homo sapiens
atttatcataaaatacacattgtagaaggttagcaatgctagcagaactaactcattggtgctcaaaaatacttgaatgaaattcgaatcaggttgctgattataatattcagtataacactggtataattattgagtagatttctcatttatatcacagaaagagagaattccttcattttcttagtttgctcaacttcctactgctttacagttgattacaaaaagttttcttcaaaattttttcaccacaaacttctgctttactaatttgttctcactcacaaaagaaaagacgtaaatgctattcacattttccaattttttaggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagaggtaaagtatacctcttgaataaatacatgcatggcactttgatcagtgctactcatagtgtggtcccaggcccatgctgtctacccactgtctgtggccagataagtactaagattgagagtaagtgttgcaaaactcttagaaacttgacagagtaatttttttgcctgttgcatctaagaataatttaaaaattaaggttatattttgtatgttatttaaaaattaatttttaaataattcatcatttgtgtattttgcaaaagtattagtagatgacagactagaaataataatttaaaaaaatggtttttcctcacacacagtttgagaagcactgatttagatcataaagaaacagatgtctatatatgttatttactataattagagatgtctgatttttaaaatattaaaaatcaagtgcattgtgccatggagggtttatttcaggggaata

SEQ ID NO: 130179 - DNA, 1048 bp, Homo sapiens
gctcagtaaatagcacctctttccccaccttgagttctgagttaattgagaaatatgacaaagggagcacatggaggccaaaatatcacttttaaaaaccgatagaagtgaggttgcagaatgtagctcatatctttgtgcaagtggactttctaataaaagcagaaataaataggcttggccatctagccatgggcaatgctggacccaagcagtgtgcctgcctggggtctcccatgtggagtagggggtggcggtggtgtctcggtggtacttatgccaggaatgagcaggactaaagtttcactccctgcgtgcatacttactcccaagaggcaaaaaagaggagctgtgctgagcatgcccggtttattccaaattcatcagtcacattaatccccttcttccttcctgaggaggagcagtggcggcagagagaaggtaagaaaggagacattgagagtgggaatacacattgcctcctaagacttgtaacccattttaaaatgctgctttaattttgcttgtcttgtttacaatgtgtttacctctgtaaaccacaaaaaatcctttttggaagtagtgtctgtgcaaatcatgaataaataaaaaataatctccactgaaaactaacatgaggctgaatgatgattgagggatttgaggggttgattccaggacacacagatcacattgaatgatgtggcgccatgagtggaagaccacagagcatcagcttcttgttaggatgctcatgagttttgtgtgtgtttgagacagttaatttgtgccacagatatgtcttctgtacaacagtaatgattgaattttgatcagctgtgtggtggtcatttttggcctctaagacaaattcatctaccaggctgggaaacaaacccattttgggtctaactgcaaaacaaagggttttagtgcctcactgtggaaaagacagtgggtgcatattgatttattcagcccacccacaaataacagagatcagcctttttagtagcatttatggtagagttttcaaatagggttttat

SEQ ID NO: 130180 - DNA, 1001 bp, Homo sapiens
ccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactc

SEQ ID NO: 130181 - DNA, 1062 bp, Homo sapiens
ttacataaagtaacagaaagataaattgtggatgactatactatatctggtacactgtaattatgttcagaaaatagaaaaataattgatgtatgactatctaaaaaggaatacactatctaagtgtttcacttaactcagtttacctgctcccaatcaaactagcaagtggtacaattctgtgtttcacccagtgctttttatttatttttctctcccctcccctcatgcagtgctttttaaactaaagaatatattgcaactcaataaatacacatttacaaccccacatacacttctatttttttctcgatggctttattacttgaatgactagtaatgtaagttaaagattttttaattgcttctttttcttgcatatttatttgcattcctaaatttacttaacaaaaggttttcttatttacatagatcaatcttgagtgcaaagcctatagaatatacttgcaagaagacaatggctctgcagggttaaggtattagagcctaagtacctttcattgtttaaaacatgggctaagtgcttcgttttaacctaaatagagaccccttttagcacaaagagccaaagtgagtcatgggtccctgcctcatctttgcacgattacaatgaggcataaaactctgaaaacctttaaaggttttaaaagcttgctccctccacgcccccaaccccccatcatcacttcccaaatcatcagtgtcactcactgctaacctcatcgcagcaactgcaattattttaacacgtactaattaggtttattaggtcttggagtttgggccaggtctttcctaaaggggaagacaagtccagtctgtagattattaactagctgggtctatatgccataaagtccattctgacctttttattttttcatgagacattgatcaatgaatggattgataggaccacaaggaaacgtgaagcatttgtgtgtgcaatactttttcctctaaaagaatgattacctgacagattctattgaatgccaaaatctaacataaattttattcttaaacaggtgcagcttaata

SEQ ID NO: 130182 - DNA, 1025 bp, Homo sapiens
gggcgagagagcaagactccgtctcaaaaaaaaaaaaaaaaaaaaaaaccagtttgtgtttctttcttaaaagaaggaaaatataaagaaacatatgcctggcagctttgaaagaaagagaatattcttctcttaacaaggcattccaaggcctggatgtggctctgttaatacagagaagtaacaccttgaggaaacaaagcgtgctacttcacccccaaatcacagcggtaattaccttcccgatgttcatttgggtaaaaatcatccttcattagatttacgttttctgatgttggaatactaaattaggtagttgtcttcctaataagtcaccttgggtattacctgtgcattctctattcagatcagtggtctgggaataaaacgtaggagggagaaggggggaattcgggaagttagatagcgttggtggcaagatggaggagccacaggactgttctgaatgatgccaccaaaatgttggtttcataaaaaacaggctaataaatcctcttaacaagaatttaccaacactgaagttcagctttactatgctctgcaagacgactgcgttaatttcctgaggctgccgtaacaaagttctacaaagtgggtggtttaaaataacagaaatgtattctctcacagttccagaggccagaagtccaaaacgaaggtgttaacagggctgtactccctcaaaaggtgctagggaagaatgcttctttgcctctttcagcctctagcagctcccggcattccttggtttgtggctgcaggattctaatctctgcctccatcttcacatgactttctcctggtctgggtcctcctcttctttctcttataaacacttgtcattgggcttagggcgcagctggataatgcaggatgatctcatctccagatccctaacttgactacatctgcaaagacccccctctggcacccaaactggagtgcagtggtgccatcacagctcactgcagcctcaccctccccggctcaagtgatcctcccat

SEQ ID NO: 130183 - DNA, 1035 bp, Homo sapiens
cccgcctcggcctcccaaagtgctgggattacaggtgtgagccaccgcgcctggcctgatagctattagttttaaacagccaaagcctggcgtggtggctcacacctgtaatccctgcactttgggaggccaaggcaggcagatcacttgaggtcaggaattctagaccagcctggccatcatggtgaaaccctgtctctgccaaaaatacaaaaattagcccggcgtgttggcgcatgtctgtaatcccagctagtcagaaggctgaggcaggataatcgcttgaattcaggaggtggaggctgcagtgagctgagatcacaccacttcattccagcctgggcaacagagtgatactctgtgtcaataaattaataaataaataaatagccaaaataatagatgtctgtgaacctggttagttcttctggagtcatacattcaagcaccagttggtctgcagaaatgccaggctcttacacatttggatttctggtgcaattcatctgtcactttttgacatgtggtcaattttatgataattgaagtttaagaggaatttgtagaaaataggtctttgtacttaaggtgtaaggaaataacacacaaatgaattttcccagttccagaagcttttatcatcaaaatttctggttattttagatggaaatttttctatatgtgtgtctcataactgttttccaagagagaccaagtctctcttttagggagtttcatttcacatcctgaaaaaatatgcatactagtgggtacagtgtgttggacttccaggcaaaagaaggcagagtgctgtacctaccaactgcatgccaagaatgaatgccttcctccttgacagacatgactgcctttgtttcagtcccagtcagggaaggagtctctggaatcagcacctcacagattccctcttcatggtattctggcctgacagctttgtcctcttctatacggtgacttctgacagatgcaatccactttcacagcacatgactgagcatacccaagcctgggcac

SEQ ID NO: 130184 - DNA, 1072 bp, Homo sapiens
ttcaagaaattctcccatctcagcctcctgagaagctgggattaaaggtgcacgatagcatgcctgactaatttttgtatttttagtagagatggggtttcaccatgttggccaggctggtctcgaactcctgacctcaggtgatccacctgccttggcctcccaaagtgctgggattacaggtgtgaaccactgcgcccagcctgcaatctgcttttttacaaactggacctccagataatctagccattgaagaaccactgttctaacatccagtgcttctcaaaactagccagaaggacacatcagtggagtcctttcggattaaggctactgatgatgaccaggagtgctctatggccttaaaacccaaggttcgtccataaggatgagcaacagtgaaatttaccccttagtttaattggttgtccagctcgtggaagttgactttttcttgtgttctgtatttctgttctctgcagaggttcacagcctccagcatactccgcacacacatcaggcagcactccggggagaagcccttcaaatgcaagtactgtggtaaatcttttgcatcccatgctgcccatgacagccatgtccggcgttcacacaaggaggatgatggctgctcatgcagcatctgtgggaaaatcttctcagatcaagaaacattctactcccacatgaagtttcatgaagactactagccctgccaggcacaatgactcacgcctgtaatcccagcactttgggaggcagaggtgggtggatcactcaagtccaggagttcgagaccagcctgggcaacatggtgaaatcctgtctctaccaaaaaaatacaaaaatcagctgggggtggtggcacatgcctgtggttccagccactcaggaggtcgaggtggcaggatggtttgagcacaggagacggaggttgctgtgagctgagatcgccccactgcttttcaacctgggtgacagaaccagaccctgtctcaaaacaaaacaaaacaaaaaaaatgagtagccctcaagagtgtggagacaatgtaaaaacaagagattcggattc

SEQ ID NO: 130185 - DNA, 1216 bp, Homo sapiens
gctggagaattgcttgagtccaggaagtggaggttgcagtgagccaagattgcaccactgcacactccagcctgggtgacagagtgagacactgtctcaaaaaaaaaaggagggggtggggaggcgtggtggctcaagcccgtaatcccagcactttgggaggctgaggtgggcaggtgcctggagatagggagttcgagaccatcctggccagcatggtgaaaccccatctctactaaaaatacaaaaattagctgggcatggtggcacgttcctgtaatcccagctacttgggaggctgaggcaggagaatcacttgaacccagaggcagaggttgcagtgagtcaagattgtgccactgcactccagcctgagtggcaaagtgaaactccgtctccaaaaaaaaaaaaaaaaaaaaatcactatttcatagtatttaagaacacaaacatggccaagtttcaaatcctgcctctggtgcttacctagctgtgccaccctgagcaagtccatgaactcctgttagtttccacattgataaactggggagaatagtctttaccaagttgttggataacatcagtaaagtatataaaactcttgtaacagtgcctggcataacataaaagtactactggaatgttaactgctattattactactttaatctgtgaaggatgctactgatgtaattttctataggagcattgcagaagcggcatctagtctatgttacacagaatacagagttgtaaaaacagagatgaatcatgtggttagaggttgctataatagaaacaataggttgaccacgctttagacatattacaccaaaatagctctatgctacccaatgtgcagttcgcggttaatcatatgtggctatttcaattagtaaagacgaagtaaagttgaaaaattccgttccctaggttgcattagccacattttaagtgctcaatggctccatgtggccattgatttccaagatggacagcgtgggtaatgaatattcccattattgcagcaagtcctgttggaaagcactggtatagattatgttttcagtcactgagtcatttacgctttttacagtaaagccgtaaaaggagtagaggctgtcctacagctacttctaagcctctcaaaaggaataaaacattgagtctaccagattagagcaactaatacctccaaagtgtgtgtcaatagaat

SEQ ID NO: 130186 - DNA, 1084 bp, Homo sapiens
aaattctcttgaccaggcacagtggctcacgcatgtaatcctagcactttgggaggccaagaggggctgatcacctgaggtcaggagttctagaccagcctggccaacatgatgaaaccctgtttctactaaaaatacaaaaattagccaggcgtggtagtgggcacctgtaatcccagctacttgggaggctgaggcaggagaatcgcttgaacctgggaggcagaggttgcagtgagccaagatcgtgccactgcactacagactgggcaatacagcaagattctgtctcaaaaaaagaaaattcctcttgaagtagccaaagaattcttggctaaaaataaataaataaataaatatcctcttgaaggaactagggagggaagtaactgaagagacattgtgtttgctgtgtttgacagagtctgcagaaggctacagatgtgaaagatgtgggaaggtatttacctacaaatattacagagataagcacctcaagtacaccccctgtgtggacaagggcgataggaaatttccctgttctctctgcaaacgatcctttgagaagcgggaccggcttcggatccacattcttcatgttcatgagaagcaccggcctcacaaggtgagtattaggaggacacatgacccaccatcacgttctctctcccttcccaagctcctgaacacggggagttgccttgtaggtgctagctgcagggctgtgatgcctgacggacaccctctctgaaggaggagaggatagtattacggaacaggcaggcgtgaataggcacagcgatgcacatgtgttaggatgcaggtacccacagagggaggaacatggaggaaggagtgtccacggccacctggacacgtggattatgaaagatgcacagaggtggccttgagccaagtatagaaggacaaatggggtgtctgatttatactggtggcagggttagttgggcaggaaagagtcgagctgttccagacaggagagagcctggcatgtgctcctggggaactgcgccttgttccaaatctgtgcaggtgtgttgacaggtataggtaagaaggaagt

SEQ ID NO: 130187 - DNA, 1023 bp, Homo sapiens
tataggaatttgggaagcaagaaagtgataaaagtaagaatcttttagaatatgtcacattaggcaggctcagtggcttacacctgtaattctagcactttaggaggccaaggtgggaggatcacttgaacccaggagtttgaggccagcctaggaaagagtgaggccctgtctctacaaaaaatttttttaaaaaaatttgccaggcgtgatggtgcatgcctttagttccagctactcagggggctaaggtgggaggatcatttgagcccaggaattcgaggctactgtgacctgtgattgagccactgcactccagtctgggcaacagagtgagactctgtctctgaaaaaaacaaacaaacccaatatgtgacattacctagagaggtgtccttaaactaacaaatctatgttggcataagtaaatttataaactacttgtaatgacataaaaatcagaatgatagaagtgtatttggtggactcaagtgtgatatttaggttacaagtattaaaaaatttattttatagattagaccaaaaaagaagtacaatacaaacttcatgtcttatttcatttagatctttgaagatggtcatttgagccactttatagatggaaaaggaggtacggggaactggatgtcctatgtcaactgtgcccgcttccccaaggagcagaacctagttgctgtgcagtgtcaagggcatatattttatgagagctgcaaagagatccatcagaaccaagagctccttgtgtggtatggagactgctatgagaaatttctggatattcctgtgagccttcaggtcacagagccggggaagcagccatctgggccctctgaaggtgagtgcacaccctcgccttgcccaatgagggcatcccagtagaaggactgggctcttttccacaaaccctccatgcacagctcctccctcctaaaggctaatgcagaggactaaccgagagtgtctctaaccaggggggaattacccaggtgaaggaaagcatcc

SEQ ID NO: 130188 - DNA, 2003 bp, Homo sapiens
aacgccatcctttcccggcggtgcgggggcgggaggactggcagtcgccgaggctcttcgctcccacctggccagggctcgtccacgcggctcccgaggggctaccccaggccccaatagtcctggtagaatgattggagtttccgaggaacccggggaatgtggcggacgctgcccgcgagggaaaagaggttcaggcggcgcatcctagggcagccaaaagtggcgcgcccctcccctgcgggcagtcaggaccgccaggacccgcggggtcacaccgctgggccagagcaggtcgcggggtccctggacctgcccgggggctctgggagcgcgtctccatctgcgcggtgcgacccagggtcctcggctcttccctcccagccgagggcccaggagcgcctggagctgtcgcttgctccattgccctccgaccgcctgcgctcggctcccggcccagccccgaggttggcagggccccgcggctcccacagaccctaccaacgagttttgtaggactgagaagaaggaaggaaagggaacttcaatgggttttgcaggaaccgggttgggggccgaaagcggagagcgggtgtgggaaggcggccgggcttagggaaggggtgcttggagagggaaggggaaggcaacactaacccggaatttagagtagggcaggatcccggcagatttccgtttggggcttttttgtgtttgcttctattgctgttttttcgttttgtcttaattgtgggagcgggctggcgggatcggactgggggcgtttatcctgttcccttggatctggggctggctggggtggaggaggctggtggggaggcgcgggtcggaccccgggaagctcccgcgcggtgtcctcagcggcgcccgcttttctgcagagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccaccgtggtacccaattccccacgtccccagggaagtgccgcccttcctgagcagcagccacgagtacgcgggtgccagcagtgaagatctgggccaccaaatcattggtggcgacaacgagagtggcccgtgttgtggacctgacactttaattccaccgccccctgcggatgcttctctgttacctgaggggctgaggacctcccagttattaccttgctcacccagcaagcagtcagaggatggtcccaaaccctccaaccaagaagggaagtcccctgctcggttccagttcacggaggaggacctgcacttcgttctgtacggggtcactcccagcctggagcacccagccagcctgcaccatgcgatttcaggcctcctggtccccccagacagctctggtaaagggagttcacaccatttgggagtcgaattggacgggaatgcaggcgggaacgggagtgtccgggaagaggcgcttccaggtggagctgaggctgcagagtgcgggaagggggaagtacctccatgagagccagggctgttctaggctcacttctgaggccctgcttgcttaactgcatgactaaggttggttttagtgagagctgaggaccaagagagaaatggttcctgcagcgaactcccaggtaggttcagattctatgctaacatgcaatgacagccttcagcagttcacacctaacagtcccagctcagctagctacgctgaccttagtcaggcattacctctgatcctcaaattccttgaatttgc

SEQ ID NO: 130189 - DNA, 2290 bp, Homo sapiens
tcatccatttgcagacgatggcctgcgagaaatagcatgtaggattcgctgggctcctccttggctcctggaagcgttgtgtggagggaggaatggcgccctctgcctgttcacctccacatcgaatgtactcatccagatgcggcctctgtgatttgctttattgaaaacagtcaggaattttgatgtttttgtggtgggctttatgatgtttttttcaaaacctcaaagatgtttcacaactttttatctgttttcctacagaaatattgctgacactgctgaagccagttgcttcttcagctgaccgggctcacttgctcaaaacacttccagtctggagagctgtgtctatttgtttcaacccaactgacctgccagccggttctgctagagcagacaggcctggccctggttcccagggtggcgtccactcggctgtggcaggaggagctgcctcttctcttgacagtctgaagctcgcatccagacagtcgctcagtctgttcactgcattcaccttagtgcaacttagatctctcctgcaaaagtaaatgttgacaggcaaatttcatacccatgtcagattgaatgtatttaaatgtatgtatttaaggagaaccatgctcttgttctgttcctgttcggttccagacactggtttcttgctttgttttccctggctaacagtctagtgcaaaagattaagattttatctgggggaaagaaaagaattttttaaaaaattaaactaaagatgttttaagctaaagcctgaatttgggatggaagcaggacagacaccgtggacagcgctgtatttacagacacacccagtgcgtgaagaccaacaaagtcacagtcgtatctctagaaagctctaaagaccatgttggaaagagtctccagttactgaacagatgaaaaggagcctgtgagagggctgttaacattagcaaatattttttccttgttttttctttgttaaaaccaaactggttcacctgaatcatgaattgagaagaaataattttcatttctaaattaagtcccttttagtttgatcagacagcttgaatcagcatctcttcttccctgtcagcctgactcttcccttcccctctctcattccccatactccctattttcattccttttttaaaaaataatataagctacagaaaccaggtaagccctttatttccttaaatgttttgccagccacttaccaattgctaagtattgaatttcagaaaaaaaaaatgcatttactggcaaggagaagagcaaagttaaggcttgataccaatcgagctaaggatacctgctttggaagcatgtttattctgttccccagcaactctggcctccaaaatgggagaaaacgccagtgtgtttaaattgatagcagatatcacgacagatttaacctctgccatgtgttttttattttgttttttagcagtgctgactaagccgaagttttgtaaggtacataaaatccaatttatatgtaaacaagcaataatttaagttgagaacttatgtgttttaattgtataatttttgtgaggtatacatattgtggaattgactcaaaaatgaggtacttcagtattaaattagatatcttcatagcaatgtctcctaaaggtgttttgtaaaggatatcaatgccttgattagacctaatttgtagacttaagactttttattttctaaaccttgtgattctgcttataagtcatttatctaatctatatgatatgcagccgctgtaggaaccaattcttgatttttatatgtttatattctttcttaatgaaccttagaaagactacatgttactaagcaggccacttttatggttgtttttcttgcccactctggtaggggaaaaatcttttattaataggtgtcagtttcagacaactccaataccaagaaactgatgaccttttttgagctatttctccttaacccctaatacctttcttacctaaatttcagaatgatatctttttgatgtctaaaaagcaaagcattttataatatctcattagccaggctttttaggaacagagaagtttttccttgaaatttgattgtttgtttatttgtggcagggtgaaaaatgtacaaactacccctatttatacttatatctctctctatatgtacgcattatggaaatataggaagagatatagcccaaagatagatggtaagtagacagtctgaaaatgttgctccatactaaagaacctttctggaaatttgcatttcgcta

SEQ ID NO: 130190 - DNA, 1026 bp, Homo sapiens
ccaatgtgaacttgactctgaggcctggagtaccaacacaggtaaggcaacataccagccattagctttcattgtatgcatgcagctgcttttgtcatttcttcctctctgaagaaagttaacttagtagacgtggatccagatcagcacactagccctgtactgtcatctagttacctactagtgtgttatatttttcccttctaatcactgccatttttattgccaggtacagtcaattcttgttattctaagaagttgtgctacataaagttactgcaaacactgaattagagaacagccaactatcgttcctaggaggaatacagggttgggttcctgcagacctctggtcacaacattgtcatcatccagtcaacacataaccttgttttatgtgtgtttctgtttaaagaactcactgtaactcaggcctgaatggcgcttatctagcacacctgttttctccagaaggcacatcaccgcctcttgcacttaggaacactagagagcactgcagcaccatgcctgggagccagtttaagcagcaaaatcaccaacaggaaaagcaaaaaatgcaaaaatcttggcaccaaatagatcacagaggacactagtttacagtatgagagctgaaaccagaaggcaaagtgttgccttgttcaacctctgctggaagtgtgcacattgcatatctgaaatgttttaccactgtgctcatgtctacgaatgactgtgacagtggcatgtgtattgatttgggggttacaaataaattttactgagtaggcaacttcagaaatgtggaattcataaatgaggatcaacgatatcttagcagcctcatgcctctcactgacagcaagcactgggatcccttcccttcatccatcctgcctttcctccctctccaccctccacctctgactcggtctctgtgcgttcttatcaggcactctcctcgctctccccttttcctcctgcctctgctcagccttttgtgaagtgcaccacgtcaccttttgt

SEQ ID NO: 130191 - DNA, 1068 bp, Homo sapiens
tggaccaaagtcatagtctattcataattaattggaaatatatattcttataattaattgaatgataagcataaaataaaggagaatttataaattgccaataaatcacaatgctggaagagagctttctttcttattcagccatctctttttatagatgaggaaattgaggaccaagagattaaattatttgtcctttgttaacctaattttttaaaagatgatcaattatctgttaggcctgtggtatgcaggaatctacctattttatttggctgtggtgccttatggcagttaggtcagtgattgcaaatgggcttgtggtgtctactcttagagtagactggataaactcttctgtttgtcaactacagcctggcagtgagctggacaacttggaggagattttggatgatttgcagaatagtcaattaccacagcttttcccagacacgaggccaggcgcccctgctggatcagttgacaagcaagccatcatcaatgacctcatgcaactcacagctgaaaacagccctgtcacacctgttggagcccagaaaacagcactgcgaatttcacagagcagtgagtatgagaaatggctggttatgccaagaaatttccatataatcactatcagaaacagggattattgaagtctgatgcaaccagcttagtcactttaaggtttttgtgatcaaatagcaccatctactgtcctggtcttttgaaacagtattcaaaatggatcctcctgagcatggttctctcacattctcttgtgggttaatttaatcagcactggacagggagactgacctacattgatgaagttcttcaactgattgtcatatttcccttcatttcagtgactgccttcagacatggagtttatcctggattttatgtgtttaatagacaatgaaatactgaaatatataacatttgggagctatgctgactttttagggataatacactatttaaaaatattctaccctcccaaactgctcagctggtagtaacaaaaaataaatttaaaaaaaaataataaaatattctactaaa

SEQ ID NO: 130192 - DNA, 1002 bp, Homo sapiens
tgaccctcagtagcaatataaattttcccataaatggcccaaaggaacaaatgggcatgcccatgggcaggtttggtggttctgggggaatgaaccatgtgtcaggcatgcaagcaaccactcctcagggtagtaactatgcactcaaaatgaacagcccctcacaaagcagccctggcatgaatccaggacagcccacctccatgctttcaccaaggcatcgcatgagccctggagtggctggcagccctcgaatcccacccagtcagttttcccctgcaggaagcttgcattcccctgtgggagtttgcagcagcacaggaaatagccatagttataccaacagctccctcaatgcacttcaggccctcagcgaggggcacggggtctcattagggtcatcgttggcttcaccagacctaaaaatgggcaatttgcaaaactccccagttaatatgaatcctcccccactcagcaagatgggaagcttggactcaaaagactgttttggactatatggggagccctctgaaggtacaactggacaagcagagagcagctgccatcctggagagcaaaaggaaacaaatgaccccaacctgcccccggccgtgagcagtgagagagctgacgggcagagcagactgcatgacagcaaagggcagaccaaactcctgcagctgctgaccaccaaatctgatcagatggagccctcgcccttagccagctctttgtcggatacaaacaaagactccacaggtagcttgcctggttctgggtctacacatggaacctcgctcaaggagaagcataaaattttgcacagactcttgcaggacagcagttcccctgtggacttggccaagttaacagcagaagccacaggcaaagacctgagccaggagtccagcagcacagctcctggatcagaagtgactattaaacaagagccggtgagccccaagaagaaagagaatgcactacttcgctatttgctagata

SEQ ID NO: 130193 - DNA, 1063 bp, Homo sapiens
aaaccaattccagtgttgctaagatttgcacttttattgtttcagttttgtttagcctttttttctctgaatagattcttctgattgtttatcttttacttcctgttgtcctaaccacataaataatacttcttacacagtgagaaacaggactgggggagagtagtgtgtgagatgatggattgaacagtacgtaatttctagatgaatattcagagaacatattaaatgtcataaattttattttcatatttgtattagttttacaaggaaattaaagtcatattgtatacgtaagagataccctgtttatacattgtgttgttttctaccattttaagcaaatcattataaagcttgtttgagcagttaaatggtttacactgttttgccataataataaagattttaagaacacagtttgagggtccaggctcttactccttttcataaggaaaacagataattgaggttattggtattttcagtgaaaagtaaatgtgcttttaaaatgttatgtttcaatctcataaagtattacttataactctttacatgctggtgggaaactattatgaaacttaatgaagttgattactcttattatgtcttgtcctccccgacccctcaatttttttttctaaacgtgccttctgtttccttgcttgcctgcagtactgagacaaggattggcattcagtcaaatctatcgtttttccttgtctgatggcactcttgttgctgcacaaacgaagagcaaactcatccgttctcagactactaatgaacctcaacttgtaatatctttacatatgcttcacaggtaatcctagttctaagaagtcattttccatttccaagttaagaggagatattacaaaagcagcaaattattttagagctttgaggatttgttagacatttcttctcatcaatcccagtaatgtaaaatataaaattaaattgttattagctgttggctaaaagacaattcataatataattggccctctgtatccatggcttctgcatcccaggagtcaaccaaccacagatggaaaat

SEQ ID NO: 130194 - DNA, 1268 bp, Homo sapiens
ttttaaatggaaagggctgtgcagagtactctgcatgttacaaagataaataaaacttttccctttcctccagaaatgaaccctgacgcataagacagttgaagcaaggtgaggattaagtgattagaattggctgtgtgagaaaccgtccacagccaagattctgaactataatgcagctgttctggtgcacgctgcattttctaggtattgtgggagtcgttctctgaatctgcgtctagacccagtttatattctttgctttaaattgcatgttgccattgtagtatttacttagtttggcataaggtgtacctagttttcctgaaccctaaaactcaagaagcaaacccttgacaaaacaagagtatcatattttagtttcatcatttttgtacttcattacaaattaacctggttttctatcagccatttaaaaagaaaggatttcatttttttttctactgctggagagagggtttcagattattaacgttttagtgtagtcgatgtatttccatcacatgtatcgcggggacttggcagtttatcctttgctccccagctctccttacacagccaccctccgtctcccttacccacctaccactttcatgaagagaataaaaccagtaggaagctcaggtacatagtgtttcatcactgtctcccttactgcttttttaatgacaggctgtgctgtcataaatacacttgggtttgtttgaatcactagaaaagcccaatatgataaatgtaaacatgtgtggtttaagatttgcagtcctgcttgatttgcgtggcaagaagagttcccatgaaggaaagaccagttcttccctcatcagaaagttttactactcgccaggatctccaaggtaaatttcctctccaaagaagaccaaaggaatcattttagaatacttacatatttgggaatgcaaggactctatttagaagactgtaaggatgctagtactagcaattgctgctgcagtagaaatgtcaaggagttggaggaccggagagagagccactggctctcactgtatacccttttgttccatgtacttatgttacctagtttaaataaatacatttaaatcttgttaaaatttaattgtttctggctgggcacggtggctcacacctgtaaccccaacactttgggtggctgaggcaggaggatcacttgaggtcaggagttcaaagccagcctggccaacatggcaaaacctcatctgtattaaaaatacaaaaattagcca

SEQ ID NO: 130195 - DNA, 1048 bp, Homo sapiens
gagatgaatgaggagagaactagccagatggaaacctggataacttcaaaaaggaagaagatcccataaaagagattgaaaaagaataattatgtaagaggaggacctatagattgttgtgtcatgaaagccacaaaatggagaggttaaaggaggaaccacggaaggggtgtgatttttaactgtggtaaacacagcagaaagtttggtaacaacatacagtatgcccaaattgctgtaggttggcatttgaatgtcatggaagactagggagggcagatttaatggggtaatatgggaagagatacaatatctttgggtcatagagtgagtggaagggaataggagaataatctacatgcctgtattcccttatttgaatctcaaaattcagcacactgaaaatggaaaggtgttttgtaattcatttggcagtaaaacctgacctgaatggatgtgagatgatttataatcatttgtttcatttagtgtgaatattcatacatttcactgcagaaataatactgaatttgattatagaatgcttctgtagacccttctggggttataatgaaatatggtatatgacacgtattatctttttttttttaaacggagtctcactctgtcacccaggctggagtgtagtggtgcgatctcagctcactgcaacctccgcctcctgggttcaagcgattctcctgcctcagcctcctgagtagcttgggagtacaggcggacaccaccatgcccagctaatttttgtatttttagtagagatgggatttcaccatgttggccaggatggtcttgatctcttgaccttgtgatctgcccgccttggcctcccaaagtgctgggattacaggcatgagctaccgcgcctggccgacatgtattatctttctagaatgaaatatatatatatgtatatctacgcacgtgtgtgtgtgtgtgtgtgtgtaaattctaaatcatatggtccccagtgtttggggataaaggaatcccagacctttgtattctttagacaggtctggatgtgaag

SEQ ID NO: 130196 - DNA, 1042 bp, Homo sapiens
cagaaaaggctattatctcaatgaaaaggaaaccgggttttagagcaagcaatagaatagaagcaggaagaattttcgagtgttccaccatgctggattgtcaaagggggatctgtctgatcagcagctaaaaaaggatttgtgtggctagtttgtcagctatcgttagaaacaaatgatagaggagataagcggcggggtgctcagcatgtgcttaggtttacatcaagatgtaatgttggtttgggttaacagaggagatttatctctgaggcaataaatttattgctaattgtgggggtttttgttttgatgagtgatgtatggtatttgtatttacatcactggtgaagataaagagaagctgctgagctctaatatgaactgcagaagctgtggacagttacaaggtgtgtttcagaagtgctctgacttaatatttggtaatgttcttggaattctgtgtgcttgtggattggatgtgcggtgcgttgtagaagggagaactgagcgtgacaaccaggcagtgataatgttctcaggaacacatagatacagtgtgacccaaattgattccgtggtccttatttcttttgtgtttgtgtagtgtttttaaaatattccttgtagtttctttatgtagccaaatacagtgtcacgcttgtttgtaggaaatattttggtaagcattttctaaaattcaggaggagaatcttaattttttagatgcaaatcttaattattaaggaataaatataactataagctttatctttctacctttatactttttatccttttctaatttcaagcttaaaggggagctttgtgataaatttgaaattatttaatttttgattacatgataagtacagcttttatttttggtggaggccttgattcagtgatttttttgttgttgttatatatagtacctaactttctcagattgatcttatgctactgtatgcagagagctaaataacatacagttaatcttcagactgtacttgtctgcttttgctcatgttaatgctattaa

SEQ ID NO: 130197 - DNA, 1038 bp, Homo sapiens
tcttctttccattagcagaggttctactggatcttctttgtgtgtgattcatcgttatgcctaatctgcccccgactctcaccttggtgctggggtggcaagcatgcttcaatctctggtgccagttcctattgattatagtgattgtgtggagtgctgtgttgaggagaattgagaggccacatacaggcttaaaagtgatttaattggcaatgtctgctgtgtgaggggagaggaggtaaccacagcatatgtgttgtgtatgtgccgaacgtgatagattccacgatagggctcacccttgagagattcaaagtcacattttgtgtctgtgtatttttgtctttgaattggtatgtacatattactgtattacacagtaaaatataaataaactgggaattatcggttagcttgggttatatagaattacctatgtatgcttttcatggcttgcttaaagcgtggatctaaattattattctttcatttctgaaataaaattacctatacttttctacactttttgtgagtttctcttgtttagttgatacatgattctgatctcctgttttttaagtttggcaaaaaatacttttaaattcttgggtaatttcacttaccaaactactgacaaattaacatgagttgcttgaaaccttgggcacacaacaggtggttgtgacagactcgggggttccaatcattgtagaacagaccagagatctctttccttaaggaatggtcatgtgtctgttgccacttggcttctctccttatgggtcagaggtaatcctcagtttaaccattgaggtataaaagtattttttaaattttattttgttttccttcttgtgaatcaaagtctttcctaatttggcagctgacaaagaatactctttcattgagttagaatgttgaaagtataagcaaaaatttgagaggcactttttacatttgctaagtaaagaaatatttatattagacttttcaaaaaagtatgataaaatatacataaaattgacccttttaaccatt

SEQ ID NO: 130198 - DNA, 1067 bp, Homo sapiens
cagtgatctgtctgcataaaaatgccaggccaagtcaaagaatactgcacacagtatgagtttggttggaacgtgcaccatacagctaggggaatatttgatggacagagctagggaactgggtagattgcagaggcccctgaatgccaggtcactgttttgatttcacagagagtaagaaaaagagaagtgacatttattgagttcctactatatgttaagaactatgttagatggttaatataatcatgtttaatcctcaaatcagtactgtacagtaatttctatctccatgttacacatgagggaattgtaacctaataacttggtgctaattataggatagattgagtaagggagagacctggcatgagaagaagttattggtggtggggttactgaagagaaagaaatcttgataattgtagagggattggaaagaaggtgatgtgatgaagagaaactgcaaaagtagaatctaaaggtcttggaaattgattggatttgaagattgagagaaaaaaggagttaaaaatatttgctggtgacttatgaaaagtagcagatacagatttcctatctcccctctcctggggaaaaaaaaatagcagataaagaaaaacttcctcagaaaggtgaggagttcaattttgggtacatttagggagatacgtttatgagagcttgaaagttgggcacggtagtagctaaggtgatatcctgaagctacaaatgaaaattgggtctcatttacatgaatatgatctttgatactgcatcagcagacaagatttcaaggagcagctttgtagtgagaagaaagggcaaggatgttattcaagaaatgcccattgggcattacaggtggttcacacctgtaatcccagcactttgggaggccgaggctggcggatcacttgagctcatgagttaaagaccagcctgggcaacatgatgaaatcctatctgtacaaaaaatataaaaaattagccgagcatggtggtgtgcctctgatcccagctactggggagactgaggtgggagggtcacttgagcctagaaggcg

SEQ ID NO: 130199 - DNA, 1017 bp, Homo sapiens
cccaggctggagtgcagtggtgagatcactgctcactgcagcctcgacctccctggctcaagtgattctcccaccgcagcctccccagtagctgggactacaggcatgcgccaggataaaatttaaaaatgagcctggctaatttttaacagttgaggtctatgttgcccaagctggtaattttttaaataaatgaaacatttttactggttgccgttagtcaattaaagtagtatgtgttgaatctggcaaaattcataattaggtttcagtaaatgtgtgttatatgtatttttaaaatctctgataacctaaagtatccttaagctaccagatggaaaatttaagtttcaacataggcacatctatgaatttttcttactgttgatgaatttaggttgacttgccttaagtcggaatgcaaacatgtatattttgtatattgattgaagttgttagtttgtcttagtgaaaaattggaagtgctccttaatgaaaattaacatttaagttgaagccacaactttgttccatattttttcttcctgtatttattagcttagtgctaccatcattgttttgactatactaagcactagaaagatgccagtgtgtgtgctgtagaaaaaagtttgcactcccatgactgtggatcccgactgacattcttttttctttttttaatttaaattaaattttttttagagatagagtctcaccgtgttgcccaggctggtcttgaactcctggtccttatcccagatttgaacccctgaactcttagcctcccaaagcagtgggattataggtgtgagccactgcacctaggccctccatcactattcttttatggcaagtatgcttgcagttgtcacaagaaggtcctgcccacgtttgctttagaatatgtgaattcaacttgaaatattatgctgctattaaaaattatattgtcaaaggctgaaccaacaaggaaaaatacttccatggtactggtaggtagaaatggtaggattt

SEQ ID NO: 130200 - DNA, 1066 bp, Homo sapiens
tttacatctttaaagagaatttttatttaggaaattaacattcagcctaatgttatatctaacatggtgtccttttgtacaattgtatcaaataaagaatagaaactatattatggtttctagtgatgccctaaccactagtgtttcatttttctggtgttccctcttacgtgcacaccccttgctcccctttgggttgacttataatctgacttttgtgacagatgttaggaggtggagcaaaggaatttcagaccaatcagttaagagactgctgtggggtaagaaaaaaaaattagcctcttaaaattactcttatcaaaggaaaaaaagttggaagcacatgatagtataaccagaaacatgacacagaagaattaagggaagagtagaggagacacgtagataagttagatagttactgctgagaaggttttttaggtgggggtaggggtttcatgttgaagcctgtgctttgctttgagtgaatctggcttaatttctgtaaacatccctccttctaggatgaatcaatgcattttagccatgtctatacctgtagcagaatactggtgatgaaagtttacaggcagtttaaaaaaagaagaagaaaaagtgaaaaaccttgatgtttcaaggatcccacagtttctgccaagtttgaacacattccaaaatcctaaaaaagtgtgtacttttgaagctttatttttcaagtgtttgtatgtacatttctgtaagttggaaatcagtcaacaataaatacgtactttaaaatatttcttttactttggtaattacacatgtgtgaagaattcctacaatttttcaatctctttattcaatttactgggatatctgtacagtttttcctatggaaagtaatttcagtggagagatttagctaggaacttcattaggcagcctgtgtgattcaggagcaaaggaatagcctgttagtttaatgtgtagaaggttgtgtttgcaaacatgtgggttgagggcaagtatgtaggcacaagctgtcagaagcaaatgatggatctggtggctctggtttgctaag

SEQ ID NO: 130201 - DNA, 1620 bp, Homo sapiens
tagaggagggcaatactggaggctgaggcgggtttagcctgtggaagtgatccagatgagatgtgaactgaggggtagtggcagaggggatgaagataagcggattctaggaagtgactgacttctaagggaaggaggagtcaccccaggtcttacaaaagacctggtttggtctcctgtggatatccaggctccctatgatccacatcatcccattaccataaactagttagtagactttctatattgatggaacgtgaatatgagaatgttcatagcagcattagtcataatagtcccaaaataaaaacagtccaaacatccatcagctgatgaatggataagtaaaacttgctatatacttcagtggaatattatttggcaataaaaagaagtgaaatactgatacatgctacaaaatggatgagccctgaaagcattaaatttagtgaaagaagccagtcataaaggccatatattgtatgattccatttatatgaaatgtccagaataggcaatgctgtagagatagaaggtagattaatggttgcctagggctgggattggagagtgggagaaaatgggagtgagtgctaatggatatagggtttctttttatagtgttaataatgttctaaaattgattgtggtattggttgcacaactctgaatatactaaaaactattgtacattttatttaaattgatgaattgtatggcatgtaaattatatatcattaaagctattataaagatatgaatatgggagtaaagtctagaaaacagaaaactggctggtagaatcaggcatatggaatacatcaaaaacgacagtggggaaatagcaaaaaactggaaaaaatttaaatgtctaacagaaggatggataaattgtagtgtattcattttttaaaaaatgacagtgagtaccctgataattaagaaattcacataaaagtatgaatagtgtataaacgtgacctaaaaatagcatttgtgggaacatttagtttagaagtaatttttttttactcaactgtctggcccttaatactgctattaacattaccaaagaacaccatttaggaaggtaaagaaaccatgtactttagcaaagattttattttaaaatgtagggattttatttttaaaaaagtttcaggattagtttcatttaaccgaaagatatagctacatctttagaacatctttacagaagaaccagtaaatattttctcatctgaattgtgagtttcttaaggttagggtaaatagagaaaagaagagattattacttggaaaaacagaaaaggcaagagatagtagtaatgtatagtaaagtttcagaaggaaattggacagttaaggatcactcaagctttagtgacttctgtcatttgtgctttattgcagaaatgttatacagaccatttttgggcatttgtctcattttgtttttgcgtaatcactgaagcaattaggaaaaaaaacaaaaacgcctgctttagatgaagaacccgagggaaaaaaaattaaagagcttgcccatggttgggactggggaatgaaggataaaacacaaggtggagaaatctaggttctgcttaaatggggtcttag

SEQ ID NO: 130202 - DNA, 1065 bp, Homo sapiens
agcttccatagccaggatgcagatgtgtacaccacatcttcccagccctctgccttcccctgcagatgcccattatctcgtgtgacatgctctccacagagctcacactggcctcccattcttaagatcgtgtatgagtgggaagccctcaacgatgttatgcaaagtcattcttttggaaaaagagcctggaagtaaggggtagaatggatttctatgaggcataactaactagtaggaaaaagccccaaagctgcttggtgtagatcctatgcttgactccaattttctgattattcttggtcatatcgttctttctactgtactataccagtcactgaggacacagatgatgtctcaatttcagtatcttctcctgtcaccaagaaatctagtttagattaacactcaattttgtaacatttcatgaacactatattcagaaaaactggttctatcctatttactccacccatagggaagtagttggtatattgtgtatgggtcagtatttctatatcttacatgaaatttggaagaattctatacaaccaaacctgacccttcaatttcagcaaattgatttctgagaaaacagatgaattttgatttatcttacgtctctaaggatgaaagcaacagaattgcgatcgcccctcagttggtccaattctgtgctgtcttttatcattttccccattataggttgaaagcttcagatgtcacaatttcccagggtcttaggattctaccctggctctggcagcctaccttcattgttttacccaccaaaggaaatggtagaaactcagctctgaggcaaggggttatggcttctactaaggtatccctaagaatagggcatatgctttgtctgagctttaaactatataaatggtgatgcagaatggcagatgcttgaaaggtaggtatagtctcttaatgcctaaggtagactaacacaagaagatagattcttgatgtgtgtagtcatggactccttggctgcaagtgtagaaatgcaactcaaaccagtataagcaaacctggaacttattacctttt

SEQ ID NO: 130203 - DNA, 1040 bp, Homo sapiens
gccatcaggatttttcatttatagaaggaattaagtctgacctttaagaattattgaaagtaaaattttagggattatacagctgtttctgattcacatctattttacaagtgcaatttgcagagattctactgataatactaataacaactattacttattgctcttttactgtatgctaggcattatgtaagtgccttttggttgtcttcaaaataacagataaggaagttgaagctcagagaggttaaatgacttttccaaggtcatatcaagtaagaggcagtttgccactccaaagaccttgaccttaaccactgagctccattttctgcctaaatacccctagtacaagaatatttgtgacaacaattgtagtacatgaaaatcatattcatatttgaagacttcaaaattaatttaaaagccaaacattatttcacttatatttcattaggagaccttaacttgtaattgttattccaaactgaaacatgacgactcatttgaaatgtaatgattacctaaactatttaagttctactctgagactttgattttatactcacagattatgggtaggggcatgggggacagctattctaattcctttttctgttgtaaacatgatatgctattaatatgaatcagcattctttctctcatgcaatattagaaattttagattgtaagtggcatctgtggttcattggataaatcacttttcttgcaaagaacagattgtttgaaatatagtgactatagaattacttagaacctttatcttgaaaaatttgatagtttgtatctctgggaaaaatactttaactattgaagaaatgaagtttagtatatagccttgcagtatatcaggagttggttcagatagaactttagcttctcttacttagtttattttcaaagctgagtaggacatactatgtaaaaatataattattatattttgggtcttaaatttataaagtggacaaaatgttctgaaggacaactttgttgaatataccttaagattttgattt

SEQ ID NO: 130204 - DNA, 1005 bp, Homo sapiens
attaatgcatattacttgtgtattgatggcaattaacaagtattactttgaaaatcggttataaaaatcacatctgctctaaggaatcttaggattctgcagattttattcacgtttatttgtttgtttatattacagatttctcttggatttggctacacacttatagatcttctgcactgtttacaggcacaggtgagttaacgttgaattcttcatattggatactttgatatttaattaaaattttaaaattctttatatagtttaggaaaatatgtaaataagatgattttaaataaaaacaataaactgtatatttgtctatatttcatttttattatgaaagttccttacaaatgtattggaaataacatttaaaggtaaaatgctcatatctgtttatcagtggttactatatctatttgggatgagtttacattatacccattggatgagttgattacagtttattctaatttcatagcctgacaaaatgtttattatatttatttttatatgtaaaaatttgagtggtggtatttctcatttcttagcaaactagcataaaagaggagaaaagaaaagttactacagattttagcagcaaatctcagacttacaggggtagatgttataaaatgcaatgagccaacctttcttgtccaacctgtgtaaaatagcttctcaagcactccgtatcacacagctgaaattgatttttatcacaatatttatgatcatgtgatatatttttacttactctttacaactttccctgctagcttcatgaacatcgggaccatttctatcttgttcaaaacagcatccctaacacttaggatggtgcctggtatacagtaaagactaaataaacgtttgttaaagtaattatcgggtaataaacattaagaatatatttatattcagagacactgaactttgtaaatacaaatagaaatagtttattaagcttatttcattttttgtttttgagatggaatc

SEQ ID NO: 130205 - DNA, 1045 bp, Homo sapiens
ccacccgcctcagcctcccagagtgctgggattacaggtgtgaaccaccgcgcccggctaacatctttctttagcatgggtgcattgacacttttgcctcatgttatggtagcttattaataaaagcttactgaatagtatagagccaacagtaatcatttaatataattcctactaatatcacaagtttcagctcctgattgttgcataatatgatgtccttgagcaaattagttgttggtatagaattataacgggcttaagtaggccagcataatgaatacatttatcccagtagtgttagaaagagttgatgactcctattacttaagtttattgcacactattcactgactgccacttgagtggaatccattcattttatttactgtgataacttcttatttgcatatagattctttttgtttgtttttcatgaagtatctctgactaatacactagctgcatttcattatatatgatgagttcaagactggccaggtcttggtaaaaatcaaaatgccatctttttctgtttctctcccctgtagaccttttagattatgaaatcagatgtttctagtgtccaagaaaaatagtaattttgatattaaattgatgttaacttgtttgtgctattggattctatttactgttttaacgagtaaagggctcttaaaggaattagtaatgttttaagttttgataatccaaattgtaaattcttactgatggatgtcatttgaaggaagaaaaatctagtagcttagttataaaaacattccttggagctgattaaatctagtagtgtttaatgttttttaaaaattattcttaaaaagagatacattttcagtatcgttactagtagcaatcaagccacttttcttgagtccataaaatatacaaaagcagtaaatattaatatacataaaatgccgtaagcacatacttcttgttttcatattcctcattgtgtttcttgggaacaaacttaattggtgcagtggaaggatcagacgaaaagctgcaggctcatttacag

SEQ ID NO: 130206 - DNA, 1602 bp, Homo sapiens
ccacgtttggaaacagtacctaatatcttgtctcttggaacaagtcccaaggatagcaaaatcttcttggaatgagtaagaaagggttattaattttcttttaaaggttgttgatctatagagtttatcctatatgagtacctttttttttttggggttggacaccatggctcgtgagcttttgggaggccaaggcgggtggattgcttgaggcaggagtttgagaccagccttgacaacatagtgagaaccctgtctttacagaaaataaattaaaaattagctgggtgcagtggcacgtgcctacagtcccagcaacctgggaggctgaggcaggaggatcacttgcgcccaataagtttgagattgcagcgagctttggtcacatcactgcactgcagcctgagtgacagagcgagaccttgtctcaaaaataaacctaaaaaaaacaaagatattaatacaacttttttatatcctctggcacctggtacttgatgagttcatgaggaactagagaatgaatgaatgaaatttgcactgcattttggtcacaaattgacaagatgtctccatatactttagggattagatagcatatattgataagatggagaaaatagagatatttggagtagaataatcaccagcttacttagtatattttatcctaacatgtgtatcctaggcatatacatgtcagtcttgaaaaatgaagtcctttattaagacggattttcagagggagagaaaaactagtagcagaaccagttaaggtggtatgtgggaccagtaatgggtaggggaagggctgggcctgggaaatgggaccccagactgttcagggaagcatgttcatccccactgaagattaggactgtcctggaaataccatgttaacctaccatatggtattggatagttgtgtttgtatatacatattattctttaaattttggatctttttgggagttcattttaaaaactattttttttctagaaaaccagaaaattagcacataggctcataccaggtgtcagaaaggttattggagatagttgggtagatagtatttattgagtgagacaatgttataatcatataatcagtagtctgatttacacatcgtttatggtaataagtatccccaggcaataatctcccccccttcaataattagcaaaggacttaatgtatcaaataattattttttaaaaaaattttgttaaatttccagattaggctgttagcacccttaatatcaatgacctttttgaagtttgctaattttttttcctacctcagataaatctgcttttcactgtcagcattacttatgtttcatcctgtgttcgtgtgctttctcgctgttgctacattcaacatccaaattgtaatttatatttataactgcctctcatctaattatattctttctcgtttttaaaacacagcaaaatcaactttagctagccattatactaaaacatactacattttcttttaaacttcttttagtttgtttcctctagatggtaaactctactcaggcagggattatgtttgattattgatgtgaatgcaactttttagaacatagc

SEQ ID NO: 130207 - DNA, 1079 bp, Homo sapiens
actgcacttcagcctgggtgacagagggaggccttgtctcaaaaaaacaaaaacaaacacatgtttacggatggtttaggtttcttcaaatatcttaaggtggttggttttcctaaagaggtttctttaatggtgatagactgtcactgtgctatgactttaagctagattgcagtagttacttttttaaaaagaaatgtttttaaagtaaaacttgagtttgcattaatagtttggctctaacaacctaatattttcaaattaggaaaaatttgaagctctcacaagtaattcagcattaaatatgagaatgtactaaagcatagggtggattgaggcactgtatgttatgctactactaaggtagtagcaaaataagctcttatgggtgttatctgctgccaggatggccagattgaatcagaaacaaagtcaagatttcagctggtcaacctgttttatttaggacaatgtttggcaaattggagagtgtgacctgtaagtgggttgtaaaattaatttagtggatcacgaccagtgttaagaaaactgtaatagaagagaatagaaaagatgacagtatgttacatgcagtaacggtaattacttgtttgttgcagttgttgtatgtattggttcatggtgtgaaatgtatttcttaactacatggtgtttactatgagcacttagcacagctcatagaacattcaagataataggcagtcaatgaatgttcaactgcactaaatttaatttaaacttatataggaaaaaattgcacaagtaatttcagaaaagttttctaacacaaaatggcattaggaaaattggtagaactttaactgttgtgctggaattatcttgttatatgcctgtgaccttcttgggtctgtggggacttagctttatatcagtgtgcatgatggaagagcctgatttttagagtcagaaagaactgcgttccaattttgtctcttgacccatataaacttctggacattgggcaatttttttcagcactctgagcttcaaattcctcatttaaaaaagacgacataatagcacttacctaacgatta

SEQ ID NO: 130208 - DNA, 1041 bp, Homo sapiens
gcgagatattctggcttgaaggactcgtaactgtgcttcctttgtttcagagtcagaatctgttccccttcaggtggatgtttgtgtgtttttattaacttaggtcagcactgtcttctggttttgaatgttcttctgtgttcttcatactgagcatggctgatctggccatgtgccacacatatggtcaacatagtaatagagatagaagtacaattgataacttgatcagcattcatttcgccatatataatagcttggtttggttgaatttgcgtttaaaatattatacagagtgtgctaattactgcagtgtcaaaatggattagacagctgacaaagcaaacattcgaggaccaacatctgtgccaaaacacctttaattactgtaggctttgatcatcttaatttttcccataaataaattcattatattggtactgttcacatctcagagaataataaactatcagctttttcacagtttatgccatataagaataaatgtcttttcccagtcttgcttaagtgaagttctgccattttttcaagattgttattatgcaaacatatttttcatagaattccttagcattaagtagagcttaagtatcattaatattaaactcttaatattagttcatctaagagatacgagtattttcctagtagataccattgtcaagagacttggagattagaaacatattgttaaatttcttcagagatgaagggccaggtttctctagtccctggcccattgggttaggcctatgtttcaaatttttgtatgagtttcagactgtagaatagttattctgtgttaagaaagcacattttcaaagcatatgttttctagagaatgtttgctactgccttaaagtagaagagtgcatactcctgaaatctaccttagaactatcttcgggggaatcatgtgagaaggtgcagacttttcattgatttgtagttgagtatgaatttttcctctgagataacttaagccacatcaacaaaacatcaaaataaatcgttataaag

SEQ ID NO: 130209 - DNA, 1069 bp, Homo sapiens
ctctgtcacccaggctggagtgcagtggtgtgatcttggctcactgtaatctccttctcccaggttcaagcaattcttctgcctcagcctccctggtagctggaattacaggcatgggctaccacgcctggctcatttttgtatttttagtagagatgtggtttcaccatgttggccaggctggtctctaactgctgacctcaggtgatctgcccacctcagcctcccaaagtgctgggattacaatcatgagccaccgcacccggcctacaaataacattttaaatgacagattatattgcagtcttctgtttatgtggaaatgaatggttttgtgaaaactctggcttttaaacaggtgtattgcaagaaactctcttggtgggatgaaataaccatgaacataaaatcttccaatgacctcttttaaaatctcctgtgctgtaattaactaccctttaaatataagggttctgtttgtactgctaattaaattcatagttaagacttgtagaatagcatttaatttatgtgttgttttgtcttgggacttcactaacttgaaaggtgatgaaggtataaatagtgaattttcattaaaatgtaccagaaaaatatgtgctaaattctcagataatgactagcttgtctgaaaactaaacatatggctaaaagggacaaatcaacggttttcttgctgtatgctacagttttatgttaggctctttcatttgctcattgatcctgatttgattttggaggcatttaaaatgtactaaaatttacctgattacttataaattagcttaattagtgtgggcttctataaataaaaaatactgcatttgttatagttaattcagagtagggataacctcaaaatatttgtgtcaaagtttttgtatctgtttctctttcctaagggattgcagcaaaacttagagcctaggaagagaaagagaaatatcaaagatggaactgggagagatagacactgcagaattaagcaagatgaaatgatccacattcaaagtaaaattttagggcagggtatgtatatttgaaatgc

SEQ ID NO: 130210 - DNA, 1058 bp, Homo sapiens
acaaatgctgttattttgaatttatttaatttcaaaacagtattcagtgtcttttcatgaaatgcaaacttaaacaaggtcagcattatagaaggaaatgagaacagtcttaggagtttgtattaaaggagatagctatggttgaaaggaaaatctgggctactagtaacttgtgtttatttctaaaacaataatttttcctcccccaaggcctggtagggtgttttgaaggttgtatgtaaagtcagacatgatcgggttgctattattgtcctttaggagaactgtagaagatttctgctgtgcagtgtcaggaacaggttgctgtggatgatgagagtatcctcattggccactattattctgtatgaatcttctgcttttatgaacctttagcacatctaggggtaaaaggcgtgttttatttcagagctacgaggtcagagtttggatgatatgctgccaaagtgtgtgaattgtggctactggagttctgagatcccatctttgcctaaaatcagaattctagaacagtaagcattcaataagcactccaagcttccaagtaaccttttttttttttttttaaagccaatggctgcttaattttatacaatggttttcttgcttgttttctgaatgttgtagataaataacttatgccggcaatggatatataattctcaatcagattcttagggaaaaagccaaagtagtaaagaaaaccttttatatcaaaaaatataatttgtaaatttgaggtttagatttaaaaaataacattaatatatacatattaaatatatatatatatgaactcttctccccccgaaagcccctgagtattaaatattttggtcttaccaagtcgtgactaaggcatattaaagccagttcacatggaaacatttaataacctttatattactatttcctagatttataatttgtattagatactgtacagagcctgctagagaagctttgtgaacctgtgctctgtgtatttcccccctcttttaacagttgagaacatactttcatcagtctgtgtcctt

SEQ ID NO: 130211 - DNA, 1748 bp, Homo sapiens
catctaaaaagaatatacactttaagaaaatctaaaatccaaacttagaaagccagattaatcagggatatttattcactttacattggtgtctctcaattttataaaagaaccaattgtactacagccttccttaaatggacatcttccaaatgtttcgtatgtttaaactatttgagttaccaaaattgaatttgtgtggaattttttagactacgtcagtgtgtaaaatgaactgagtttcaagtgaagtctattcattttgataatggatagaaaatcacatagcatttaaaatgttgctcaagtttattattttaggcatactgttaactctaaagaaatgggtaaatgtataatgaagtagttaatgggacagaaatggaattatcccttttttttccttttttttgagactttactgttatttttggaaaacatttaataactcttaatattttagtagccattatatcagagatgctacttttgtttttgtagaatagatttacagagtacataagcagccagactttcccacagggagtgacagaataagttgtgcagttttgggaggggttacattgaccaataaatgatttctgtcagtacccaaagggcacccttacggcccaacagaattaatgaaactgtgcagcagcattaatttccttttgaaaggcttaggaccaataatactgtccttattttctaaattaaagtgaatttttatataaatacagtttgttatgtgacacttaagaaatacagtgaaaggttttaataaacagtctaaactatacttaagctgttttataagaaaaataaagtgaagagttggtgaatttcattgatatagataacgagttactttggtctcagtagcagattttgacttgaaaaactaaataatggctgtatttctctgcctcatttaattgtgcaccattttgcttttttggtcttttatctataatccatccattactcccctttgagattaagttttctaaaactctgctttcattcctccctcaacttttccatgtcttataaattgcctcttggttaaagtcccagcctagtgtattttacagccccatctccaagtatttccctatgcggccttgcacttcagccagatgtctctagccagcacttgtgacactctctttgtctttctttctgtccacgtcctatatatgctttacagcatagaagaataagccacatttaactttccagaccaagccagcacacttgtatgtcaggttttgaaattgttgcagctttgagtataaaagctgttatactttgcattgtcttctaagatttctaaactcttaagttatttctctcatttcctagtcttcatttggaaatttactgagagcagaggcctgcatcttatacttctgagtctatgttgaattcattcctacagtgtctacttctatgtaacagtattttacacatattgaaaccctaaaaaagacacagaattaagtcatagaattttagggctagaaataatttgtaaaaggttgtcatttatagttgagaatactgagtcatagaaatgttgattttgattaatagtatcttgaaatcatggtatggcttggagaagtgttatctgttatttttattttagtagggtctttgtggtggttttcactttgattctttctgaagaaatagctttaaaaatccttagcacttggatatgtaattattttactaagata

SEQ ID NO: 130212 - DNA, 1114 bp, Homo sapiens
gggaattaactgtaaagggtgatgagggcactttttggaatggtagaaatgttcatcatattgtggtaatagtatgcatttgttacctgtgtgttaaaacataccagacttacacatttatacacatcagtatatttcatgaaaaataagttttggtatagctatgctttatttaaatgatggaagggtgcctttgagaagtgtatgaattctgctgttcccctacttcctagccacacaatatgacctaggctgaatcataaaataatttaaaatgagcatttgtggcaattctctgaaaagagtaggattttgggttggtggggttggtttgtacttgttaattgcttctttggaagctggctatgcgtgctcagtttgcataacccccaactaatctcagcacttctgaacatgttaaagcattaaattctaatttctgtactaagagttatattccttttccctcttctccagtaactaagagagctttagtagtgatttttgtatgagtggatgacctttgagcttttttagaattttagaacagaatctggtttccagaaataatgttttaaaacctgcttggaatttttggtttttgtctgtagggtttcaaaataaatgtattttatgtctgggctttttgtgttttattctgggtttctttcttcattaactcggtatccagctcactaacttttccacttttccttgcccaaatccatgtatggttaatatgatttttagcctaataacattttttccctaatactttagaggtaaaaaaattataaagatacacagtgtagatttgtgaatatttgttagtttttaaactaatgagttttacttattagacatcagatgaacgtactttgttatattatctaataatgcacttttaaaaacttacagtttttaaaatagctctcttaagagatccctgtgatgcaggctagaagtgataagaaattttcttagagttttgaggaaactgttgctgtaagtgtattttaaaagctgcagtagtgttcttatgtcctcttgggactgaactgtttgcccacgtgtagtacatttgtgtttatgtggttaaacaacaacaacaaca

SEQ ID NO: 130213 - DNA, 2965 bp, Homo sapiens
ttcaccctttcaggtagatgcctctgcagtgggtatgaaaattgactttctaccattttctgtaatttttcgtatttgtttttaatcttgaaataggaacatttattagtaagtcaaatgagctattcactcagagctgtggaaactgcagagtaccatctgtgtagtttgtgatgtgccatatcaactcatatttgagcttttagcaggaaaagtgacataaaattgcgaagtattattattaacacggctgatcctacagtgaatcagggtgaggaaagaatctctgtggtacagactgcttttccatatcggttgtattaacccttctggaacgcgtgcaagcatttggtaattttaccaattggtacccaccaattgatcatcttggttatgtcaagaaagaaatgcctccatgttctgacttggatcagattcatttttacaaattataattttcattcaaaatagatatctactagcttccctccctggttcttctggaattcctgaacaacaatgcctaatagctgctgtttgtatctagataaaactgttggtggacctggtgcaacagatattcaaactttcccaacatggaatattagtctttcctgactttatcacattggggccaagatttctttgttctctttcttccttgtggaaacgacattttaaatgtaagccttacactatgctaaacaaccctttattctagccagtttatttattattgccagtttctttattgggaaaagtgatcttcgaagtcaaaaagccgtctgcctgcttgtgtcaggtgggcctcctcctggcctcggggcactgacttttcttagaagaagccttttttagcagcttcggccctcagcactctcctctcctgatcctaactggtgcttatttcccagaccatatgttggctgttaaccttacgatagcttattttatattctggctttttctgtatgtatttaggttttatgctgctaacaaaatgataaactccttcagtggcagcagcagcctgggatagtggaaagtgaaaagaatttggatttagaggatgatttggtatcagtctcgctcctctatccctgagttggaagcacaggcaaattctaaaacatattctttaaaagtagtctcatgtaataatacctgactcacaggattttgtgcattttataatctatatagattaaatgctttttacctataaaatgccattacggatattatttattgtggttgtgagcacatgggtaagccacccagtacctggatcagattttacatgagagcttcagaggttcttgggaaatgtcaagtaaaatgtgttatattttcaaaacctattagctttgttccctctgctgcatacttcattatctcaggtttagtcttgtatttctgttatcatctctatataagcttgaataacaaaagaaatattattattttacatttggtaattatatggtgtcactacaacaatcccaattcacctgctaggctggaaaagaaacatacttttccatgattaatattagtgcttatgtagcattagtattataccttcgtagggttccctgtaataacttttatcacagagtcctaatacatttttcattgagagagattagcactactgccttcactttaacaaacgagccatttgaaacaatggaaacttgatatttataatcgagttaagattaggatttaggatcccattgtgtattaaatagaagttacattttaatattctgttgttattacgctgtttttctgtgcggcttcctgaaattcctaaaagttaaagtttttggtattggcaaaatatccctttacaaatggttacaaaaaattactatggaaaagtttaataataataatgtaatgaacgcccatgaaccggtcatctatacctttatctattactcccccatctgttttgaggcaagtcccagatacatcttttcatcctataggcatttttttttttttttgagacagtgtcttgctcagttgcccagggtggagtgcagttgtgccatctccactcactgcaactcaacctcctggactcaggtgatcctcctacctcatcccaagtagtcgggaccacaggcgggcaccaccacacctggttaattttttatattttttgtagaggtgggtttttgccatgttgcccaagctgatcttgaactcctgaactcaagtcatctgcctaacttggcctccgaaagtgctgggattacagacgggagccacggccacaggcctttttttttcttttttaaagaagaaaatttcgtgtggtatatatgaattaacaaatgctcactcgaacaaaattttgggctgtatagtccttgaaaatttttgttccgtggtagcgtaataatagtgcaattaggcttggagaatgagggctgtacagaatgaataccagtaacaggcatatagtctaggggagagaaacattaataaacacacacagttctaagctctgtgacagcagaaatcttttttgccttgcacagtgtctgaaacaacgtaaatgctaagcagtttgttgagtgaatgaaaaaaattagtagaaagtggaattcttgggaacatgagtcttgttatttgtgttcagtgtcatttgggatttaaagtatgtgtgtgtgtgagtgagtgagtgtggcactgtgcgagtgaggagtatgaattaagaatttgccttgacagagaatttaggtttgccctaaaactgagttctgaaacctagtaggatctcatcttacaaaagtattatgaagtgcataggtaaatggaaagtaattcatgcagctctactaaatgaaacagaatgaaatgtaattttagaacttgtacatataattaattattcattctttaggctgaagttgacttatggcattactgatatttattttctttcttt

SEQ ID NO: 130214 - DNA, 1506 bp, Homo sapiens
gcacctgtagttctagctactcaggaggctgaggtgggaagagtgcttgagccaggagttgtggctgcagtgagctatgatgacaccactgcactctaggctgggtgacagagggagactctgtttcaaaaaataaaataaaattggagtttcttgaatacaagagtatttgtttttcagttctgtgaaggcagtttggtgtagcactgtctggattgccatccaactccatcacttaaacaagtgtgaccttgcgccccaatttttgtaaatgttcgctgttgttattgtcactttgaatcacctgcagtgataggtatttgacatacagttggtgttcaataaatcttggttagttatttggtattataattcagagtagattattttaaattcaaatagaggatgtttagaagaactatgaaaaaagttagtcttgaagacaagacccacctgtgcattcaggattatttatggtcaggtttttatggtccttctttatcaattgaagggtgtaacagaaatgcaatgggtgatgcagcactctgtagtccataaggatacattatgaattattttctaattattcactgtttagagtaactgtgtttctactttgtttgtttacagaatgattattattacaatcccttaacattttagcacttggtaggtctgattcaatggttctcaatggatgggagtggggaaggacaaagatgatctgatgtatcatttggcttaccaacattcctgtccctgttacattcctgtggtttcatggtggttgaaggtgaacctgacagtgctgttttacagagaagattgaagggaaggtgttttaagtcaatagagttaaagctctttatgttttggaaaaaatttgggggttattttaaaaactactcagaggtgatagagtattgtaattatcatatggaaaataatccaagaaatatagtatataaaattcacatttcattaacctggaaaattgactgattgtttgatgtatctaagtgttggacttagaagtggacagtattatattctcgacaaagagattatatttagatttctcagagaagtgtgtaatgattaaactcaatgttggaaccatttggttaatttaattataatttaaaataaaaccccttttgagaaaattcctgcataagacttaagtgttatttttgactagttcagactgtggcttaatatacaataattttctcagaaaaatgaagctcttgcgaagaatggttgggcatatttcaccaaaatcaagtatttgtgtgtgtgttttttttttttggagtttgaatataatcctgtaagtagatgcttcaaaaccacttgaatcaccatggaaagcaaatctctttagttattctccatctaagcagcctttgccgtacagtttaattaaatctaatcatcagtaatagttctcttttccatagggataagttggttctttgggtttttcaagatttggcctgtttc

SEQ ID NO: 130215 - DNA, 1034 bp, Homo sapiens
gcattatcttaggtaaccacacacacagtaccattattaaacctaagagaactaatatcatctaatatcagctctatttcagtttttcaagctgtccccaaaatggctgttacagctttgtttttcaaacgaggatctaatcaagtttactcattgcattttgttctctccctttcatctcttttaaggtggaccagttcccgtggtttgttttgtttgtttagactttttagagtctaagccagttgtcctgaagaggatgcaattgttctatcaattttggggtgtcagacttcagtttctccagaactgttaggaaattaagttgttaatgtgttactgagtttgatcagggctgaagaagcacagccaacctttgagagcttattgcttgaaatgatggcatccttggaccttttcatggcatgttccttctgaagtctctaggtctgggcctagacaaactttctactggcagatcataaggagatgcaaatgaagaggtagtatctgaccatgagacatttaccgtctaacaacttgagatattttttccctcctgggaagtagatttctgttttaggctcagattaaggagggggatagaaattgagacacttaattttacagcccccttggctaaatagaaagcttttattcaaacacttatttggagtaacattatggagacgaaaatttcctggagcttttcggagcaatagtaacttcagtttcttgaatacttgactacttcataactttgaatttggaagtttctgtttctctcttctgtttttctttgcaatgtcttcatctgttctccctgttgacttttcctgtcctataattatttccatcttctttactttatacctaaccttaccttttctctttcctactttaggatcttattagaagtgtggtagagccctctcttccctcttggatcacagtgtgcataggggttcattctcactttgagaaatagaccataaatgtaaaaatcattcataggtatgtagtagacaccagag

SEQ ID NO: 130216 - DNA, 1223 bp, Homo sapiens
taggacagaagtgatcttggatctgcacccaagatcagataaagagtaggtagtcctaaggcaagggaaggctttctggggcttgtggttttcagaggctgagttccctgtcttcactgggcttgtgtacctctagggcccttggaaggagtgaggggaggcaatgtcttcccaccgaggggtaaagagagttttccctttcccatctccttcctatttccttttgaggttcaggtatccctgggagcttaatcccacattttctgggactaccacaggttttcatagatgtttactcctttaaggcagtcctctaaccttcaaatcagaaacaataaagaattaaatttttggctttgtcacttcagtaaaattggacatttttcacacctggacttattaaattttcccctgcagaatattttgccactggagtgagaagagggattaatagtatcagtttttagtggatagaggaggaaaaggtaaagaaaaccttggggaaattcagtagttctgaaaaggtaataaaacaaaaccaaatacaaagaaagtataccagggttggcacttaactatttccattgaagaagtgataaaaaaagagaatgaaggcatcacttaagggctgatgtcttaatagataaataatgaaattctacaactatccaaggagcaaagaccttccagttcacacattaatatatacttgtggcaacacttgtaaaaatgttctcaacgttcttcccaaatttctccttttaataataatttcttattttgtgggatgtttttatttgcagaataagtcagaaggctatccatctgtctgtcatttattcattttctgccaccaaccaatgaacgttaaatcgtagaaacactgtgcgactcagatggaaaagtgggcggcgctttgtgcagtgtcctgttgccctcctagctcccctgatcctttaataatgtggtagaatgagaggctaaatactgttatttcagtgtgttcttgttttcagttcctgacaaaaaaacctgctagaaaagtattggggtttagggaggactaaggatttctttggtcccaactttctttatgaaaaatttcctacacacaggttgaaaaatagtacagtgaatccctgtataaattttgctataaatgtttttaatttctcctcctaccctctccacggtgtggttgtgagtatgtatattggataaac

SEQ ID NO: 130217 - DNA, 2453 bp, Homo sapiens
tgataaagcaaatgtttgtgggacattataaggctcagtctacttgttaagtccgtaagaaggatgaatagatttgaatagttccagtcctgcaaattgtatcaggaggcatcttccagactgttgccttaaggagggcttatacctgcacagaggttatttattttaagacccatgaatagtctctagcttttttagtcatcagctcagtttttaactattcttgaaattatagattttttcttttaattttcaggaaataagaattatatgggtgaagtaaaatagttaacatttattgagtgcttactgaaaaccaagtgcagggcaaagatgaccgtacagtactcttgtatgtttcttactgtagcattgagaggtagaaccctgttcttgttagctctcttacccagtgctttattgaagtaacatagatcagtaattctctgctagtgaaaaggaaaagagtagggagtgtattttgcaagagcatattcaggttgcctgttgttctcacaataaaaagctcagaaaataaagctcaagaaaacttgattgtgggggataggtagaacatagattgacagagcactatagaggatataggcttagaaaggatagaatgctgatacaggtatttggcttcttatgcccttaaaacatttaattctagtattgtttaactgttgtgcgcagattgtgtgatgcatgttttgcagatgttttgtaatcatgtagcatggatgactaggtgttgaggtattgtagtcccaaaaagaaggctgataatatattcagtcatctgacttctgctctgctatttgtggaattcttctgtctgctcaattgtttgcacggagcgcggagagctttcagggaactctttcacctgcacatataggatcagcatgcattgcttacagtgttccagctgctgagactgaagacctgttgtcatcgacgagaatataatgcacggtattttctattattcatttagtgtgtccatatgaaatatgacccaaaacctttcaaggcttaacttggagagtgttagttctggtagttcctgttggtgctgactgatctctgcccattgaagtccccgtctaaatgaggattgtctttactagcagatcattcctgcttataaaatcagtacatgatttaaatatgaaacaatttcccttgtctttggtattgtagtagcatttgtcagaatatttaatattaacttatcttaaaatttctaattgtactgttaatatgcttaaaaaggaaaagctttcagttattgtcgaaatgtttttagattcctaaataaggaatacggaaattccgtagtagaattgaatgtcgggagtatatgaatttctacaaatttaacctaatattacagcatttctggaaattacagaagcaggttgtagttatggagacaggcattgggggcttgccggtgcttgaggcggttctgctgtcctgcatctgccatcttgtgccagcagcctgttctggatgtagcatagggtgtgcctggcattaagaccagactccagtagctgaccacttactacgcagtgctttgacatcagggtggaatgataaataatgattcaaacttctgaccacttcactttgggtatgaacctttgcacatctttctcctctacctccttttatctttcttcttccctgactttaattttttcttcaagttgaagattaaatataagtggtagtgaaaagaatacaatcaagattacgggggaagtctgttactatcattaaggatttcatgtatgtagatcatgtctgatcatgatctacagtttcccctttaccaaacagatttactctgccaaaaacacttagtgaagaagtcagctgtttgttaagaaagcagttatgttgtgcctgtgttaagatcgcttaacccaagagtggtgaggtattggctgatttgttgttggagttagttgctggacaacattgtggttcagaagactggggctgagcttctattgtagtaggatcgagtattacattccttagcttttatatctgtattttattttttccctgtttaaggatattgttataaaccctacagtgttagatgtcatgaaaatggtgattaaagccatcaaaatggtgttagctgaaaatattaagacaatttaagattggtgaaaactgtagtcaaattgctaaaacttgaagaatgcctgcctctttggagtttctcaatatattttcaacttccgtaattctattttgagacttattttgtgtggtgttcttgttactgttttaagtaatattaatgttttgattccttaaagctttttcatacaagtgtgatgtaaaaatatttatttcatttcaacatgttattttggccaggcgcggtgactcacgcgtgtaatcccagcactttgggaggccgaggt

SEQ ID NO: 130218 - DNA, 1019 bp, Homo sapiens
tgcaacaatccttgaaaatgtggtaagattcttggtggcagagagaaccaagtctcctaatggctggcttggggggaaaaaaacctctcaagcatatggagacatctagaaaaagatgtgcatcgtcagctgtgattccattgtgtgctctcagactggatctgagcttccttcctcctgggaatttcagtcttaaacagaggagttctttgacttttagatgtcagtatactgaagcaggagggtagaaaaggagctcaccaattacggatttattatgttttgagtagttaatatgttttggattttaacccttcattggttaaatataatttagatgagtggcttagtgttagaagagcattttattggaaatataaaatgtaaggcttggagggggatttgggctgtggataaaggggtaatgctccttagttgtctttatttatagttgtatcttattaaagctttccaagcttcagtaacatcaaggatctgtgagcagtccttccattatatgccctgtatttaaggattcagtaccgtagctgtttcaaattacataaggttgaaatgtgacccataagttgacagcttggatttcttaggaaaaattgtttgtgttgtattgagttgaaaagcaattctttaagcactctttaggatattggatagtaaaggaaaatacaaaaggggatggtctctttaaacaatttttctgaaatgcacagcatgtgccctcatttgatattttggccattattgtgtcatgatcgaagttatatttaaaagccaagttaatgcttatttattgttatgaaaaaactgctatttaagaaattactaactttagtattttgcgtatgtagttttgtttagtaatgtatgttattacatgctttattgattttagattaagagaataggagggagaaaataagtcactgctttaaggtattggtcttttattgcagcaaatcataaaatcagcaacaaatcaggatctttttccatagtat

SEQ ID NO: 130219 - DNA, 2390 bp, Homo sapiens
tcaagactgcattgagccatgatcgtgccactacacagccttggtgacagagtgagaccctgtctcaaaaaacaacagtaacataaataaataaaaagaaggccataatacacgcctccacatagaaattatcctaaacaccaactttactatattgtaaacaaatatccccaaggacttcgctgtcaaatgtgaaaagtttctttatttctacagaaggtatttctcttgaatactatttttaaattcttgtgactttatagttttctgtgctgtcacttttttctgcttttaatagtagttttcttttaatttgctactttcagttcattgtgttaaaaatgttaccaggttttgtgattggttaaatactggtaagtaaatttcacctgagtgaattggattttacattttcttttctgaaggtatctttacatataaagattataacttgcatttatttataaaagagagtaacatggattcttttctttttgcagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaagttgtatcctggatgtttctgtcattgttggtgtttaggctattttggtatataacctcattaaaatgtaccatatttaaaacacttcatagacattcagaataacccttttcaaaattgtgttctgcaaataaacagatttgttccacagaatattggtgaggactactggggggatagatggtcataaccaaataaatctgggaatcactggattaaactaacctaaaggtgtctctttattatgggaccgttcagtccttaatatgcaaacgtgtttcctggtgcaccaagaatgttggatataatatgcagtgtttcccacc

SEQ ID NO: 130220 - DNA, 1124 bp, Homo sapiens
tgaatactagtagttctgaggaatattaatagttcttatacaagaaaagagataagctaaacagaaaattaaacatttatttcctggattgttttagaaatttaaataggctaatatgtgttatatctctctgagtgtgatatatagcctttcccagatatttgactcaaaattcttttttgcagaataagaaatgctattttaataggcttttacttaataggaatctagtttcttctttatttatttatttatttttttgagatggagtttcgctcttgttgcccaggctggagtgcagtggcgcaatctctgctcactgtgacctccaccttctggtttcaagcaattctcctgcctcagcctcccaagtagctgggattacaggcgtctgccaccacgcccaacttaggaatctaatttctaatagaatcttgtttttgagatttcaggaatttgacttacggcctttttcttgcagattttctctgtgggcagttctttttgttttgggaagacttctgactttaattctttcagtactgactgttggttttggccttgcaagagcagaaaatcagaagctggatttcagtactggaaacttcaatgtgttagctgttaggtacgatcaatttaacatttttttcactttatacagctagataatatatattatcagtttctctacattgaatcatctaaaaaaggatgaatatgaggttggggaaaatactcatttgattttatttcatacccgttgctattttacatgtctaaagtgaagtactaaagcatttaacttttaggataaattattaatgcaatgattattaatacaattttctcaactgagtgggaattattactaaatactatgaaagatgatagaatgtattcagtggcattgttttttatacactaactttttatgtcttaatatttcttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacaggtttgtattcagt

SEQ ID NO: 130221 - DNA, 1011 bp, Homo sapiens
gaagccagcagaggttaagtgacttgctaatgctatatacctaattgaggatgagagattgcggtggggtgggagcagaatagctttcagatctcctacttctacatttttcacttactcttaaagaacagaaatgagccaagcacagtgggtcacgcctgaaatcctaaccctttggaaggccaaggttgggggttctcttgagtccaaggttttgagaccaacctgggcaacatagcaagaccacacctcttaaaaaaagggaaaggaaatgttttagcatgttttaatctataatgtatttttttacaggaagatattcctcgtcagcttgtctacattggtctttacctcttccacattgctggagcttaccttttgaagtgagttgggatatttcatgggtgtgtaagtaggctgggcagatagtatgctgacctgtcttaattgataattaatattcccatttttaatttgctcttttaacagcttgaatcatctaggacttgttcttctggtgctacattattttgttgaatttcttttccacatttcccgcctgttttattttagcaatgaaaagtatcagaaagggtaagttgtttagccattctatttctcgtgtactaggtatttaaagtcagtgcctaacattgccaagatccatgctttaggccattatattaactttttaagcgatcagtagccgctttaaataaaacgaaattatttagcaattcagactttgtattttactctctaaaatggaggctttctcagctagagagatactgtattgtatcttgcaattttgaaggcttcttgggtttacttttctgttataacttttactttgtttgttgcatggtttttcttttggaggagtgatagagaagtgaactctcagaagaaagtgaaacaatagataattagccttatagataactaaaatatattgatggtgaaattgaactgaaaacagaattggagaggtgtaacttgtaaagagtg

SEQ ID NO: 130222 - DNA, 2576 bp, Homo sapiens
gtacagttaccatatttgcctaagaaaaaaaaaaaaaacagaggatatttgaaattgggattattccagtttcaggtgattattaatctatgagcctttgcttttgtgtcagtctttttccccttcttgtcttgatgaaactgtatagacatgtgggttatgttttcagtagctaacatgacatactagtcagtattaatgaactaataggggctctgactcctcccaactggcttacatgtcaatagctttctgcagatagtatctttgcctgctgtttaatccaggggtcttgtccaatggtgggactgtcacagggagatggggaaagaggttgttgaagagttgtttaaaggtgcacagatattgtatggaatgatgacacaaaggtagttacttagtatatcctgatttccagtatttgtttacttttttttaaaaaaattatgctttaaaaggtactcttcattttcttgtgttgtacagatttcaaatgaagtttttctacatatcacagctggcttactggcttcatgcttttcctgaactctacttccagaaaaccaaaaaagtaagctgggattttgtagtgttaaaaaatgtcttgtcatttttttttttgaaaaatttttctaaaattaagtattttcttacatgtttgcccttcctccattcttcttacctcaactcttaccccatcattctcccaccaaccctctttccacaaagcctaaaatccttaagcatttcttgaaaaaaaaaaaaaaaaaaccttcagtcagtattttagcttagattttttacatttgatatgttaatggcttgtcttaaaattatgttagtggtaatgtaaattaaaatttaaactaatttttaaatgtaatatttgttttatcttactgatattcttagcaaattatttcacaagtgagccaaaaaggattagtcacattacaactaacagttctgtgtgtaagtcctaaagcaaaattcagtattggaaaaaaaagtaaaatatatttaaatattcaccagcaaagcctctcttgaaatgggtagagcattccctttttagcatgtggaaaggatatttgtttgttttatttgaacaaataagtaaactgctggagcactgcaaaatcctccttcctagttttaccctcagtgcttctgaagtcgggttccatgctatcacaaaagtcgttttctttaccctctcccttctgaaacctgtattggctccctattactttaaactagagtaatgctgctcaactgtgccctgagagtttctcccatcgccaccatcttttctcggggacctctttctctgcttactccttatgcttcatgcacactgatagtctctagttttgtaatcccagcacatcacttctttttcctggaacacctcttccctcggataaattaatcaagtactttcatttcccttttttctgggagttttttttttttttttaattctcatatatgaaatcctatgtgggattttacttcaaaataataccaggtgaaggaaagtgaagagggatatagatgaaacaagtttgatcgtttattaataatgattgagttacgggtatgtcagaatcttttctgtctgttgtgtatatgtttacatttttccgcatttaaaatttcttttttttttttttaatcccctttgagaaacctggagtgaaagtgtgacagccagtctggtgactagtttatctttgcctactcaaaagccataaaacactatttttatgtgtgctacaaatagttaattcatggactaggcacttgatttcctactgtttcgtgtctgtgttctgtgtatctgtcgttactcatgttgtctgctaggattagaaaacagcaccaaattaaaggccatatgctatggtacttaagttctttttatgctgatttcttttataaagtagattgtttctccagctatattgataaggaataggatgaagaccttttatttttaaacccttgatttagaactgtcttcagataaaattgttaggcccagattccagtagcccttccatgtttagtaagctcctaatgtgaatcatagatattgtggagctgtactgtccaaaatgctaactactagtcacatctacatgaacttaaaaaacaaaaacgaaattgacttttttagccccagtagccacatttcaagtgcttattagctactgtggctagtatgtaccattttgaacagaggagatatggaacatttccatgattgcagaaagttctattggacagcgctactgagagtatcatagtttcttgatgtcttagtagcatggctcagatatttaaagccttcttaaggtatttgtatactcatgaacaaatacctctggatttcattattaatccatgtctatatcttcttcattgactatggtaagtaagaagggacatttcaaagtaattgttcattttagttcctgaagctcttttcttatcagttcctgccagatggcacttctccagaaatgcagtctaatttttatggaataatttgcataactcagaacttaact

SEQ ID NO: 130223 - DNA, 1012 bp, Homo sapiens
taatttagtgtgtagttagaaagtagaagtagaaagtttcaaaagccctttgaaaaaaataggtcagtaggctaagtataactttatcaacctaatttatacccctgggataatatcagtttattgagtgtggcctcctcttccctgttttttggtctttggtggctgtgactaacatgtgtcaagtctttgtaagtaatttctaaagctttagatttctagatagttttgattttcattgcccctctaagactcaagatgtccaagaccacgttatttatgatgttaatatagaacttttttattaggttattcttctttgtttccataactatgttgtacttaatgctgtttttataaccttgtgtatatttttgtgtatttgtgtcctttttggtcttcagaagaacaagctactgaatcagtgtccctttattactatggcatcaaagatttggctactgttttcttctacatgctagtggcgataattattcatgccgtaattcaagagtatatgttggatgtaagtatgcagtcttagaaatctatactttataaagtactagctctccataatctgctagtcatatattaaatataatttataatttattcttaattactaatggctgtttttatttttagaaaattaacaggcgaatgcacttctccaaaacaaaacacagcaagtttaatgaatctggtcagcttagtgcgttctacctttttgcctgtgtttggggcacattcattctcatctctgtaagtatgtcctcttaggttgttgttctccttccttatctaagattagaaactctgctaatgaaatagtattaagttaagagtttcagtgataaatctgttttaggtatttttttatacagcaaaaattctaaactatgtttactgtttcagaaaggcttattcatttttagtcactctgaatgttacttttatatctttcttttttttttttttttttttttttgagacagagtctcgctctgtc

SEQ ID NO: 130224 - DNA, 1029 bp, Homo sapiens
tatttacctgtacttttcacaccacggagctccttgtcattagggattattttatccatcttcatctcgtccttttttgtctagcactttgcctggtgcctgtaaagattgggtaagcattccatttttctgctctgaccagtttacttttaccagtagtcaggtcagttaaacagttattgaccacttaactctgctgggtgtgtgggatactaacacacccacaccacagaccctatatttgatctgcttttctcatgctaactgtgcttctctttattttattaatttacacttgaaatttgtcttaataggaactttttattcattgtatagggctagagtagagaatcatcatttgtcaaataactgttttctggaactgcagaaaatgtcttttgaaatcttaaaattaaggatgaattacacaattttacctaaaccgcagaagagtactctagtgaattacattagctccttggcaatcagtaatttccattgtgtctgtcaggattccacaggaacgaggaggcccttggtgcttcgatttagggacagattttataatgtttttgccccgatctgttatttgggagagggtcacaaattgacttgatctttgtttttccttctttgtagataacggcaaaagcttctatcatttttgttactcttcagtacaatgtcaccctcccagcaacaggtaggtaatttacgctaagaattttctacgtaaatagaagttcagttgaacaaacttggaaattttcatgaatgctaggtcctgcgttaattaatcgtcagagatctcatccatgatgtgactgaatgttattgtgatgattttataatacaagatctgatgtttttgattgactttaccctgtatatgttttctgtttactatatatttttgtgaatggacttgaaattccataaaataattttgttttgctttctctgctttctgattttttcctaagaaaattataagaaaagatctttttaaaattgtttaaatgtcattgt

SEQ ID NO: 130225 - DNA, 1531 bp, Homo sapiens
atacagtgctaggcctggtgctctggcttatgcctgtaaacatcccaacactttgggaggccaaggcaggagaatcactggagcccaggagttcgagaccagcctaggcaacatagggagaccctgtctctacaaatgattttttaaaaattagccaggagtgatagatagcacgcacctgtggtctcagctgggcggctgaggtgggataattacttgagcccaggaggtggaggctgcggtgagccaaggtttcaccactgcactccagcctgaaggacagagcaagaagaccctgtctcaaaaaaaacccaatgttaaacatttgtattcactttctgaatttgatacttgcatgtactttctgctttgaccttaaagtagtactttaatatatgtagtatattcaattttctgtaacttgtcataaaccatctccacatggtaagaattcctgactttaaaaacatattttaggggtactgtgacctgcaaggtatatttgcagtgctttgaatgaaatgaaatataaatcagaaattctgacacatagtataactttgattttatataaactattttacattctcttactatatttctagggaagtccaccacctataccttgcctcacatgttagtgatttttttaaacagtggattttcacctttatataaatttataaaatttgaaaatctaaatagacaaaaatactaaatagaggtttttaagtcaattcaaaagtgagtgttaaagtgatacacaaaagtgaagtttgtgcgagttcttcctttttcttaccatatattaaggtgttaggatttcaaagcatgttatctatatataggactttgtagactaggttagttttgctattcgacttttaaaacaattgctgctgaatctcaaagttaacataattatagaattacagtacttgtgctagaataatagagaaattgatttttttttgcagaactgttaagcctgttgtgcagatacattgaggaaatgtcagaggatttatggtgacattgacaaagaaattcagaaagaaagaaatactgtattactagccaaaatgaagaagcaatggagatacactgtaaaagcatggattctggagctgaagggattcatgttcaagttagggctctgcagcttgctaactgggtgacctagggcagctcagaactgaagtttcctcatctgtaaaatggggcttattgggttactctgacaaattaaccaatttgtattatgcctagttcaatacttgacttccaaaaggtgtgcaataagtggtagctattattattctttaaaaactcaccaaaattgggaaatagaaagcatttttatgtgagagaagggcctggaatctctttagttagcatctaaagagattatacatactgaaaaggctaacaaagtagtctgtttggcagtaatgtaagagtttaatttccagggaacttcacattaatcaaaaattgcttgtaaattttggaatcatagttttattacagt

SEQ ID NO: 130226 - DNA, 1034 bp, Homo sapiens
cgccccctcccgcaggctgcgcggcgcagttcctggttcccgcgaagggttacgtggcagccggcgaggggcctgcgggcgggggcggcccctgcgctgccgagctggctcggggcgggtgggcggacttggggggactgccagcctcggccgcggtgagcgtcagccccgcgagggccggggaaggccgaggcccggcccccgggtctgaggagtgccggcctggagaccacaggccccgagtgacaggggagcccccggtagctccgagattggggtgagcgagaaaccggagtcaggcatctgctttcgacttgaagggcggtggccgccgggcaccggcgcagtggaggcgcgccagattgttttcatttttgtcttttaaactgatattattaccagttaacgaactttttgccctgacgctttaaagaaacaaggtctgatggataaatcgaggttctgaacagcggtgccaaggaatcgagtaattttgtttcttgaagtaggagaggatgggaatgtcaggagtgtgtaaattctcttcccacgtatctagtattttgatgacttatttaacagctgttgaatgtggatgataaactttgcaaggtgaacgagtaacatcctacgtttttcccctcgctccccaatacacacgctcattcctttgcttttttccctttttaatttttctctggagcctttatgtctcagtaaatatacaaattattttgctcctgccttgttttgtctcctctctcctgcatgtaacaagtgagagtagagattttggagtatttttacgagtctgtatttccagagtctaggatagtgcctgggacataggagtgcttaaaaaaagatgagcgacgttaagaatccttgagaaaacctaatggaatgatattaccagtgaccaaaaggtgaatacattttctttttaatggagcatatttgtttttttttttaattttaaaattaaataatattttaaccttattttcgcctctcatcaaatgggcttttctgga

SEQ ID NO: 130227 - DNA, 1069 bp, Homo sapiens
gttctcaaactacaatactaaaataagcccagaatcctgagtgtattttgtttactcttccctaaagattgagacttaaaaatttttttttgttttatttgtttgcttttgagacagtgtctctctctctctgtcacccaggctggagtgcaattgcacaatctccgctcactgcagtctctacctcccaggttcaagcaatcctcccacctcagcctcctgaatagctgggactacaggcacatagcaccacacctggctgatgtttttattttttatacagacagaatctcactatgttgcctaggctggtcttgaactcctgggctcaagcagtccccctgcctcagcctcccagcatgctgggatgataggcatgagctaccacacccagccagacttaaaatttttttaatttcctttggcagcttcacctctttctgcctcttttcccaaggtccctagcattttcatgccatcctaatacacttattctcatgctttgaagacctagacccgtattcctagaactggttcttattacaaaataacttataaactcaaaaacaaaagcaacctgattgaaaaatagacaaagaacttgagtagacatttctccaaaaaagatatacaagtggcctataagcacatgaaaagatattcatcatcactcatcattagataaatgttaaaaccctgagataccacttcaggcccattacgatagctgttactaaaaattaaaaattaaaaaaaaaaaacagaaaataacaagtgttggcaagaatgtggaggaattagaacccttgtgcattgctgacaggaacataaaatagtgtagccactatggaaaacagtatgatacttcctcaaaaaaacctttagaattaccatatgatcagcaatttatcttctgactatatacccaaaaaattaaaagcagggacttaaacagacattcgtacatccatgttcacagcaactttattcacaatagccaaaagatggaagcaacctaaatgtccattgaaggatgactggataaataaaatgtggtatacacatacag

SEQ ID NO: 130228 - DNA, 1107 bp, Homo sapiens
tcccagacccaaaaaccacgaagaatttcacatgtggtagatttgggaacagccaaaggttttaaacagtggtaaaggtagtaaacttagagatgtcaaagcagtaattatgtaattattttctagtgttagtttgtcaaactaataatctttatagaaatgtaatccttaaaatccagaattctaagcttgaatttgatgtagaagccttagcaatgtttttacatgtaccaaaaatacccaactttatattgagcaacaaaattattttaagaatgaatgctttttctagccacaaggtaacttaaaattcagtgcatttacttatctattgttaaatttttactctctgattttctttttacagttagcaacacagatcctgacaagaaatggaaagctcatctttagtttcagattaaagaaagctttgttttattttgctttcagagaatggtatgttttcttaactataggttattttatagagaatataaaagtataaaacattaaaaataaccctagatatactttaaaataatgttatatttatgctaaaatatgtaaattacactatacaaccatatgataggttatttctctaaccttgtcttctaacgttttaccaaaaattcataatctaatagtttatcagttttcaatagattaaataaaatgattactttaaaaataataaaatttatctaatttaaagttgatattatttttggccgttagttatctattactagtgatcagttatactgttttctatagctactttatttaacagcacagatttctatgcacctttactctttcctcaacccttgtctctatctgtacataattgctttgtcttgatgtttctatcaactatatcatgactatctattggttccataactctgtatcatgtgtattttcttattctggtataccacaaatgattcatgcaaatgaatttttggtgattgaaaaatattaaattcccaatttaaagtattatatgataaataattatttctgtaatccattaatgcaaccaacatactttccaagtttaaatcttagtatgtaaatagtcatcagcttatacatgaatta

SEQ ID NO: 130229 - DNA, 1142 bp, Homo sapiens
ccagatgaggtggctaatgcctgtaatcccagcactttgggaggccgaggtggtaggattgcttgagtctaagagttcaagaccagcctggtcaatattgtgagatcctgtctctacaaaaaataaaaataaaaataaattagccaggcttggtggcccacacctgtggttccagctactcaggaggctgaggtgggagggtcacttgggcccagaagattgagcctgcagtgacctgtgatcctgcctctgcactgcagcctgggcaacagagtgagaccctgtctcaaaaaaagaaaagaaaaagggtgggaaaagtattaaattttacttcagagtgagaatcttggtttagttaaaggagagaattttctaatgataattttcagtgggttcaagaaaagaaaaagcagctttttaactcatctgtttatttgtgtctaaagataaggatacagaataatttacttctcaaaatttcttctaagctcgagttcataattgttattattccttatttcttctttcaaccagagttctatatacccctggccacactgatgatcacatggctctactcttagaagaggaaaatgctatcttttctggagattgcatcctaggggaaggaacaacggtatttgaagacctctatgattatatgaactctttaaaagagttattgaaaatcaaagctgatattatatatccaggtgggtaatttttaaatttttttatatttttatgtttttaaatagagacaaggtcttgctatgttttccaggctgttctcaaactcctgacctcaagcagtcctcccacctcaacctcccaaagcgctgggtatacaggcatgccaaagtgggtagtttttcaaacctagcaaaccatttgtgtcaaatgatgaggaaggttcattttggcttgtctctgtatgtatttggccttgaagagataacatataaggccaggctcagtggctcacacctgtaatcccagcactttgggatgccaaggtgggcagatcatgaggtcaggagttcaagaccagcctggccaacatggtgaaaccccatctctactaaaaataaaaaaattagctgagtgtggtggcgcacacttgtaatcccagctacttggga

SEQ ID NO: 130230 - DNA, 1768 bp, Homo sapiens
tagtgtactatgccaattgcatgtccatgttaaattcagcgtcagtatggtgaccgctcagaccttaggagctggggaccaccaggttgcctaaggagaggtgaactggcccagatcggaaacagagcaggtcagaactcccatgctgatcagtactgggatggagcctgtaaatagccactgtactccagcctgggccacaaagtagaaacccatctctaaaaaaaaaataggtaaatacacacagacacacacacacatatttgtcagtgctatcccttcttcacatccactaccagtacttcctcctttatcttactgtctccagctctcccctttagcctaccatccttcattgtgctacttgaaatctttaatgactctcgctgcatacaagataatgtttattctctttaccataccacagtctgaccccaggccacttttctggtcttagttcccactcccctcacaaaaacacttagccatatacaaatattcctgggcatattatgcctgtttatgtttttgtttatatcacccctttccactacttgtctccctggtaaattcttatctatttattcttcaaagcccagttcacatgttacttatatcaagaacgctttctgggcaaaattaactgctcttctccagcttttgtataaattttattctataatagcacttactaagttgtattgtggttttgtggaggggggtaagtgtctccttaaaaagcagtcagctccttaagttcacaatattagttaatgccagttgccatagcaaaacaactcagaaatgtttaacggctcaaataggaaataaatttatttcttggtcccatacagtcccaaaaaggttcccagttagccagtggccctctgcaagtaatgatgtatgctccttccatcttgtgactctaccctcctgaaggctttttttttcaaggttgcatgctcagctcgatcaatccagcaggtagaaaagagcatggaagggatattgcatgggaggttttcatggaccaagtcttctgttgcattggctgtcaattcagtcataagtcacccctcactgtagggtgtctgggaaattaactgtatgcccagcaaaatagaggaaatgggtttagtaactagatagccattctctgatataggcagataccagattcatcctcacatcctcacctctagcacacagaaggcactgaatatttatcttacatatagttaatatctttaaagaggcaaatagacaaacagatgagtaagagaaaatgaagtagtagatgtccatgtcctcttttaaattggtgcccccttttttctactgtgctgtgattttcaaaatgtagtttctaggcagtttccttataatgcttttgttgaaaatatagccaggtgcggtggctcacacctgtaatcccagtactttgggaggccaaggcaggcggtttgagactagcctgggtaacatggtgaaaccccatctctaccaaaaatacaaaaaaaatagccaggcatggtggtgtgtgcctatggtcccagctacttgggaggctgaggtgagaggattgtttgagcctgtgagggcagaggttgcagtgaactgggatagtgccactacactccagcctggtgacagagcaagactctgcaagaaaatagtaagaaagagcaagaaaatataatagcatgttatataattcgcccatgacaccaaaggaaaacaaatgttatattactacttgctcaaaaag

SEQ ID NO: 130231 - DNA, 1434 bp, Homo sapiens
tggggcttcatttcagtacttgtagcaaggacctcatgctttcgttattaattaatgtttatccttttgttattaattactgtcatgacacctttgctacatgttaggcacctggatagagaagagtttccaggttctgtattagtgcctcttcaacacttgtcaggatgccgaagctagctacttttaaattttttgtataaactaggactgactcaaaaaatagaggctttcatgtagacctagaggggcatgaaagaatgaagagctgtttggttgaaagatatgaaatatttacatcccagagataacctgctgtaattcatcccattttctgttgtctcttaatgttaatattttatgcagtcattcacaagtgttagctctatgaaagttgatctcttaaaaggcttaattataaagtgtgaattaatatattttatatgttttatgactagacactacctattgcattaaaaaactcccacggaatcctcagagagaagaaattataggaaatggagagcaacaatatgtttatctgaaagatggagatgtgattaagactgagggagccactctaaggtaagtaaatgtcccttagccagggaaggtgaagagtctgtgtatgtgtgttatagaaaaggatggaaggatcccagcattttgggaggctgagatgggaagatcgtttgagcccaggagttcaagaccagcctgggcaataccaaaaaaaaatttaattagctgagcatggtggcacatgcctataatcctgctattcaggaggctgagatgagatgattgcttgaacctgggaagcagaggctgcagtgagtcaagattgtaccactgcattccagcctgtgcaaccgagtgaaaccctgtctcaaaaaaaaaaaaaaaaaaaaatagaagatctgtgcatatgtgctggtatgtgtaaagagtacatcaggaaggatacaaaagaaatccaataaacattgcttactctgggaggagaaaatgagttgcttgagaaatgagaaaagaaagacttcactctttattaaattgtttatttgaatcatatgattaccattgttttaaaaaataaaatttacactttaaaaaataagtgttgtctcccaaggaggcttagggatctacctatcaattcaattcagggctttcccatattctcacttcccaaagatgacccatacctaaattaaataagttttaggcctgaccgatcatacctcatgacctatctgagggtttcaaaatggtatttcaaactcagttattgtaaaactgaactcctctctcccccacaatctgcacctgttttctgatctcagaacatccacttttctcagtatgtaagactttactcattcttctaagacagaggcttcaggattaccttgcactgctcttcacctttac

SEQ ID NO: 130232 - DNA, 1127 bp, Homo sapiens
atatactgagatatgagatctcaaaggcagatagataaaagcacatattctggcatcagaatacctgggtttgaaagctgtttctgccatttatctgtagagtaacctgggcaagttacttctaaatataatgataaaatatctactttaaacagttgttacgaggaatgtaattggtaaaatatgtaaagtccttggaatggtgccatgtttattttaattgctatgtaaatgttcaagatgactgctattattccttgttcagacttatatttagctctaatttttctcagaaaactttcttagggtgagattactgtagttaagctgaagtgatgtagctggtttttgtgcatgttaaaagtaaaataatttttgcagtttctttaatgtaaattatctgtgtgcaaaataatgctaatgtcaacgcagtgttccaattgtgtgattatcttccatttaattttcaggagaatcctcattgacactggagaaccagcaattccagaatacatcagctgtttaaagcaggctctaactgaatttaacacagcaatccaggaaattgtagtgactcactggcaccgagatcattctggaggcataggagatatttgtaaaagcatcaataatggtaaacagaaaacattcattaagctcattgaggaaagccgtgtttggagaataatttatttcagttacagagctaagtagtctataaaccatttactaaatacctcagttttaaatggtacttttagaaattgattagactgttgaatactgtgcctagttttaacaaaggaggaacggaaatcctgatttctgtttcaaatcctcaattttactttagtgtgtgagttactattcagacttaatcataactaacaactgttgagcatttactctgtgccaggcactgcactaaacaatttatgtggatactgtgaggtaggtgctcttattgttcacattctaacagattatctcagtccttctgtaactttaaggcagttactaagatatgctgaaattcaggcaatatatcattgtattgataattcattgtccctgaaacctatacagtactgacattttctatctctttatttcctcatcccaccatc

SEQ ID NO: 130233 - DNA, 2633 bp, Homo sapiens
catcagtcttatcaggctcctctcaaacctctcccactccagccatgctggccttctagtgtctcagatgaggtttgtgattccctgtctcagggccttcacgcatgctttcctctttcttccactcattcctcccttctttacccagctaatctcattcatcctttagagcacagtttaaataccatttcctcatggaagtcttccctgacccatcagactgtattagggacactccatacttttcatggtccttatctcaatgataatgaaatgatttttttgtgcaagaagcttagtgtctttccacaccttcataccccactataacatcagttcagtgaaagcatattcatggctatatccccagcacctagcacagagccttgtacacagttcaggtagaacagtaaacagttgctgaatgaatgagcattctgtacattttctcttaattttcactattatgactccagaactgctggataactacagttttagctggtcttccttcctcatctgatcagcccatggaagccaaatgaatttcactaaaacactgctagacctaactgtgatgcttagtacataggtactcaataagcatttgaatcaacaaatgacagccaaattgtccagtgtttttactttcctcctctgctcaagaacctttaaaaactgcaattttaacctttcctatcaaaattgtacatactttgtgggcagacagtgtggctgataatagaaaaaggtagtcaagtggaatagaattaaaactctggactctggttacctcgattagaatcctggtgccatttactagccatatgactttggacaagacagttctaagcttcagattcctgatacaacccaatgaaggttgtgtagtacctacctcattggattttataagggctcagtgaaatttaagtgaaaaaacgtatatgaaaagcacttaacaagttctagcacgtggaaaacataccatgttagccattatgtttatcacttctgctttcctcataacatctagataacactgtgctcatagtaggtgttcagaaaatatctaatgattttataagagtgacagcaaatagagaccagttaatagctatcttaatattgacatgaaatacctataacaaggaatttgattctactaattttccatcaattaaaaatttttttctccattcatgtagcaaacagttattgtgtgcctactatgtgccaggcactttgctctagtgaataaatcgttcatagacctatacagattcatccatactcttcccttgagcccttcattagcataatttgcatttgcaaaatgacctcctgagatagggatattattatctgtggccaagaagaacaaagtcaactagcccatgtagagatgatactatccaatcatctattataactatttacagacatcactgatagagtaactgtttgctaagggagaaactgataacatttttttcaatttcaaaactgataacagttttttcaaatgtatagctgaagttttatttttgccacataatgattctaagcacttaacctaagcaatccccttctgctagagaggcagtgttttgaatggagaagtcactggaccttgtatctgaacatctagtgcttcctagcactgcctcttgctggttatatgacctggagcaaatcacttagcctttctgaagataagttttctataaaataaataattaataaagtaataatacctccctagagttgatatgaggatcaaaagaaatagtaaatatgaaagccccaaatggtttaaattgctatgtcaatgtcatatgttatcagtgtgactttttttttccctcaaagcttggtgcaaactcatgttttaggttttatagtatctagacacccctcctttgttctgaatagattgtattaattccagaacttttttctgttttctttcttttgagagcccttcttttatcaattccaattttgttaaaccaagacaggaccattaagagacctaaaactggagccccagaaacatgttctccactaccacagtcgtatggtcactcacactttcacctgcaaacaaccagcacaggcattctaaaagatctgttttctttgctactagattttatcaaattcatgtatcaaccctgttaattttgtcatgacttttgatcagtgtgatgtgatctggtcattaaattacagaaatttatattcatttttagattaggagatatttcaaaacagagtttcttgggaggacgggaaggcaaggattaagaaataattttaaaagtggtggggccttgatggattgaaaaaatttgagccttacctgaagcatggaagtattctttttgtgaggaccagaagacccacaaaaatagtcccagtgactctacgttaggggcagtgagaatttgtggtaaataactgcaaatgcatggaggcagccaaaatctaggatgggtgggctagagagtattattggaggtatcatagtattatagtcttgtgtattttaatttagcataactaaatatgcacaatgctaagtgcagtacaatgtattatggatatagaaataaatccataaattcctt

SEQ ID NO: 130234 - DNA, 1916 bp, Homo sapiens
gtttactttgctcacttgactttcactggtgttttgcccagagtgtaacttcccttctcaaaagcgattaattatgttgaggcgatttcctcaactcagcagcagagggcaggattctcctggcttccaaattggttctctgcagcctgtgggctcataagaggagctgacataagtaatttggggaagttttttgttacaattgtgtgtgaccttgtttgagtttaatttgcagacacagtaacacacctgtatttctaagaagatacttttgctcttgtttagctgcattctgttttagtggaattatgcaggaatgggagatttggtttactgcatagtaagtcttaggcatttagcaacttttgtagtctttactggatgaacccagataatgtagtttctcttgagcatagaatttaattgtgcagtcaagacataaattatttttaaaatataattgattactaaaaacgatttagtaagtacagttaattgagttttccttggaagtgtctactgtttggcgtttttccagtaaataagaattttagaagcagcagacctgcaaagtgggcaggtaaaagattaagttcagagtaaataaggcagggtcaggtagttaccaaaggtttaggctgccaccagaatctaggaggatagagaattaagcaggaaaaatgccagatctctagggtacagtctgtcttggctggaagtccctcaaccaagtaaatccataggcggtctctctacagtgtgtcatcttgaactagtcaatacctcagacaaaagatgcatattatcagaattaccctggaaagtctcttagaagaacaccatgttggagatcagtgtattgtctcagtaagttcagcacaacctgccttttttccagcgttgaaacagatggctgattctgtttgaaaaccaggtgaagaaattggcttgtgttgaggggctatattgtatgaaaaatacatactgtatctttaaacactataatcacactcaacatagcaaagtgctagtgctaagagagacttaaagactaactgagggaaaagcagatttatagtctctcgtcttaaattacttaacactgttgctcacataaattaatggagtggaatggccagtggaattacttgcactatgtaaattatttctccatatagttgaactagagagtccgtatagttgagctagaaataagtgtagataatgctactgtataaagtaaaaggtgtaaagtaaaaggtggctagaagttaatattaattggccccttgtcagatgttctgagattggtatccacctgttccgcttcacaaaacagttctaagatcacaagcggcttttgtatcactaaccccaatggtatttttctgttctcatcttccttgaacttcagtgctttgacaccattgacgactccctccttaatttgccaacaccacattcttcaggtttcctattacctcttgagctgctctttctctttcaccttgatagagtcatcttctttatcaaatctttaattattttagttattcagtatataatcctcatctctcatgttcttctactgtattctctacctaggtgatctcatctacttatttggctttgcctttattatctgtttattattaactaccaaatatatagctcaagttcaaattccaaacttgatcttcagactcaagtagccaacttttaaatctatttgcatgactcactgctgcctggaactcagtgttttccatactgaactcataacctttccagaaaactgccaggtcctccttcagttgttcatatcttgataaacaaagccatcaaaggaaatgcctaaatacccttcctgacatttatttgcttcctactgcatatccaagccattatgaagatct

SEQ ID NO: 130235 - DNA, 1032 bp, Homo sapiens
gaatagacattcaaatctgtaatcctggatttaaaaaactgaagttgtactttatggtatttcactgaatgcatgtataccctttatttttgagataagattggggaagcatttgtagttaaacggttgtggaagtgtatgtttttgtatatttaccagcttttgaaaatggacagatagataagctatcactaactgatttaggtgcattgtgggcaggcatcaagactgaaggtggattgtcacagtctcagtcacctggacagacaggatttctcagctatggcacaagcttcagtacccctcaacctggacaggcaccatacagctaccagatgcaaggtctgtatatacacattgctattttccttaaccctgtaggttgatagttaacttctaaagtagaacctgatgttccatgtaaatagtaaatgatgatggcaactggattgggcttagaggcaggacacctgcttctagtttgattcatcacttacctattttctaggcctaaatttccatatttataacatcagggggttagactggatgatctataacattctttccaaaaagcactaagattttttgtgaagttgacatttttgcctttgtgtcttctgtcagttataaaagaaatgaaaaagtcaaaagtcagccacgtaggaggttgtgatatggcatgtactaaaaacttacgcacttggtattaccatccaacttttccaaaagggctgtattctttattttcattatgaagtgaagcttggggagtgacagtcatagctgtagaaataaagtatgtgataagtgttgaataatgatctcccaaagaacagcttgatcagatttacagacacccagtgaatctttaagaaaatgcttgtaagaatcagtccctgggttctgtttttgaaaatatagacaaaacataatgtaagtacaagtcaaatggaatgacagctgtcattgtcaaagctggtctcaagaatacatagacattacttaaagttagcacattgttatcttgca

SEQ ID NO: 130236 - DNA, 1036 bp, Homo sapiens
taagagttcatttaaaactagagcccttaatcagtttctattcattcctctttatagtttaactttctgttaggtggaaccatatgaaatttccatctccgcaggtcacaaagaccaaatatctgaaatttcatatggccaacctatagttgaaaatatgtcagtgctttctatatattttgtgttttgcttggattattgtgcattattttgttttgtttttgttttccagcaattgggagcagtagtttcagcccacgaccaactcaccagttctctccaccacagatttacccttccaagtaagatgtattttctcttaatcaataaataacttctctgagtagacttttatttatttaaagtcatgtctgtgcccacatgttccatcttaatttaaatgaaagtgcatttcatagagatgtaaacatattgatacaaatttattttgagcatcatgtagtggagacactgaagtatttcagtgctttgtcaattctgtgtgaaagttttactttaagatacaatatttagctggaatttgtgatgtggttgttaatcggtttgcatgtttccatctaatgcatgggctttctattttctgtcatttctgacaaatagcagaccatacccacatattctccctaccccttcctcacaaactatggctgcatatgggcaaacacagtttaccacaggaatgcaacaagctacagcctatgccacgtacccacagccaggacagccgtacggcatttcctcatatggtgagtaacctgcaactgtagtggtggcgttatcgcatgggcatgcgtgtattaacatgtttgagtggtacttaaagacccaatctttggccaatttagaacgtgttgtcaccttctgtgtctaaattcttagtatgattgtttctaaagagcattataagaactggtagctccttatcttgaggtcagaggtagcgaaaagattatgtggttcgtatgccttcttgctctcatttttctcgatttacatctcaaccctgaatttgcca

SEQ ID NO: 130237 - DNA, 1057 bp, Homo sapiens
tgcctcagagactgtctgaccttgttgcctgcccgccttgcttactgttcttcctcccatgtggtagacatgctccccacacagtgtgttttttgctggcagtcctttccctgtacacctgccttactctccctaacttcgtctgtgttcaaatctcacctcatcgaggcccaccctgaccacttgactcggtgcagctctgctgttctacttctgttctaccggatcaggttactccccactctttcctgccaataattatgagccttttgcaaatgctgtcattttcttgtgtattatgtttagttttggactctcaccccaccaaaacataagcttgtgttggcagggattctgtcttgtttggttcacttctatatccctgacacctacaacagtacctgccacatattaggcactcacatatttgcctaatatgtgccacatatttgaattaaagaaaacatgaatgaacgaatgatggcttctactttttcctccgaagtgactcaaaataagagtagtgataggcatgtgagcttgaagagttggagaagactgaaattgatgtagtggatgctggggaagtctgaggctgcctagaaacagagaataggatggacagtagagctgaaggttgaacaaggctggagctaatgaagatgggcctgtatggtagagtgatttttctctacaagggcttagcagaccatgtgaaaagatgctgggcttgatccagggtcaagggtttgccagatagagcatgagagaatatgaaattaagaaaattgagagtatcagtaaaggaatggtttaaaataatttttcatgtattcaagacgggtagaaagaagaaggtaggggctaataccgtgagaaaagatagggatgtcaggggttcttcatctcttgatgaggttggagaacacatgaaatgagaacaaaggaatgaaaattctagacagaaatgatattccttacttaaactcagtgaggccttcaccacatgcctctgtagttagttccgcacccttcatcactacttatgggattaatc

SEQ ID NO: 130238 - DNA, 1015 bp, Homo sapiens
gtgtaatgagaatcaggagagaaaaattggattttagaccatttctagtttgaattcagaatatttggggaagtcaaagctcactttagaagtaaaatggttcatgttaagctgttttaaaaactgatacccatagtcaatgtaagtgcgacctctaaattaaaatgactgtagcttttattgacctgatagggtgaggagcaaatagtattaactttatatatgtaaacattaaacctcctcccatcttttttcttagaaaaacatacaaagtttaaaataaagtaaatgggccctaaacttttaagaaattggctgtaagaaaataatggaatctaagtgtgtttttagtgactttaaataaattctctcttcactaatagggtattaaatataaatgtatagttctgaaattgtgaacatgagtagtggcttttgtaccttttatggaataagtaactgcagagtctaagaactttcagagggcatttaactggttttatatggtaaaattgcaaaattatagcactaaagtagaattgttgttatttcccagagtaagtgacagctgaggtattccgagtgctaatgcttgcagggacccactgtatgttggccttatcctttttcaactgggcacactgtatgtaatccacaaagcaaacaagtgagccgacatcataatgttttaatgctgcatttgtttcaagggaaacagaggaacaattaagtagtttgccagagtaaacacatgcatcaggactatctcattccctgtcactagactataggtttcaagtgttttatttggtttggagacccattaaattacaactgggtggtaaattataagggagtacctagtgctaatttattagatgaaacagattccacagaagagtgatctatttccattttacttctttacatagttgccttttcttttagaaaagtaatgcctttggtcctttttaatataaaaagacaacgatgactgtattttttctttgaaaat

SEQ ID NO: 130239 - DNA, 1046 bp, Homo sapiens
gtaccttaagtcttgtttgatgatctctcaaagcaagtttgccttctggaaataatttctggggttgaagagcatggtattaacagatttaatgtggctattcaatggattggcgaagtactatgtgaggtttaacaaaatgagagagacaaattgaatatcaacaaaagttacatctgtgaagaattataaatttaattagaaaaaaggcaaacttaaaagacctcattaactaatcagaagtcaaagttactagtttaggattcttgaatttgaattctaagaagttctgcttgttgctatttgtattttcacaactctgtcaatatgctactatgggtattctatacaatgagttttaaaaagcattaaagtgaaatgacttgattgtaatataagatgaccatttgttatgttatgggaaatatttttgcactcatagaagtatttaaattaaaaataccagattaggagaagacaagaaacatgctaagtttatgggtgtaaagcagaaaatgtgaacttactgaatgcctcacatcacttttctagaaacaataaaaaataatatttttctcttttgaatggaaatatccctaattaattattttcaaaacacattatggttttagacctttacaagacagaaacttccagagatattatcaaacatgagaggaaatcaacagcaatcagaaataggtgttctttttagataagtcattataagactatgtttccttctgcactgtaatcttgtactacacataaaaaactaaaagcatgtgaagtgtagcattttgtaaactgtaactaattttgctcacatctgtgtctaattgttgtctgcattcgcattcttgagagtagatttatttttcctggaccacgatgtggattcagctgaccagcctaagtgaggattagttgttttaaagttattttgattaaagagtcatttttaaatacagtaacacacaacacatggtttaaataatccctgagacacaaaagagtatatctgaagtatacttaatgaaatgtag

SEQ ID NO: 130240 - DNA, 1056 bp, Homo sapiens
gggtagggaaatgcagggaatatttgacagagtgtagaaatctttcctggagcgtttgaacttgaacttgactctaggatcgccttgccaggtgaaggagaggagagcgacaaagaggggcaaagagatggaccgaggagagccaggctagctctctgcaacgactattgatgacttgaagctatcagtataaatatatagtctcacacattaggggcaggcgaataggtttttaaaatctgaattgtttatacaggtgcagaacaaagtctttctttagaaaagattaatggtgaggagagcgctagatttctctaaacagtcacaaaaactatacccagcctcaacgctgaggaggtcatggccagtttctttatttcttgaagaaatggtctgaccccaccagttcgggcttatttttcacagcactcgcctttccctccctgtcttctttctctgtcttcccctccctccctacttccctccctttctcttctactccatctcctcaccctccctctgttcgctttcaagaaagtcagctattttattttgtttgtttcatcatctttcatttaacctccatttctttcatttttgtgaaattaagttatattttcacttgtaactctgttttcaagttgcagactggtaatgaaggttaggaaatgtaccttatatgcattttttataagcatataactgcagtttgctttaacatgtttgtaatatctggcatttggtcacctccttccactttcaaagtgctattactttttcttctccttggatgattacaacagcttctcgagctgaacagtgtaagtataactctctcttttgaaagcccagtgtttttcatggttttgacaagtgacatactgaaatgaataatacagcctttatttttatcttataaacacactgaaatcaattcctatttgcttatgctttacaaactcttagatgtgaaacaggtatagactgtttgtgtgtacatcaatggtcttgaaattctttagtgacatttaaaaaatattcaatggggtgagtagg

SEQ ID NO: 130241 - DNA, 1035 bp, Homo sapiens
ttcttttaacattatttaattataaggacatgtcatcatttatcatagtctttctgcaggaggaaaagcctccagtaggccaattcaaagatttgatgagacatttatatgagataattttgttacattgaatataaaataaagactagtcaaagacctatagatgcttgggcagtaatcagatggcagtcaaccaggtgaggaggtaacagatcttcaatgaaattccatcagaaaaattgcttgatcattttatcaggatgctaatttcttacattgtagagaaagtttccattccaggccaagtttgaattaattgggttacaccacacaaaactctgaagagaatagagtgtccactgacatgtcccaaaattcttgcaatccaggtaaaagaaaaataactggaggagaaaaaaaatcccttcctgctttttctccctccctccttctttctctctcttttactctcttccttcttccctacctctcttccccctccaccatgagcactttctaatggctccacaaatttattttcctgaaaatattagttaacataacttcacttactacaagtcagaagtattaagtgaagctatgataactagtatctataattcttattttatttataattccagaactcagtattgccttgattgttgtgatgttgaaatcatgattatttcatctaatggggaaattagttagtacccacaatgtgcaagattttgtgccagattgtgtgagagaaggatgaataaaagataaacagacatggtccctggtatttgaaaacttaaactctagtggaaggcaagtaccttatttggaaatctgcaaaaattttgacaattattctcccctttttttaggtcttgcttgagcatagaactattgatgttaatttggaaggagaaaatggaaacacagctgtgatcattgcgtgcaccacaaataatagcgaagcattgcagattttggtttgtatatttgtcatatctgtctgctttctttatcttttcatgaata

SEQ ID NO: 130242 - DNA, 1181 bp, Homo sapiens
tttcattttaaataaccgtgttgttgttccagtcaaggttgcattttacaaggaataaggaagataaagctgcctcctcctatcctaatctcgctcctcgctcagtatggagtcgtccggtttacctacaaagccctgccctagactggcggcaaattcaacgcccagaggcaggaacaggtgtcggccaatcagaagccggaacaggtgtcggccaatcagaagccaggcttgaaccgctcgcccatgtcccgccggcggaagagactctccgcggccacgccccgagccctcgaatgcgagccaatcgttgctcggcgcctgaaggggcagtacccaagcgagccatttaacatggcggaggatgtttcctcagcggccccgagcccgcggggctgtgcggatggtagggatgccgaccctactgaggagcagatggcagaaacagagagaaacgacgaggagcagttcgaatgccaggaactgctcgagtgccaggtgcaggtgggggcccccgaggaggaggaggaggaggaggaggacgcgggcctggtggccgaggccgaggccgtggctgccggctggatgctcgatttcctctgcctctctctttgccgagctttccgcgacggccgctccgaggacttccgcaggacccgcaacagcgcagagggtgagtgcagaccgcgtccgggccgggactacgcggggggcggatgcgggctccgtggtgcgcggcagagggctggttccctacgtcgccgagggaggggctgctgcggccgattagctgggagtccgaggctccgggctgaactttgttcgaatcccggttcgcccgttgtcagcacctgagtttttctcagattgatttcctcttcgataaaatgaaaataagaccctgtttaggtttgatgcaagcattaaatgagttaaaatgtatacagttccactcaacccagtacctttgtctcttttggcgctttctactcaggtattcctgtagtaatattcagcagtccctgtggcctccagtaacccccgaggcatcagtgttttatgttaatttgtgagctattaaatctcatttggcctgctggctctacagcagttacttttattctgtgtagtctcagaataaaagtaaatgttggccacatgcctgcaagtcccagctactt

SEQ ID NO: 130243 - DNA, 1008 bp, Homo sapiens
tgtggtccaggagtatggcttacttggtattgtatgtaatcactgcctgactcaacatctgggtgggcattcaagtttggggaggttaatattaataggttttaaactttgtaagctaaacagactcacttaactgaaacctagatagaaataatataaaatattttctattatatgaaatgtttctaggtataagtttccaaccaatgattttacacattttacaatttgtatctaaatcttttttgttaatgtagactgctacttgtgaaagaattttcaacaatttttattctacatgtgaaagttatattttgtaagaaatgtcttcattgctattctttttttttgttctgaattttaatcagatcttaaatgtacaactctaaatttatgataatttttacaatatgtttgtagcctattactcaacaaaccacacagtggcactactggatcaagtttgattttaataaaatttactttttttcttttttagctattattcatggactatccagtctaacagcttgccagttgagaacgatatacatatgtcagtttttgacaagaattgcagcaggaaaaacccttggtaaatatgtttttttattttatattggaaatatttcaatctgtttctaatgtaagacaatgggaagaaacagacgtttttgggggaagtttgcctacaagtgtctggtgcataggggtgtgggggggtggtgtgtgtgtgtgtgtacacatacagtcatatctaaagcaagtaaaagaaatgtagtccctgtcatcttagaacattggttctcaaactttagcctgctccagaattacttaaagggcttattaaaaaaaaaaaaacatagtgctgagtctccctaactctcatgagtttcagattcagtaggatgggtatggggctctgaaatatacatttctaataaattcccaggtgattctgatgctactcttggggaagtgtgtttcattgactctatttgctaactt

SEQ ID NO: 130244 - DNA, 1074 bp, Homo sapiens
gaaaccccgtctctactaaaaatacaaaaaaaaataaaaataaaaagttaaccacgtgtggtcctctggagactgaggtaggatcgtttgagcccaggaggttgaggctgtggttagctgtgattgtgccacttcacttcagcctgagtgacagaatgaaatcctgtcatgaaatttagaaattcccattccagcaggtgtagctaaaaaataataatgataattaaaataggtggaattaattttgataatcttatttaactcaatatttctcaaacactatgtcaacaagtagtcagtgtaaaaaatgttagtaaggccaggcacatggctcacacctgtaatcccagctctgggaggctgaggtgggtggatcacttgagcccacgagtttaaggctgcagtgagctatgatcacaccactgcaccccaacctgggcagcacagcaaggcccccatctcttaaaaaaaatcaaatgagatattttacctttttttggagtaagtctttgaaatctcatgtgtactttatacttaaggtgcatctcaattcaaactagccatattttagctgtgcagtaatcatgtatggctagtagctgtgcagtaatcatgtatggctagtagctaccatattgggtttagtctcctaccccacataggtttgacaagattggacatgtttggggtgatgtggctgtagacccccacgtagctctgaaatacagcagatatcttaaaggggaaatgcttgtcatcctcctcttatggaactttaagcttttttttttttttttagccagggtgtctctctggcccaggctggaatgcagtggtgccatcatagtttattgcagactcaaactcttgagctcaagtgatcctcctgcctcagcctcctgagtagctaggactacaggtgcaccatcaggcccagttaattttttaattttttgtagagacgaggtctcatgttgtccaggctggtcttgaactccttgccttaagtgatcctcccgcctaggcctcccaaaactctgggagacttaatgtgcctttccactgcagcctatt

SEQ ID NO: 130245 - DNA, 2564 bp, Homo sapiens
taattagttatcagctgttgtgagtctttgttctgaataacttgatcacaactcttttaggaaagcttaataatagtacaactattatctcattatatattcacataaattctgtgagatagtatttattctcaccattttataggtgagaaaactggcctgtcttgaggtttgttataatgcattagacttaggaaccacttaagaattctgttgctatgacatgttatgtaaaatagtttactttcgttcttaaaattcatgtttttgtaaagaaaatcttcaaatgtttgtaatctcatcaacctttttctatttgaaattgatcttaatgagcaaattaacttagaaaataaaatcacttctaaactggtataaacaagaagagtacctagcacatagtatacactcagtaaatatttaaaggaatgcattattaaaaactgacaaagttctacttagctttctgagttacttatttttgttctgtttttaaaagatgcacagtttgaaaatgatgaacgaattacacccttggaatcagccctgatgatttggggttcaattgaaaaggaacatgacaaacttcatgaagaaatacagaatttaattaaaattcaggtatgaataaattacttttatgcttattatatttctagaaaataacatttaaaagaaattaagaggaacctagtagaagttgagcagtagtaaaatttaatgtattgtttctcttcagaaatttgacctttggtttatagtcttaacatgagcactgggggctggaacttaatgtgccatacttaagcatatgttgcctctatgttgtggaaaatttaaaaaccaggggtttgtgcactctcaattgatgcttaaagattatgtaaaaagtagatactatttttaattaatggtaaattttagatttttgtaatcaagaatatataaaattttaaccaagtagggagaattttagtagacagtaagtagcccaaaacgtcattcaaagatacaatagctagcagtcaaagcaaatactaggtactttcttagttaaataaactttttctcttttgagaattttaaaaatttcttttcaggttggataaaagaaaatccaagtcattccccaccttcccaagaattagtgtggtgattgtcaagtagaattaggacctgaggaaaagaaaataggcagaaaaacgactgcttcctttatgaattcaacccagagcaaagagatttgtcatgttattgcaatcttttaggctgctagagaaagcaagtctttcttaatacactactgtaaaatcaaatgggtgacaaagtttatagcaaacatttaatatattccttactatttgccaggcactgttctaaactctttcacataaaactcttacatcctcataacaatcctatgaaataggtactattgtttccaccattttacatataaggtaactgggacaccaagaggttaagtagcttaccaagtttacatagctacccaaatggtaagtggtcctgtcttacttaccacgttaccaaaaatgccaatgcatgaaaaaaatgatcattaaaaaacatctagcttcttaggtgtgtattagatattttccagggatctgactagcaaattttatgtatcctaatcatcacaaacatcatctacctcctctcatttcccttttactcaaaattaatatttaggtgggtcctaaatgtgtgtggtatggcttctaatttatttattaatacatacttttcatttggtctaaattagagatagaatgctgggcatttatgaataaatgtgcatgggaccagtgcaaatttttcatgtcatttcaagcgacacttattttgtctttgaaaaataattttatatcttttatcaaattaaaattattaagctacataaaaatgttctcaacagaggatttcagacttacctgagttatcttaataattaaataactattgggtatttataaacgcagtctaaggttggtatttttcatcttttaggctatagctgtttgtatggaaaatggcaactttaaagaagcagaagaagtctttgaaagaatatttggtgatccaaattctcatatggtaattatttaaattaaaaccatagaattttagaagtgtttatgtagagtgaggaaaactgaaagaaaattggaggagaaaagaaatgctttatcttttaaacagtatagaataataccgtgcaacagaaaaactacgcaagtcacatatgtgatttaaaattttctaataagctggacgcagtagcttacacctataattccagcactttgggaggctgaggtgggaggatctcttgagctcaggcattcgagaccagcctgggcaacatggagagatcctcatctctccaaaaagaaggaataataaataatgaaaaataaatacaattttccagtagtcatattaaaaaagtaaaaagaggcccggtgcaatagctcatgcctataataccagtactttaggaggctgaagcaggaggatcatttgaggtcagtagttcaaga

SEQ ID NO: 130246 - DNA, 1050 bp, Homo sapiens
aaaagaatacgcatcgtacaacactatttgtagagttaaaaccatgctaagcaatgctacatatttgtggatacatacatatgtagtgcaagtaaaggaattcctgggaatggtgaattctaaattcagggtaatggttacagttaggagaggaaagggaatacaatcagattatggtagtaaacagggattttaaccatattgattatgttttatttctgaaactgggtaatggatactctggtttataatacatatctttttgaatctgtctaaaatgtaaaatattttttaaaatgaggagaggccagaagaagtcagaaaaaggtacattggcatgccatttaaaacttaattttaaaaatatctgtgtctcttgagtttgtaaagtgatttcttttcaattaaataatatgtgacaaaaatcgttgtatctgtaactttgtgtgatttatgttaatatatttcttctgttttctttagcctttcaaaagcaaattgcttatgataatctctcagaaagatacatttcattccttttttcaacacttcagctacaaccacatgatggagaaaattaagagttatgtgaattatgtgctaagtgaaaaatcatcaacctttctaatgaaggtatacatattattcaagagtgactaataatagacttaaaggaaacgttataataaaggagaatacttgaaatagaaatcctttaaaattaatcagaatttttcattgtggttttgtagaaaggtgtggtaaaatgttacattttgtggacctaattaaaagatttatgagtgatatgtacttttgtaacttttcaaaattagtttggggaaattttcaaaagaaaaagttgaagggaaaacttagaatgaattaaaaataagaaataggcaaaagcaaatattttaatttaagtaaattttaaagactttttaaacatatttttggggaaaaatagaattgtattaaagaagggccttttaaaatttttctaggccaggcgcggtggctcatgcctgtaatgctagcactttggga

SEQ ID NO: 130247 - DNA, 1920 bp, Homo sapiens
aataacattttattttctgtcttggcctccaaatttttaagttgacagtgttatagtggagcatcttgattgatttgagatagtttttatttgaaaatatctagaatttttattttttttttttttcatgcagccttttctcttaaaattgcctagagagcattttgtctatcaaatatatttacaaggaaagaccaccttcgtaacgctgataaaccaagcagatagctaatgtagctgctggcagtgtcataattattggtgaaaataacaacacagtgcccttcattggcctgtgaacagatacattagctatgactatcaaagaattacaaggcttaatttaatgctatttgtttaaaatggcttaatgcatttcttcctatccttctacctccacgcacgttttttaaggcagcggcaaaagtagtagaaagcaaaaggacaagaacaataacttctcaagataaacctagtggtaatgatgttgaaatggaaactgaagctaatttggatacaagaaaaaggtttgtaatttaatcaatttgtatattttttgttttatgaatgttctgtctttatgtaaaattgatatgtctttttattaaaaataattattgagtagcatgttatcttgctgatgattaacatttaggtatttgaagtactgtagagttatttcatgacttgtgcaaattatatatgctaagcaaaagtagagaataagaaaatattacagtttaaataatgtggatagtttaccattcttggggtatgcttaggaacaagggtgaggttggactcctgtgccccttagttgtgtttagattctacatgttctcattatgtgattcatgtttcactgtactaagagtctagtattttaagatattattcatatatcttctctaagcataagctcactgcttcatctggtgctcaactgaagaaatagtgatttgctttaatactggaggaaaacaagttgtgtcagtcctatatattgagagatagttgttaagtctccaaaattattttttctttagggattttcaggggtgattgttgtcttttgttttagaagcttaagtatcttcccctattgagaaagatataactcttaacattataaagatcttcttttctgttgaacccatggtctgttttctctgttcttctacccttaaaccaaggccagataatcaaatctctgtggtctctggatgggtatatttggaaatggatgtaatattactttcttcttgggaccatgacctaagtgttgcagggaccccatcttaactacttatttagaggtggagattggggttcaagttggatctacactgcatttgtcacatcttaggactgaggttctgtcatcttatagtggcccctcctattgttcctgcctgtcaaagcatgacttgttcctcaggggttcatctctccaaaggctgtactaaagtcttatttcacattgatgtacttttttctaaactccaatttaagaagtagagattccatttttattggcccaattacttccttttgtttcaaaaatcaaagttgaatgatactaatacccagtacattcttgtggccaagccatcctgctcatgataatattgctaataccatggttcttacagataatcatgagcacacttcctatggactctccttatatagtgctacccacttatttcagatgctctcctagacacaaacacagtgcaatccatgtgtaccaaacagaactcttcatgttctcatttgcctctctacaccctgcctctctttaacctcacacatccagctgctctccaagtattaggaaccgcacctcagaaatgcttctccaatctatttttatctatatagctttgtaccattcaaatccatccttgacataacttc

SEQ ID NO: 130248 - DNA, 2456 bp, Homo sapiens
ttgagaccagcctaggcaacatggcagaaccttgtctttacaaaaattaaccagtcttggtggtgcatgcctgtagtgccaactacttaagaggcttaggtgagaggattgtttgagcccggcaggtctgcagtaagctgtgtttgtgccactgcactccggtgaccctcggcgagaccctgtcaaaaaaaaaaagggggtgtaatatttgtatacaacctacacacatcctcccatatactttaaatcatctctagattacttaaaatatctaacacagtgttgaaatagttgagatggacagcttcatggaggtagtagtcttgaacaggggcttttgtaggatggttaagatttttacagatggatagaagaggaaatatcattttaggagagaggaatattactagtgaaagcatggaggtgtaaatagtcatgctgtgtgtatgtggaaaccattttaactataacaaacgggaacttaatcgattcccaaaagttcaattggagactggtggggagaaccagaaattaaaattgaacccatcaaattgtatactttaaacatgtgccatgctttttatgtatcaattataccttaataaagcagtttttaaaacttgaattcatggaaataaagtgccgtagaagagtttttgaaagagtgttataaatgcttgactacaccattaattatgcttatgtttggagaaacttggtttaatacctcttataagcatgtctggacaagaattagccatgttgtaatggactgtatatgtcccgatgttaccaaggtttctttccaaagttatttttttataaattgaaatatgccttgactatgtggaaagtactatccttatgaaaagtttcttttgtttacattcttacaaattttttcttcttttaaagtgttagtgacaaacagtctgcggtaactgaatcctcagagggtacagtatccttattgaggtgaagtaaattgacgtttttcttctttgtctttcaaatctttgattgaagcaattcatgcagacctaataaaaactaccacataaatggtacaattgaaagaatatctcagggtcctagttagcccaacagatagtcacgactctgagacatcttgaaattccaaactgtagagacctgctctgagactgggttgtttcacattgtttctacaaagccattattggaatacacatatagggagttcttgagcttaaaacagatgtttagtaaacacttctctgtcacagaaacaaagatatgatactggggcaggaaggggatggcaattacatttctaatgaatgccccatgccaattttatgaaagttacttgaaaaactttatttgatctaatagaatcgctgtgacagacaatacaacctgtcccgagggcagaaagtctgcatgaatgatttctaacatagagcagttgggatcacaagtggaaccatggggaggaggtggctgacttcatgtggaggaggtgattggacatgaggaactgagaggccaagatggtatatgaattgtctgtgagaacactgaaataattcataatagcagcacttaggtgtagagaaagatctgtgaatgatgaagaagtgcttggaaggatggtaaatggctgtgaagaatgattgaaggtgatacatctcagtggcatgaatcctcaaggctgaagtttctatggaagcaggatcttgaaagtggcattcattaggaaatgaaaactgctgtctctggagtcctatagtttatggagggtggaagattaagccaatctctacttgagaaggctaccaaggagagaaacattgtccccaggggaaagctagattttagacaaggcaaagagcggagaggaatgggtgaagagattgagaatgacattctagaaaggacaatagaaagtcttaggaaggagggacagaggggaagagagaaaggatggctggtcacctagagtatctatagggataaaagtatagctaaaataacctacattttaggtggagataatacagctgcctaagcttaggtgaactgctttttgaatcttagtttgctccttcataaaattggattaatataataccaatttggcagagttttcaaaaaaaatgatgccacatcctgtgtttccaaacagccttacctttcaaaactctttttggaagctgtaaagataatcaagtgatacctgccattatgtaaaggaattttggaatccgtctttggggaaataaaagccataagagagaatgaaagctaatactttgtagtttaaggatttttttccttgatgtatctaattggaaggccgaaagagtcttgtcttttcttttttttgcctgcttcttctgagacatcaaaaaacatcttgatttctgcggagtagatgagatggagaaagatgagacaggcaacagaaatcttaa

SEQ ID NO: 130249 - DNA, 1093 bp, Homo sapiens
gaaatcctttttgtgtattgatcttactgatcttttaattctatttgtagattctcttaggttttctgcctaaacaattatcatttttcagtaattacagttctgtttcttttcagttacatatatttgtcttaccaaactgactatgaataagaaagaaggagtgaggaaaggattatgcttcttagtactcctaaaacattatcgtaagaaaatttcaacgatcctatgcaataaatatttttcctttttttttaaacagataatggaaagacaggttcagggatgtgaaatgatttatttaaagacatataaaagaatcaagactcaaaacactccccctctgatttcaaaggctgatctttgcactataccatactgcttccagatttgaaggaaaaagttaaacatgtactttttcttagaatagcttagaaaaggaatttcattataatcattaaaaatataattgctcttttttctttaatgtaaatcaatatttatgacattatttttctacttttaggtacaaaaaagaaaaaagaaagcagaagagccactgaaagcagaatacctgtttcaaagagtcagccggtaactcctgaaaaacatcgagctagaaaaagacaggtatttggttttttaaaattcgaataacgcttatggacattaaagttataacttgaataattgtgattatttctgttcaacctccccaaaattttgagtgtaaaatatttgccctttgccatcttttattttgccgtcttagataggtgactaatcagcctattcaaaatgaaatacttcacccatatttaaaaagtcttaagttgggtgttggtactgacatctgtttggaattattgtgatactatcataaaatctgtttattagatgtaaggtgggacttaactccacattataagctttgatgtttaaattttcctaacagggatccagtgtaaaaagagttttctttacttaaaaacaaagaaaagataccatttgatcacaaaattttattaaggtgggtcaatttagggcttgattcatttgcttcccctttcagtgactatagtcttgtgccatc

SEQ ID NO: 130250 - DNA, 2136 bp, Homo sapiens
ctttcttagagttttcatctctccatttacatttacccatctgttcttgcatgttgtccactttttccattaaatcctttgacatattgatcataatcattttaaattccaagtctgacaatttcaaaatctgtgccatatcttgagtgtggtcctggtgcttgctttgtctcttcagactgtgttttttgctttttagcatgtttataatattttgctgatagctagacatgatatatcaggtaaaaggaaatgagataaatgatcctttaatgtgaggttttatgtttatctgtctaggagttaccgtttgtagctgtaggtgtcaaaggctaaaatttcctttagtgtcctgtttttgtctctcttgttgtctctgggtttccctagagactgctttttaataagaatctgagggacctctttcaactataacgcccaggatcctgactaatgtagtggtaaggtaaggggaggtgaagcgttctggagtcctgtgcatagttctccttcttttagtaagcctgtgtcctaggctgtgaccttcataagtgcttctcagcccaccaccccttgggtgagacatgaaggctagagaggggtggagttgagtatttccacaggtaagttaggttctggtaaaacctcagttggttaggttctggcaaaattagtttctcttgaggaaaggattttgttaagaagaccagaacgctttcctcatttattttgaaatggggagtatttctaattggggagtatttcaaaatggctactttttccctccgcctgtcagaagcaggaaggaatttttgtgtaatctttaccctgagacctgggggggctcctggagataaaactcacaaaagtttgtgagtccctctgaaactgggcccttggagtttttaactctgaagcttatccacacggatcctccatcagttcctcagtcacagttaattgctcctaccagtattggctccagctgtgagcttctgctcctggcctttctgtccccagtaattcttgtgattttctcaatctgcctctctctctctttagttttcaggacagcagtttgccctgtgacatttgttctttgatgtatctaagaagagttactgagtttcagtttgttcaacagcttttttcttctggggactgtagtgatgatttccaagctcttcacatgttagattggaaaccagaagtctctgtcttatacatataactgatctttccctatagttcttccagcagccattccaaatgaggtgttatttacagatatatatgaggaaaacagttgtttctcttctattcaaaacgaaatataggatatcgaccacataatcagtgataatatctatcaccatttcctatgccaaaaaagaattctgtggatatcacaagggcctggttttattttttagctttccgttgttggccttttgttaaaatacttgttttagaagataagtgacagacttaattttattttgtattgaggtttttaaaaaaaaaaacttacggcaatagcccatgtctacttggacagttttcttttgctgcattggtctgttaaagatatttcttccttcctcatcagaattaaagagccctccttttataaacttattccattaaagaagaaaagtaaatgcctttcaaactgttttccataaacagtatgtaatgagaaatactgtagcagtattttcttttactattcgtagtatcattttaaggcattaaaaagcattatttgttctttagaatggatatacagtgcagatctgagttatgtaatctctagccttgggaaagaaaaagattggtgtgttttaatttgttatgtgctctttgtatcttttcaggctattggcatggctggggttgttaagattttgtatttgattttttgagaaaataaaagacaaatgacaataaaacaaaggaaatgggttgtatgggtttaatgtccagaaatacatcatcttaaactcttcccttaattattactatcagtggaatctggtacaatcagttaaatgtataaaatgaggaaatggaaagttttaagcacaatagtagactttatgaaattgtactgcccttatgttttctttctgatct

SEQ ID NO: 130251 - DNA, 2922 bp, Homo sapiens
atgtggcccccaaatttgtatatgaaattttagatactatacttttctgtggagtacgtctgtaagatttatatgaccccaaagattaataacccactgttgaagtgcttttaatcagtcaccccacacatgaaaaatttattaatgcatctcttggtttttgtcagttaatgacaagcagtgtagtgaggttttgtaggagtgaaggccgagtcaggcagtaatagatggtcataggaggctgtcagcctttgtctagcgattgaatagccatgtacttgtaagcagcacagttgccgataggtgtgctgcagacaaacaaaagcaaaagcacgtacagaagagaccaggttcgtatcttggatttaagtcacaaagcagaggaatagcaagaacaggggatcaggtttaaggtagctcaaacaaacttctgcatgggtttggttacggtcactgccaactttttggtactgagtcatacacgagatggttctcatgtcatgtttgtattcttcaggccaccttgaattctttctaatattgcattagacaattgaactggatttttttttcttcgattatagtaaagtacacatgatataaaatttaccatttgccattttaactatttttaagtgtacagtttggtagcattaaatatattcatattgtgctaccatcactaccatctatcaatagcactcttcctcttacaaaactgaaaccgtactccttaaacagtaagtccatttccatcctcccagcccccttgccaccatcattctactttctgtttatgagttggactattctaggcacctcatatcagaagtagcatagtatttttctttttctgtctaacctaatgtcctcaaggtttatccatgttctagaatgcgtcagaacttcctttttaaggctgaattatataagtataatatataatataattttgtttatccatttatcagttgatggacagttgggttgcatccacattttaactattgtgaataatgctgctatgaacatggatgtacaaatacctcttcaggtccctgctctcgactcttttagatatgtacccagaagtggaattgctggatcatatggtagtccttttaaaaaattttttgggtaactgtcatactgttttccatagtggtgctataattttacattcccaccactagtgcacacaggttccaatttatccatatcctcaccaacacttattttgtgtttttttgatagcagccatctgaatgagtgtgggttgatgaaccgggtttttaaagaaaatctgaagtgctggagaatttcttgtagtctagacacagtaaataaccacgcagatggtcaaattgctctttcagcatgccaacagaaggaataattagttagttgcctgtagcaaatgccaagtatcagtaatttttctgtgtatagtattaaatttgatttttaaaaatgtttaggaattttctcccagcataaaattaaatgtttttaattagtttatgttagttgtatttttgaaagtctattttagacaagatttgagttttatatgggtgtgtaatacttcccctaccataggcagaacaggtttttcactgagttcattagtgaactactaaacattcacaaagcctatttggagatttggaggataataaatacaactattaacaattgtagaagagcattttaagagacagtgtgggcttaaagtcagacaaattcagttgacatgtagcactgccactttctagctatctgatcttgggcagctgagcttacataaaatgaacagtaataataatgacccctaaaaatgttacgataaatgtaaaatcttttaaaaatctaagaaatgtttagagaagtcttccgtctttaagaaactaagcattattttgattttttaaaactggcatttatagtaggtattttctttttgaataattgtttctgtaaataactgttttactttttatcaaaaggcatggctttgggaagaagacaagaatttgagatctggcgtgaggaaatatggagagggaaactggtctaaaatactgttgcattataaattcaacaaccggacaagtgtcatgttaaaagacagatggaggaccatgaagaaactaaaactgatttcctcagacagcgaagactgattgtgtttgtaaaagcttgatgaaaggacagttaagtattttgatcactgcattttgtttgaaacttgtgtcattgatgtaatttaaaacttttgtttaaagcattacagtatttttctgtgaccatcaattaatgagggtttgtgctaccagagttaaagcatatgctatcattgtattctttaagaaccttattttgataaaatgtaaatttgttgaaccctgccacatttagtatccccacccccaaatcctgttccaatgaaaaaattaaaacctgatacgaaaaaaaaaaaattccagttaacctattttgtgtctgtaggctgacctcaaccctgtaacgtaacccattaaaatgaatttctttttttttaagacagagtttctctctgttgcccaggctggagtgcagtggcgcaatttcagctcactgcaacctctgcctcccaggttcaagtgattctcctgcctcagcctcctgagtagctgggattacaggcacacaccaccacgcccagctaatttttgtatttttagtagaggcggggtttcaccatgctggtcaggatgttctccaactcctgacttcatgatccacccacctcggcctcccaaagtgctgagattacagacgtgagccactgcgtcctgcctaaaatgaattttctagatgattgaataacagtagtcctttgatagaagataatgacttggtttatggccttaatatactact

SEQ ID NO: 130252 - DNA, 2028 bp, Homo sapiens
aaacttaagatcaactttttggatctctactaataaaaacaacaaccagaggaatgcttaatgaaaaggctatttagctttggtaaaagagtttttgtggttttgcttacgtgcctaccatgccctgtctcccagccaggcaacagctgagaggacagtggcctgtgctcctagtgcatcttgataccagaacgggcaatacagatcttgctctcacagaaatgtgggtgtgctttgacctgcctggcagttcctgaaggttcagctcagagggttgcctttgttttgccccctccacactagaacagcctcacagtgcttatcagaagcattacctgcagccatctggggctggggacggcaaacggggcaagcagcaaacagaccaaaaaacttggaaaggaaataactgggaggaagatacgtgggagagagaaggctcagaagggcccttgtctgtactaggtagtccggaaggccacacacatgcctaacactggacacatttttggaaaagacctgagaggactctaggcctgcacctctgactgatctttaggctccacagaagtaggaggtggaagctaaagcagaatttaggtgacctggctaagcgctgaaggaatgcccaagtcaggacgaatctacaaagcctgggagaattaccatttttaactttttattttattttattttttttaaatagagacatggtctcgctttgttgcctgggcttgtctttaattcctggcctcaagaaatcctcctgcctcaacttttcaaagtgaaacagtatcttttgttcttttggactcatgacagttaaggaaattaagtgaaatgctgtacgtattctttgccatctttcaatcagcatgtttgtacaattcaaattgtagctgtagcttgtttatttttatttctacactaatccactacatgattctattaataatttacgctgttgatgagcgtttgaagtgtaaaaataattgaagaccaaacatgagaaaaacagactttttattcagagcttgcggtagcaaaggaatcagccacgatctcttgtgtttagcagactcagaggcagataggtttatagtggggggaaaggggcaaggttcaggaatgctctgcttggagggtgttggcatgaggaagctggaggctgatcagctcactgcaggtgtcttacaggattgctttggggaacctatttggctttctctgattggtcccatgttggaagagggagcaaaatgttgggatgatggcagtaactgagtaagtcttgaccattctgaatggatcactggggagattgtggtttggcttccaggagtggttgctgcagagggtctgggtgagagttctattgtcacagaagctcgtccattgtccgtgtgtatgcctagtcccagagttgtttccagtttctggctgctagacttttacatttcacaatgaagtgtgattttagaaataatatgaactcttgcctgccagaacaagggccagtgaattttaaaggaaggaagcacaatctagaactcgacagcaagggtcaaccatgaaaagttaggtatgaatattgttaattcctagagcaagaattttttcaaaaatatagatagatagccaatagaatactaaattactctatttggaatactaataaacccagaaacaaaaagtagtgaaacaaaaacaaaatcacagggacaaacagaagaaataaaatggtacacctaaatccaaccacatcaataattatatcaaatgttaacggtctaagccagaaggtgcgtggcaaacttcttctgtaaagagccagatagtacatattttaggctttgcgggccatacagtctgtatactctgcctcaaattagccataggcaatatataaatgagtgggtatggctgtgttccaataaaactatatttacaacaacaaacaggctggatttagccacaggttatagtttcctgacctttgctgtggaattctagagtgtgtttccttcc

SEQ ID NO: 130253 - DNA, 1008 bp, Homo sapiens
tgagccttaagggagggtttgaggtgacttctggttcagtctccccctaagagtatagtctttcagtgtcctcatttaattattcccatctcaatgtgtccttgggctttgacttctggcccccttgctgaggaagagaagacaataatggaagtaagaagtataggaccccctttcctccaaggctaagattcagacctcttcaaagagaggaccttcctacacctggaccacagcccacagcggggaagaaactggccagagggcacaggtggtgctaacctggaacagcagcccaggagggtgtggctgggtggaaaggtggcctgggggcaactggaactcatccacatcactccccccctgaataataatgataggaccaggactggaagggaatggtcttcctgtcctttcactccagagaccctccaaagccctctgttggtaaagcttaatgatcattgtgtcaacagatgtttacagagtccagcccatgtccatctatcacaaagcagggcagagaagggtggatttggagctgagagccattatattgataactggcacataaagtgcttttatttttttcaacttactcccaacacacacacacacacacacacacacacacacacacacacgcacgcacgcacaccccttcatatgtcaaaatgacattaagtttcatttaaatgtatcctatattgaaagagcaaaaaaaaaaagtgacagtttgactcaagaaatgcaatggtttatatgacctacaactctcgaaggaaaagagtaataattttgcaatgttttgatgatatttacaagtcataatttaaagagatacataatttttccctttctacgtaagtcctcaaggaactcacatctgttttagcccagatttgtatagtgttttgctttgcatggattatctcatttaattcttgcagaactttgatgaatggtattattaattagcagaatggtagtagtaacaggcaaagtggt

SEQ ID NO: 130254 - DNA, 1620 bp, Homo sapiens
gttgtttttcagtttgagatattatattatgattattattattaatattagagacagggtcttgctctgttgcccaggctggagtgcagtggtgcaatctcagctcactgcaacctctgcctccccggctcaagcaattctcccacctcagcctcctgagtagctgggaccacaggtgtgcatcaccacgaccgttttttgttttgttttgttttgtttttaaggacacagggtttcaccacgttgcccagactggtctccatctcctggactcaagcgatccacccacctcagcctcccaaagtgctgggattacaagcgttgagtcaccgcgcctggccagagataatatcttattgacctcctctatatgggatgctgtgcccggccacacctcacatacacacattgcactcacacatgtgcttctcctccccagttccttcagcatgtttatgccagtttttgttgaatcagtagtaagtgttcatattatgttaactctgtaattgttctttacacctgagctgtgtagtttctatgtacatgtcacttattcatctccaaattctccaaccaaattgaaaatctcagaacataatgaaagatgtaggccctccttcggattgcattgttttttggagccatccctgcccctgctcccaggtagtctggctgctctgcaggcctgctgcaagctgtcaggcttacattgcccttcgtctgcactctggggatcctcatttctctcccaggttgtgttccttattacctggaccctcttgcttggtttacactcctgtttagatagagcacctcctcctgtaccttcacagaaaaagcacagagaatggaaaactcatatcttgcatgtctgaaaaaatccttattctgccttacatttgaataataattttataggatatagaattttagtttggaaaacattttccttccgaattttaaaggcattgctctgttgtcttctagtttcaaatgttgctttacataaatattctgatgcaattctaattactgattatttgcacatgacctacttttttctctctggaatattttagattcttgggtatctgataatctggaatttcatggtaagatgccttgttgtgaacctttttttattttttatttttattttttgagataagttcttgctctgtcacctaggctggagtgcagtgatgtaatcacagcttgctgcagtcttgacctcttgggctcaagtgatccttctgcctcagcctcccaagtagctgagaccgcaagcacgcaccaccacacacagctgattttttaaacttttggtccattccaagatggccgaataagaacagctctggtctgcagctcccagcgtgattgacgcagaagacgggtgatttccgcatttccaactgaggtacctggttcatttcattgggactggttggacagtgggtgcagcccacggcaggtgagctgaagcagcctggggcatcacctcacccgggaagtgcaaggggtcaggggatttccctttcttagccaagggaagccatgtcagactgtacctggaaagtcaggacactgccgcctaaatactgggcttttccaatg

SEQ ID NO: 130255 - DNA, 2135 bp, Homo sapiens
tgttttaaagtgagaaacttttaaaagattataaaatagactgcaaggttcaaaacatagatccccttaaatgacacttccgtcaccaataatcggactgagttacagtaattttactttagcaaacagacatgtattctgtgtctcacgggccacctgctgaatgagaggactccagttgaaaggtcaagaacataaaaccacaagagctttttgagtgggtcttcaacttagttaaaataaaaataaaggacctgtgttccttgagaactggcccctaaattttctttctctacttcagagtgtggcaatgatgtgtttggggactttggccaaaattgaaggtttaggaaacattgaacatgacttgagaatatttagaatgtttacaaatgcatttggaaatatttatatcaccatctatataaaaataaaactgtgaacagctggacaagaacactggtctactcgccgaacttttttccaagttccttgacaccgaggattaccaattgcttgccaatggagagtctgatttctgaaacgatatttcgaaagtgttagttacactaaaagcataccgaagaaaggtctaatttacagaattaaaactcggagttaaaaaaaactgatcacagcctgagcaatatagtgaaaccccgtctctactatatatatatatatatagtttttttttttttctaattagccagacatggtggcacacgcctatggtcttgggaggctgggtccacaggtgcatgccaccacgtctggctaatttttataaagaaaaattatttgtagggatggagtttaactgtgttgccaagctgatctcaaactcctgggtgcaagggatcctcctgcctcggcctcctggctcacgctgggattagaaacatgacccactgcacccggttccccaattttttttttaatgatcacaaacagagtttcccttgtttagtttctgtcaaagcaagttttaattcattgctactttaggacaccctcatgttgacagagtaacttggggttactgtatttgcttttcccgttctatctgagcacaagtgctgcataaaggaaaatggctgactgttctatgtgtatttaaactgggaggtctgaactaaatgatctcttttactgctttccaactctgatttcataatgaaaaaacaatgagagagctgaaaagaacaaagccagattattaaaattattatttttaaagtcactgctacctcagccagggtttaaatactatatgggtacaaattaaattataaattcatttaaaaccaaaacatggatgaggtattcagaaaaatattatgtaaatattttctatttgatataaattccttacccactttattgttcttatggtgtgctcaatggaggccatgaggcactagtgactaataaacataaattctagttattaaatatgaaaacattctacaggaataataattgactggaaaggcccatattttaccttttaatctgtatttctaccagttacacctgacatactgaaaaccataatctatgtgtgacctaaattagtctttgcccaatagttgcccagcacgaagttgactcttcttttagttttgtatagtgttatcaaatttaaacactaaataagtgcagaactgggatacaggtgcatgactgtaaaatgtttttggagtcaattatttcagagaaatctacagatttatataagattattataccgcagaggtgaccccaccactgtctcagtcagggttttatgaagaagccccattgagcaacagttctgaaacttcatcgtgggtatgaattacctgggcaggggtccccaaactaggaccccgtagaggccaaagccggcctaccccttctttgtgtctggactgtgagttaagaataatttttatgttttaaagtgttaaaatcaaaacaataatgatattttgtgacacatgaaaattatacgaaattcaaattttagggtccataaataaagttttgttagaacaaatccaaggtttgcatagtgtctgtgactgttttcctgctacaaagtcagagttgaggggttgtcacagagaccacacagcctgcaaagtcaaaaa

SEQ ID NO: 130256 - DNA, 2384 bp, Homo sapiens
caggcccagcctcaggcatctcttcaatgttattttctcattaaatgctcataccaacctcatgtggtaggttattaacagtctcattttttaggaagaaaaaactgaggtggaacaagttgttcaaggtcttatgctagtgagggcagtgtggggacctgagcgtgcagctgtctggtatcccttatctgacagcagaagaatggatttcagctgagcgtgaaggtgacttccagcctgtaccaataggtttccataagaaacctctgagttgaagtgtgtgtcactttcaaattcaccaaacagaggtggtgctgaagtctaacgtcccataaagactgtaagagaagcatccttagtatgattgataaaataagctcacaaaataatctcatttgtatatagtttgtttcttgttgaagattggacctaagaggtagatatatctttatagctccacaaaaaccaggaggggacaagtattttcccaactctgatgaagagtccatattttagccaaagtcaaagagcaagtagaaagaagaagaaaacataaaccaagttgaccctcttgcattgacttgactatacaattgaaaaacatgattaaaaaaaaaaaaaaacacgaaattacccagcatcctctgtgtgtgtagaccagtgtggagacgtagcttgtcgtgttctctccttgttgaatgcagaggtagttataaaggcaggaactggaaaagggagatttctgttgaattcagggagccaaagtactcagaccatcgtttcccaattttggttttgtacctgtctaagggtctccattcctaaactcacagggctacggcacaccatcaaggtgtgaaatgaggccaagttacaaattcaataaagatgtgtgtgcacacagatcggtagggagggggcctgcaggcctttgacaagcacatttgtctgcagtaataaaactgtgtgagaggaaggagaggggccaggaggaaaaaccagaaggaaaggaagatgggggtcagaaggggaacaagggaaaaagtgagataatagagagcatgaagagaagaggaggtttcaaaaatgaaaggaagagaaatagagaaagaaagggagaaataagataataaaagaatagaaaggaaacaaagaaggatagagagaagacaaaagagagtaaaagcggatggaaggagagaaaacagacaaacagagaaaaaaatgagaaaggaaaaaagcagctggcgtgttggctcatgcctgtaatcccagcagtgtgggaggccatggtgggtggatcatctgaggtcaggagttcaaaatcagcctggccaacatggcaaaaccctgtctctactaaaaatacaaaaattagccgggcgtggtggcaagtgcctgtaatcccagctactcaggaggctgaggcaggagaatcacttgaacccgggaggcggaggtttcagtgagccgacatcgcgcccctgcactccagcctgagcaaaagagtgaaactccgtctcaaaaagaaaaaggcagaagaagcagaggaggaaagaaggtgagtcttccccaagcctcaggtaaccacagcaggaaaagttcatggaagctctgcccaccacatagtatcaatgtggctgcccagtgccagcctgcacagcattgtccccacaccagctcagggaaagaaagtcttcagtggtccccttcttttccctcttcctccccacaaccctcccccaactctgatgctctgggtcagagaaaaaaaaatggcaccaagaatccttcctcctgtctctgctcactttaattctattgtgtttgtgtgtctcctctctacctcatcactaagtctagggaggcatttgttgctataataacacctataggtgtcagtctcctggactgactctgttgtcatcttgaggaaggcagggttttgccttgtccatcactatagcttcacacatttacacactcaataaatatttgtgcaaggaataaatgggccagtgagtgaatgaatgaggtcatgggcttgcagccaagacacacaggccctacttccctgcagtcttccgttcctatactgagccttgcagccaagatggctcagcagtcctctacctctgtttcagaaactgcgcgattccaggaagggtagatacaagctgatatcaacttatgagacgccaaagtcatcatcaacatgaactcaacaatgtgaggatactggttgcaaaatagatgcttgaagcctacatgttgattttacctgtctctttactatcccaagatgacaaaccttaactctttttgagcttttcttaatgaggagttatttttgtattactagggaatttaagacaaaaggccag

SEQ ID NO: 130257 - DNA, 1576 bp, Homo sapiens
gtaatacagcgctgtgagctttttgagctattgataacatttttgtttattaacgttagagagaagaagaaggaggttcctgctgtgccagaaacccttaagaaaaagcgaaggaatttcgcagagctgaagatcaagcgcctgagaaagaagtttgcccaaaagatggtaagtaaactttttgaggcactagcacataaggaggcgccttattgggattgaggatgaggtgaatgttcttggcaagatttacttcctaactgtactgagtaattgcttagctacctaatgttacaatctgaaggtagtggggttttttggtgggggatgtaattgcatactgtggcaagaaaagatttaaaggaaacatgttgtagttttctttttaatgattggcattgctaattgtgattgagctaaaaattatgaataactgattattggttttcagcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagagggtaagttcagttttactgcattcgggtttgaatgggaaaaaaaaaaaaaaccttcacattacttctgggagccctgattctgaaacaccggagtaacaatattttaggggaagctagaacaaggagggtgctgatcactaatggtttagttgcaagccatgttccccaagctcctatcccttctcttaatagaatacagaaattcagtgtgtaacatgagaggattcctatctgtttaggtaggattcgatattcaaaactataatggttagtattaataaaaatttcgatgaaaggcaaatgcatttctggtccgttttcaccacagtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaagtctcttttctcctttgatttctatttgataaattggttatgtagcaacatgaattttagatgttttaacagtggtcaccttatttatgtttgctttttcacttcaggtaccccaatctgaagtcagtaaatgaactaatctacaagcgtggttatggcaaaatcaataagaagcgaattgctttgacagataacgctttgattgctcgatctcttggtaggttctatttgggggaaaatttggtattagaccatgcgataatttcttaccctcttgtggccgtacatttctcactattgtgaatcttcatgtgttccctatgattcttgatttagcttaaaagaaaacgtaagacatggtttcattagcttgaaccttatctttgtaaagccatgcatttaccttgtttattcctggttatgttttcatctcacagcctattcaaaaagattttgaataattatttcaaaactttttgcaactttaa

SEQ ID NO: 130258 - DNA, 1034 bp, Homo sapiens
gcgctgctggtgctgtgggacatcaacacgcaaagcaacgaggagacggctggcatggtgcgccacatctaccgcgacctggaggcggccgacgccgctgcgctgcaaggtaacctggacccgcgcgggagcattgttgggtcaagcctctttccaccccgcgccctaccacggcaggccccaaaccccgctgcctggtcagccccgctgtggaggaaaggaacaccccaccggtcttttgggagacgagtggaattcgcttcctgataaaggaacgcgatcacttctgtattaccagggagaaggtgccctgtcctcgcggaggttcggtctctggggaccacggcggggggagggggcgggtttcctaagccctccggggtagggaaggcggagggaacttgttaccacaggtttggatcccaaagaaatgtcttgctccgacttacaagcggcgcgatgggaaactgaagcgtctttgggaagttgttctgactagactgaagaagtgtctgtcttactgtggtctgaaccccttagacgagggcagtattgacggtttcattataagtttagcctgaggaacataattacattgtttcgccagcgataagtgctttagttacattccctgagcgtgattgaaagacgccttgcttcctaagagaaagctcttggaggatttaggcttcgttgtaaatttcttccatgtttttggtcaccccagaaaatctgcatttctgaatacttattaactaacctgaatctgagttgtttttttttttaagccaaagcaaagtccataaccaaccataaatattggttcaggaaatttgataatggctgttggtttttaacaaaatttttcatttttagggaaaacatttacctgtacggagaaaattgacttgggcacttctcccctgtattgataatttatcatcaaacttattgatacctgcgtttttaatttaagggtgaaaatgtaccattttcattggtggtatggaggtgtagcaaatacagatttttgt

SEQ ID NO: 130259 - DNA, 1090 bp, Homo sapiens
ttttgagggttctcatactaaagactaagagctgtttctcttgggccactgtttccccaaaaaaagaggagtgtgtagtgtgtgtgtgttgttctctgagctctgggctgagatcagttctttgcaggtgtctttagctccagcaagctgatcccatgtggtctacttgtattgggcttgtcacaattacatgactttcccctaagcaaagttatccagtaaattgctgtaattcccaaagacttcatgggaggaaggcagctgtaaagctcagtcgttggcaagccttgcagcgttagaaatttgaagctcactgtagtatttttgttttgtgtgatctttgtcctactgatcgccatgtgactcactttctgcacttccttctcttttgcatgttttctcctcatctggacttctgaggacagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctgggtaaatataaacatccttgttttctttgctgggccctccttaatgagaaggttgggaaggggagagacttcagtgccagcctgaaagcaacctgtactctttcgccacaaggtctccttagctcttccctatggtaaactgcagtgtatgctggttactgttagtcgttttgtccccgcccacccccccgccacccctaactcagtatttttgagagggcagaggattgaacattttgaactagtttgaaagattgccataaaaataacacgaaggagcgtaaaaccctgggtttgtttattttactttctgttgagtttataaaacattggttgttcttatgaatttctaaagtcaggatttaggcttccaaattactgctcagccacattttggaaagtgccaaagattctgaaatcaacatttgtg

SEQ ID NO: 130260 - DNA, 1075 bp, Homo sapiens
acctggcctgtttatttattttgagatggaattttggtcttgttgcccaggctggagtacaatggcgtgatctcagctcactgcaacctccacctcccaggttcaagcaattctcctgtctcagtctcccaagtagctgggattgcaggcatgcaccaccacgcccggctaattttgtatttttagtagaggcggggttgcaccatgttgatcaggctggtctcgaactcctgacctcaggtgatccgcccgcctcagtgtcccaaagtgctagggttacaggtgtaaaccactgcacccggccaacatgaactttatttaattcatttacaaacctctagaaatgaatatataaatgacctgagcttatatatgttttaaacaagtaaggaaatcaccaaatacagtttgggcaacttcagcttgcctgtaggtgtgtgttgtgttcagtgggggtggggaactgaattaaagtccttgctgtggctgggtccccaggaacaggcagcaggtgtcaaaggggtggttagatgaataaaaggcagtccaaccaaataaacttgacatagaatttatcaagaatcttgtgtgtttatgactaatcctgagtaaaacaactaccatttgaaataaaagacatacataagtgggaggcgaagtgtcattttcatatttgaagaatggtaaagatgaagctgccgtaaaaactgcagttgatttaagtcagccctaaacagttacagcactatcagtaggttcattatgaaccgcagatactgactgggattgttttctcccgtaacctttgactaagatgatgcaagactacataactaaacttttacctacaccaggtattctaaagtttagccatcttgcctactttgtctgcatgattattttgcttaattgtaaaattttaagtgtaatcaggtttttaagaaaccccatacaatctgcagttaaatacttaaaacaagaaaccagctccaggaagacatctgataaaatgaatgctaatttagtgtgtgtaaagcacagaaaattcatagccttagctttgaaaatgcacata

SEQ ID NO: 130261 - DNA, 1044 bp, Homo sapiens
tggaaaaaaccacaagtgtttcttacatgctgcttgcataaaatgtgaatttcttgcctttccttcaaatagtttagtactggaatttttgaatattaacatggtgcagcttcttagtgttagcctaaacaatagggctcaaaataacataagtggtacttatgtaaacacatgggtattttgaggacaagtgaaacttaaaattcaaagcctgaattttcccaccttaagttgtaattaacatactgccccctactgatttcttaagggttttttacatgggctagtcctgcagtctcttgggaaagagaagcataaggtgtaatgaattacttctaaatgatttcatattgtatttttattatgtttgctggactctttaagtgttgcgatttttacttataacagtcgttttttgcctatagtaaaatgggactgataaaagaaggattagaaaggtggtggtgttggaaagtttcgttgttttccagcgtcatctaggacttgggatgaaagggactaggcagctgaagcaactgcttagcagtgtttttgcgacttcttttcttaggtcagatactgtgttttaaccagaatatggtctgcgtggagggcagggaggactaggagccatacatagtaagaaccaggacttgcaggaacttaaggaaacaacctaaccaaaaatagatagcacttataacaaaaatagtctataaatacatgcttaatgagccttgtgtactaaatttttatatagcacttaaatttacaaagccttttcataaacacttttctcatttgagcctcacagcaactctgaattaaatagagccactatcctcatgtttatggatgaggaaacaaacccagagaggtgaagggacttccctaaggtcactgccagggaaggaagaaactaggacccaaaccctcagcctaggcttccaggttagagcctgtacaaatacttagctgtgggctacaagttcaaagctcctggtacagtaggtagattttcctatgagtcacttaggagttttg

SEQ ID NO: 130262 - DNA, 1042 bp, Homo sapiens
tgggtcccccagcctggaacttgtgccacactctctgcctcactgtgtggccagtcacttgcatctgtggcagagtccctgcggtgaaacccatgttggaatgtgactgttcagaatgatacacgttcttgtcagtgcatagttggcattatgatatgtttttcacaaaaatagttctataatttagcctgttttttacatcctaaaatactttgtctcctgctagtacattttggtaataagccttgggatcccagagcatgctgctggagtatctcttcattgataggtctattactacgtagacatcgccgtaaggcacacattaatacaaggcaatgtttgtagtaggctgtggtccctcctaaaccatgagatagctgcattgaagtgtcacgagcagaaacaaatacctggcttgggagtactttaaattagcagataactgtcacttgaaaggtaattaagaagcttctgccaatggctctctttttatctctagacactgtccccaaaagcttttaagttacagtcttgttggtcacgacttataataggcctgccatgccgatgatacagtgctaagttagccagacacttaaaagatctttttgataaatataaaatatttttaaaggaattgggaaacaaaacatcatgtgaataaaagtttgttttgtgatcctggactgggttttagatgaaattcatgaaatcagttctaaaacttgaatcttactttgtttcagaccactaaggcttttcttcctacgatgctggagattaatcatggtcatattgtgacagttgcaagttccttgggattgttcagtactgccggagttgaggtttgtcagatatatagcatttctttcgttcaatctgtttatcctgtgataagtacaccagaacctccaggagagcacctgctgcccctccattcatgaaagctgcacgaaggcactctgcatgtgtgctgcatgtagaatgttccacaggaacccagggccagccactggaatggaattctatgtcaggtgtg

SEQ ID NO: 130263 - DNA, 1040 bp, Homo sapiens
cctcctgtcttggcctcccaaaacattgagattacagtgtgatacgctgcacccagccactactttctttgaagtctaaaaaggcttcattgagaaggtgcctgatttcccttggggctcatcccacattacatctcagacactatgactactacttacatttacaaattaggatattgccttgttgctttctatgcatgtattcattcattcgttttcctcctttgaaatgtcattttacccttatttggctaataatactagctatacaaagcactaagttgcatgctgccaaattccaaatagcttattgcttttagaaaccgcttctccctccgacttccagcaaattcttctagccttttgataaattaattcataacctttccacatatttatccaaagaggcagctttttaattctggcacagtcacccttttttttcctcctgggctttgatactaccagatgctagaggaaaaacattcgcaatatgcctacaatctatttcaatatataattctatccaattgaatgtcaggcatttctaaagaatgctgttggttgatataacatcccttgcccaagttgaggttttgatttgaagttgcgtattggaatgctttgtgttacattttgccccaaatttataaatctatcatggattctcctttctatcttgcttccttaatcgatgaaccatcaagaatgaagtttagcgtgatatcttgagaaagcaaaagaagaaaatcttctgcttttgaaagggaatgtaccctcaggcaaaaattttaaaaaattctctgtctcgtaatacatattaggaaatgccagttgtcatgcacgcaacttaagatggattaggattccatcactgatcatggaataaattcttatacttttaaccttacaagttcatttgcagccaagcaattagaaaaaactgtgtttggctatattagaatgtgtcaaccctcttaacagtactagcagtttctagaaacaatttagcagaattttttccaaaagtatttggcagg

SEQ ID NO: 130264 - DNA, 1038 bp, Homo sapiens
agttaaaacatgagaactgctacgttttctcaacatggattgagctaagtcccttttaatgtttattcaggttttaaaagacttaagtgtagttttacaagttcattagcttgcctcattctttgagatgcatctcaccttcatattatcaaatttcattacatgcaaagaattatcagatcaacccattatacagcctagcagcatgaagtctttttccatctacagggagaatattgtgtaaatcaggctctcgggtttcagtgggaggcagagggttgcgcggtgtccatttgtcaagttgatggcaccgcagtgaggttacattagcttgtctttgaacagaagtgaaatcttatgcgaagctccccttgctgtcatttacacgaacatccatcctcttaaaccaaggcctctgagaaaaacaaagtgatggcacaatataatcagtcactcaagttgtctgtcatctgttttcttaaggaaatgacttttaagttactggagcagagaactgtagcaaattaacaaaggttgtagtagtaaaagtaggtggaatttttttaaactgcagatgtctttctgagaagattttatatgcagaatgccaaaaaggatttcccccctctctttcataatgaatctcatgaaaagtattacttcctgaacaatagacctactgctgttaacaactggagtctttcttgcttaatgtgagtacatgttaatgctcctaagaaactttctgcagaactgagtctataaaactctcagcctcactgaggtcctctgacaattagctcaccacctttgaattcagagctatctgaatttcagttatgtaacggcaaatcttgcatataatagtaagctgctttagagcaaatggtactttaagtataaatgattggaacttcattacttaatattacatgtagacaattgctttaaaaccctaactgcattgccaatggtggtcaatctaagtctggtgatcaaatttgcaggttttatttccctaagcctgttttatgggct

SEQ ID NO: 130265 - DNA, 1094 bp, Homo sapiens
tctaattcttagtgtcccctctaaattaaaaatatttaggtaggaatttactattcctactattctgtatgcctctatgtttgatgttgatttgaagatcactggggaaatattctaaaaacctttctgttaacagttcactactaatgaatcaaaccagatacattattaaaccaataaataaccatatgtatataattgctaaatagatgtgaaagttatagtggaaaactgttgcctatatagacttttttaaagtgatgatcaatggaatatagttccctaggccacggatttgagagcattattgcccactggaggtcacttttacaacctaaagagtattaccttcctcataaacttaaattatggtgttgcgtatgatttattacactatttaaaactgaaaagcggtaaccttctctcccttagcaatacaccttcaattaagtcatgcctctccccatgtccaaaattcctttttagacaaaccagttactggttatttttcaaaaatttcaatatttttctttcattgctaatagttatttggcctactctctttgtttctaagttggcactgaatgcctttttagattacatatttttttaaataccctttagttaattggcttctcgtttgcatcctctgatggaagaaatttgaaggcatttttaaacccccaaatattctagacatatgtgaaatttaatttcacataatttaatatgtgaaaattaaattttaagggcaaggtagtgataaaaaaaaaatgtcttctgttaccctccatagatgaaacagtgataatgctacgagcaaacctaggtcaggttttctactgtttggtaagaagagtcactgctctaggtcaggcatggtggcttgtgcctgtaatcccagcactttgggaggccaaggtgggcagactgcttgagcccagtagtttgcaactaacctgggcaacatggcaaaaccccatctctacagaaaataccaaaaaaaaaattagttgggcatggtggtgtgtgcctatagtcccagctactcaggaggctgaggtgggaggattgcttgagcctgggagtttgag

SEQ ID NO: 130266 - DNA, 1035 bp, Homo sapiens
aaattcaaaatataacttgatttttgtttattttttatgaattagagtgctaagacagatatattaaaaatgaacatcaactttaatgtttgctttggtaaagtgctttcgtatttgttgatttttttaaatatttcaaaatggtcctccctccgaaacttgtcccttgatcttagaactaaaatgtcttctgctgacatttaactttattatatacaattttcgttttacacaaattatatcttatagttaaggaatttaatcatatcttaaacaaaattacagcaggaaaagtcaccaggagcttctcaccacaggatagatattattctatctaaataatagactaaaaatagactgtggacgaaaacaagagtcagtaaactatggcctgtgagtcagcttcagcccaccacctgaactaagaatggcttttacattttgaaatggctgaaaaatatcacaagaaaaatagtatttcgtgacatgtgaaaattatatggaatttgaattttagtgcctgtaaatacagctttactgggacacagccacaaccattattttggtattgcctatggccactttcacactatgatgacagatatgagtagttatgacagagaccttattgcctgcacgtcctaaaatatttactatctgactttttacaggaaaagtttgctagttcaatcctaggattagaaggaagaagccttaaaaattcaccttctgaattttgtatcaaatattgccttaaacatggttattcagagtccattctcttttggaaagaagccagttttctggaagtattgcccattttatagcacaattagacttgactgaattttgaatttatttacagtggaaaccaattttattttctgaaggaataataaataagtctgtcttcatcagtatttatcagagtgttaaaagaaagtttgcctatggcaaaggttacttttctctccttgctgaaattccatttagaaacacttctgagcagaactttttttttaagtaataaagaat

SEQ ID NO: 130267 - DNA, 1106 bp, Homo sapiens
tccaagttgtgtctcagtctgtgtaatgtaatttcattcatttatttatccatgtccctttagaggcattaatgtgacaagcatattgcatttagagtgaaacattatgcatcaactaaaacactggtacatgaccaagcatgttaaatgtatgttcatatttttgttacaaaggagtggatgtgatgtttgttagttatggaaaggactgggaaaaaactgaagagacagtaacagatattattctctttaatattactttcaataattatatatcttgtaatttattttattacattatgagtggatgtgttataagactatctgatagttattattaatgctaatcatgagctagctacagttctgtatacttttcatgcctaaattaattttgtttacttatacattaattcattagttataaatagaactaacatgtagatttgtactgttgactgtagttaaataaatacaataatttacatgtcatcaagtgatcaaaaaaagtagtaaagttttgaaaccaacttaatctacttatttaggtcaatatttatgaaagaaagctgctttgtgccttgccaagaacatgctattttgtcttaagatttgggtctttatttgtacaactttgtacaactgaggtgcagacgttgcgaaaatcaagcatgttttgaatctcctaaggtttagtgttcaactgtcactcttcagctccttgctgcctgtactcttctgtgcaaggcttctgtgcagtagctacagtggaattgctacctactgctgtgaagtcaactccacagttaatggatctgaggtgtactaatcaaatacatgttttcttaacacagtgattgtgctatgtatcacataccttaatgatctaacaggcaactttctttaaacataggtcttttttataccctcctcatttttgttccatagggggtggccattaaaaacatccgacagacaagcagttaacccagttccctgctgagattagtaaaattagtagtcatgcaacatcaaggacttttagctctgcaggaagtagtttgactcaacttcttttcggagctgggggtaggaaatttaaattt

SEQ ID NO: 130268 - DNA, 1053 bp, Homo sapiens
tataagtggtttctttgtttaaactagtcattaaaaattaggttgaaaatgaaagtggattattttagcaaatcgtcccttctagatggatttcatttcagtttgctattctgtgcctctcctgtgagcatcatccactgtaacagtgttgtttgtgaaaccttccgagtatagtgtaacaaactaggttttttccctcacataaataatataaagaaacacttagttggtgttttagttaaactataattagtttattgtccaaaatcagggagtgttttatggaggggcatttcattattgatcataatcatgccatttccagcaagatgagattgtccacttaaattaaaatcttccttttcaaatataattcacgctgaatacatttcaactcatatgcctccttttgtggagtttaatatgatgatagcaggtttttatagccacaggcttcttttaagtatttattttttaacaatatgacttagtataggttatattgggatggggctggtggaagtgggggggtggtggctggtctccctgagaatctgagaatcaacctttcacctatttattcttatctctcctatacctcatgttttccaatccatatagttatcatcaaggtggctatttgcagcagctttttttttttttttagaataaggtattcatttttgttaggagatcaatacaagtacaattttgtaaattcctcttaggagaatatggagaaagaaataatgcatgtacatacacacccacatttaggaatatagttgtctcttggtatctgcaggaaggattggttctaggacccccaaagataccaaagttcatggacgctcaagtcccttatataaaatgttgtagtatttacatataacctacacacatcctcccttatactttaaatcatgtctagatgccttataatacctaatataatgtaaatgctatataaataatggttataccatattgcttttttgtggttttttttcaattcttttttaatatttttgatatttggatgcatagcccatg

SEQ ID NO: 130269 - DNA, 1154 bp, Homo sapiens
aaccacttaatttaaagttacaattttagaatttgtttttgttgttttaccttaagaaacacaataaatcactgtttaaaaaagatctcaatttatataaagtactggaaaaaagctaagtaatttttagttctatctataatctccgtaggatgaattagaaataaattgtgatgaaaagaaattaactgcttatttatgaatctaatcatttagaaatgtctgagagtaacactgcattcttatagaaacaaagcacaaattgcattcaagctctgaattgattttttgcttggagctgttgttacagtagctgtaattttgctaccagaatgtcttaattttttaaatttgtttttatttctaagctcttggcaatgacaataattataattttaacatatcttcactgtagtcaacatgtagagtctgcttccctcattattgcattgctaaggcctttttaaaaagcttatgcttacataatatactcttttttatggacacgttatatgtttccaaatctgtgtattgtgatttttacatactaatgaatataaacaggtgattttaaaatattactgtgcttctttggttgaatgagctggtattgatgtaaaatactctgtcattgatggaccactacctgcagctaagcagtgagcagaatctccgggaaatgacttagtctggccacatgcatagcccatcttcataatgtcgcagcagaaggttctttgtggttaaaagttttaaagcctatttctttataggtaaccctctcaggtatatttacctggtagaaaaacatgtagattgtttctattacttaaatgttttaattggactgtagtttagaaattacaggaccagcttgttacagattatacactattctgttacttttatttctgaaacttaaaaacaataaattctttttctgtgtttctaggttagaacttttttattttattgcacactgaacagatactgttgcttattgaatattgtgtaaacccttctttggctttccttgcccattgcaatttgatttaagcctactagagccattgtatgtgacagctatattgtattacaaagtaaaaatatatgagtgtattgaaaacaaagttgttttaacttttaattttgtt

SEQ ID NO: 130270 - DNA, 1449 bp, Homo sapiens
ctagaatttttaccttttatgttaaaaatgcaacatacttaatttttcctctgatacttacacaatataatttatatatacatatatatccacatgcatgcacatacacatacattgagccatatttgatgaccaaaaagggagaggccccaagggctctttggtgtgcaattaatattttggccagaaaatcagcagattgtttcagtatggttatgtgttatgacatcatattccagtaaagttacaatgaacagaaattttgtttgtctctgtggcaaaccaaaatgagttttgtaattgtcagcaggccttagtgattatagtggcgcccactccctctactgtagttaaaggtctgttagcatttcagttgtggaccttctattttcagaagtttataattaattgtaaacatttgctctatggtgaaagtttgccatatgagatctcacttcaggagtaaatttctgatttcaagttgtctgttttaaagttttatagtaccaccagttaaaaataaacaaagttatgtggaggtgggaaaattgaattttgagaaatatgaagtgaagatgaccggcgttattcatattagtctgtcagatttctgcattaaggaattaaaataaatttctgcattaaagggattaaaataaaatagatgataggaaattgtgcacttcagtacacaatatttaattgttgtaaccaaaaagcaaaaaagattatagttttttaatgctttttaatctttgtttataataaaaacatttaaaatgcgttatcttaaattaatagaaaactgtagttcaagaaaattgattttaggttaagcatttaaaacagcaactttttcttttttttcatactctgaattcctctccttcatttgacactgttaattactcctgtccctgacattgtgttgtaatttttcttctaactttgaccctttttcatctctttcactgctgtctattgtttcccttgcactttgatcacaggcattaatcagttccgagccttaggctcttttttgattcctttacacttaccctttccaggtgcttatccacttgcatggtttcaattattgcctcacaaatctgcatcttcagtaccaatcaacatttctagttcttcaccttcagtaaaccttcattgattagtcccatctgcctggtgaatgcttacatgatgcgctctatccagtttatctcaggttggacatagagcgtcactacttggatgtgcagtaattatctaaaatatagtaggacctcaattggacttctttttgcttggaaacaaacattttttaggactggagtgatttttaactcatttttttcagcattgcagttgtaaatccaccattccatcaaaatcgattctgtttattttgctaagttgctcaattcagtggtcatatttctcagtcatcat

SEQ ID NO: 130271 - DNA, 1010 bp, Homo sapiens
aatgtctttggccacactttgtatttagtgtgactaaaatacacgtatctgtattgtgaacaggagtaaaccatcataacccgaggccaaaactgttagcctttcaaagctctaagtattacttcagcctcttcctatgtgtggtagtcagactggatatcaatattgtctctaccaatatcatctcccttatttgttgctgtgttttacctcagggtacatggcaaagataaagaggattggatagttctcagcttagtgtgcatcctggaataagagacagttcacactgactaaccgatgtaaaagcataccttgcgtatctgcagcaatgcaggaaaaggagagcataggtaattgaaatccacatagtgcattccccagaggatttgtgcaggaaaaattttacaaattaatttaaaatgactgaaaattataaattgtttaacgttaatccaaggtactttaaaagtggaagagttttcttaaagttccaagtactgtactattttagcaaatgttgctttttttacacttttaatattaaacagtatgaaaggatccaggtagttgagcaaagttcattttcctatttctttgaaaagcatctctataaaacataaaaataaaaaaaaattagccaagtgtggtagtgcacgcctgtggttcctgttacttgggaggattgcttgagccttgaaagttgaggctgcagtgaggcataatcgcacgactacacttcagcctgggtgacagagggagaccctgcctcaaaaaagaaaagtgggcttcgagtcagacagtggtattggctccagagcatctgtataattccagtaaatcatctggtttggattgtaatgaaccccccaaagtgtgttactcatagccgaagaaatttctaagacccttaaatgattactgtcaataatctgagactatttgcattgcctaaaatctgacaggagatctccatgtggcagttccagctaataaattatatttctact

SEQ ID NO: 130272 - DNA, 1047 bp, Homo sapiens
atttctagatgaggcaggggttggcagtctagagcccacagctttctttttatgtatgtcccatgatctaaggttgtatatttaaaaatcattgaaaaaattagtagaagattggtttgtgatgtgtagaaattatatgaaattcagatttcagtgtccataaaaacaaaattttattggagcaccaccaccctcatttgttgatgtattgtctatgactgctttctcaatacaacagcagtattgagaaggtgtgttagaaaccttatggcctgcaaagcctaaaatatttactatttggctcttttcagaacgtttgtggacctctagtctgtattaatgaataatagagtgtatgggattataagtttaggtatatccaatataggaagctatgttttatatataaccaattctttaagtcagtgtcttctaatcagttccacttatttgtccctgctggttctagtctctttttttttctggtagaagttgtatattttattctaattttgtttcatttttttcttttttcctattgatcagtaaacagtatatgatgtgtattattataggaagcacttgggtttgagaagtatctttgtaaaataaatcttgaataattttatattgtttctatacagttgattgatggggaacactttttatatttgaagttgactttgataggctaagttctttttaaaaataattatttcatatgatcatattagcaacagaatgttattcttactggatttagttggcccgaggaagtcataatttagtttgttcctaacacaactggagtaaatattcttagaatacttcacctctttgatttgaatgctgttaccagtgtataaaattttatgtatctatttgtattctatttgatagcttttattggttcttaagagggtttgttaaattttcgtttccaaatattgaataattttgcagttgaattttttcttttgcaaattttatggtttgggagagataaaaataatatcaaaccagaacaaggataatggaattattgat

SEQ ID NO: 130273 - DNA, 1040 bp, Homo sapiens
gaatttgccaccttttatattttcatgtactttacattctttttttctttgcatttaaatatatttaaccaagttgaagttgtcctttatatgcagtttttgtagtactttatgaaggtatgatagacatacagtaaaatgtacaaatcttaagtatacctcttgatgactttattttatgtatgtatatatgtatttatactttatttgatgactttttacatacgtatagcctcacgtgatcaccactcagatcgagatacagaatgttcccaatcacctctgagagtttcctcagacctctttgtctttgacacatccttctcccagaaataatcactattttattatcatagactagtttttgcctgttgttgaactttttatatctagactcatacagtatttatgtgcatctggcttcttttactttgtataatgattttcttgtttggggattcatccatgttgcttatatctgggttttgcccttttttattgctggttagtgtactttgtatggatatatcataatttgtgtatcttgtatatgcaaaacaagcactctcttttcacttaatatagtggccatttgtcatatatttaagaatttttttttcttttctttctttttttttgagacgcagtctcactctgtcacccaggctggagtacagtggtgtgatcttgtctcactgcacccacagcctcccgggttcaagtgattcttgtgtgtcagcctcctgagtagctgggattacaggcacctgccaccatgcctggctaatttttgtattttagtagagatggggtttcactatgttggccaggctgggggtcttgaacttctgaccttaagtgatctgtccgcctcggcctcccaaagtgctgggattacaggcgttagcccctgtgcctggcacaaaatgattttgatggctacataatgcttcatatggcttcataaggtatataaatgtatgtctatttttttatctaggttgtttatgccctcttttttgttaagattgctgcagtaa

SEQ ID NO: 130274 - DNA, 1045 bp, Homo sapiens
ctaacattaatcatttataaaagttgtatataccactgttcttattatctctgcattcacttatattgtttttttaaatggaaagcaatttttatttatatatagctgtatacatttatgtttgcatatatacatgttacaaatctacaactaatgcatttatgtttgagctctattcagttgcttacaatatcttagttgtgcataattttctatggcacatttatatcttggctattggagattatcataatgatcataaaatttgtatataatgtggcagcatttgttctctaagggttgattaatcttcttaaagcaactggctattaggttatttgcatcctggcatctcctacaaactaaggaaaataagaggaaactacaatttgtcaattttgttttctattaatggtttttatgaaggatttaggggcaacaatttaatttgttcatatcttttgttcttgctttaacagaaaaaatagttgtagccttggtctacctttccagctatatgtcctgactctctttctgactcattctgcccttaatcatgttgaactgtttgcatttctcagaacgctttatgttcttttcacatctctctgcctttgcctaagttgtagtgtctttctgccttgaaggtgcttttgcccttactcattgttgagcactcagctccatgttacatcttccacacgtttgtgaaacctctgattcctctactgggcctccagtgggacctatagttctctgtggtagccgttactgtgttatagtacagtaatatatgttggtcattagttttgtgctagactgagcttgtttttgggtgtgtattttactcgtttacatttcttggtccctgtagtatatactctttgctcctcattgccaattccaggtattcttccttgagacagtcccccagttttgagtttcatattagcagacacacttcccacattccctcatgattgtcatttacatctgggtgattccatcacatttcttatggctcactttcactctctttagcatt

SEQ ID NO: 130275 - DNA, 1253 bp, Homo sapiens
agccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttg

SEQ ID NO: 130276 - DNA, 2138 bp, Homo sapiens
ctgagactaccgatgtgtgccacgacgcccagctaatttttgtatttttagtagagggagggtttcaccatgttggccaggctggtctcaaaacacctgacctcaagtgatccgcccgcctcggcctcccaaagtgctgggattacaggtgtgagccaccgtgtccggcctgaaaacttattttctaaagggaaattaatcttaactgtttattgatttggagattgtatctcattggtaaagaacagttacttccttcacagtctaaagacaaattgtgtattattctgtgttaaatagcatggcactgttgatcaggagtttacttctgtctcattacaatgtgaacttgttgcccataaaataattctcttaagattgatacatcctgactatgtactaacatgtcatgtcagtttattattttaaatagaatgtgctaataacatatcattttaaggtttatgtgaactatttctctgaaagaataaaaatttgtcactgtataattgaacatatattgcactttgtattcacaggtttgggggaggcagatcagacatgtaaactatgtacttcttgctaattgaaattatttctacattaaacagacttgtagaatttacttatacatgcttgactttttaattatcttttttctccttttcttaaagatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttact

SEQ ID NO: 130277 - DNA, 1025 bp, Homo sapiens
agaatagcagtcacaggcaatgtgaataatagcttgtcctggcattataggtaaatttgggtaatcttacaaagataatcatacgcttgtaaaaagtataacacattaattttcttattagaactttccacaagtcagtatcttttcctgcttagctctaggtgttatactgctttgttccagtataacacctagttaccaagacatatggactcttgatgtttcttagcatcatctaattttcaaaggcttacagaacaggccagtttccttatgtgactttcaaggctaggcagaaagatcagaaactgaacaaaagcttactaagaattggataaactcactgaaacacttagcatttcagtttctagaaactaagtggaattgtgtgcctcaggtctcaagctccacagtcctcctgtgtggtgcttcctgacatacttgggtcaaggtgagtcagtgtttgtcagatctaagcaaagaggcaagagaggtttggtttagattagtgattgtatatatacttcctggatgctggatgcaggatggaggcacagttaatgaaaaacaacaaatctgaaatttgcttcatttcctggttttataagaggaggactctgctgacatgctaaagctgagctgccaaataccagtgttaaagttcttggaagaagacacaagggctccatagctcaggggttagagcactggtcttgtaaagttcttggaagagacctctctcagcttaaatttgtggttttctacattattagttagaatcccttaagaattaggccagtcactgtttaccccactgttattgtctttgcttgcatcatagcttgtatttatttcttttgaggttcttatttaccacacagtgatttattaccatgtaaaaagtcacctcattagtgtttagaggtctttggatatattaaataaaaagttgtattgatagtgactgcacatttctttattacttacttgtagttgactatcaatgtgttttccagaattccttt

SEQ ID NO: 130278 - DNA, 1050 bp, Homo sapiens
cttccttgaagtagtcaggcatctaatttcataatattcattttttaggaattttctcaaattgtgtccacagattgacttggaatacctaaatgtcttgactgtcttatgctctaatgtttctttttgttaaatgaaattactaatattaacacataagagcattgtgaggctcaactagactgatagttacatatatgagttttagaagtgccaaatggactaactgttttccttcctgctatcacagagtcctactcacgattgctttctggttagactttccttaaatgatgtcataccaaattcacttattttcattagcctcaggtagaggagaggattcccttaatctctcattttcattagcttagctaagcagatttaagtctgaaaataaatcctgcatatacactatacaatatttaatgataggaaaataatcaagttattggaatgattccgaaaggcataaaggagactaaaggataaggatatctatcatagtatctataaactttaatatagctttaatataaatttgatgtttccaagtctttgtagagggtaacattttcttttgtctaggcagtatgcaacaaatttcaggaaaagtctcttccataatatatcttcagtgttgttggcatcactttatctgcggtagctcccttgcggagctgccatatatttctcatatattgttctagtcagggcatatgttcagcagaaaggccaattatagtagaaatgccaatatatatttttcccattttttctcttaaatattgtttagaaactgaatcttctggtctatctttgatggtattctattacagtaaaaacagttctttgtggaggtttgtacattgctatacttctcccaacaaatctagtttagtagacttttctgttttgttttgagacgaagtctggttctgtcacgcaggctggagtgcagtggcgcaatctcggctcattgcaagctccgcctcccagtctcacgccattctcctgcctcagcctcctgagttagctgggactacaggc

SEQ ID NO: 130279 - DNA, 2104 bp, Homo sapiens
tgtggtggcaggtggaggctgaggcaggagaatcacttgaacctgggaggcggggattgcagtgagccaaggtcgtaccattgcactccagcctgggcaacaagagcaaagctctatctggggaaagaaaaaaaaaaaaccatctgtggaaactatgcttatttgccccttatgtgaatgaactattgaaaaaaatttccttttatttcagaaattcacctctggcatgtaaattcacctctggcatgtaaattcaccctttatatgtttagacaaacttctaaaattctgtatctggcaggttaggccctaagggttacctattacatgcaattcccctggttttggttgctaaaagttttagggtggctgcatttgccctgcatgcagtatgttaaaaagcccctgctgttttatttaaaggttattgagatctgaattatttttatctcagtcctcttctacttcacagttgtttctgtcttcttcattactggttctctttgcttacagaatatctgctgcatctgctgtaggtgttttctactgctactcatcgcttttctttctcttctctcctgagtaccttttggttcatgcctacttactggctctcaggccaagtgatttagtttataaccatttctctttaggaaaaatactgttctccttgtgctctgaattggctgggtgaaacatgatgtagtaaccttcgtgttgctattttctttaaaggttggtgattcagttttgccaaagaagataatttggcagttgttcttttttttttttttttttttttttttgtggcactttcagatcactattcttcttgacttcttgatagagaccttactgggaaaaatatctttttttttttttttaaggccgagtttcgctcttgtcgcccaggctggagtgcggtggtgcgatctcagctcactgcaacctctgcctcccgggttcaagcaattctcctgcctcagcctcccaaatagctggaatgacaggcacgtgccaccgctcccagctaattttttgtattttttagtagagacgggttttcgccatgttggccaggctggtctcaaactgctgacctcaggtgatccacccacctcggcctgccaaagtgctgggattacaggcatgagccacaccgaaaaatatcttttaaaaaaataattgtggccaaagaagaaactcttgggtattgcttgtgttttaatgaaaatatcctactggtcaaatggctttttatggcaaaatgaatacctcaaggtagatgtccgtaagatttgtaaactcccattctgtacatctacaacacatgggagtatcagatgcatatgatgtaataaactatagttcatatttatgaaaaataaaatttcattaaaaaacagttgtggacagactccagtgtggaactataagaccatgtaagcatttgttttcttttacagagcaatacttttttttagcaaaaagtaatgaagagggtactagcaccgatagatgtaattgagataaatgtcatgcatagagcgtagccattacaaaatcaaagtcctttcagggagtcttctgcaattaggtaggataagtgacttgatttctcttattttgagactttacttttgttttttagcttttttttttttttttattagtgggaatggagagttgatgtccagaatttaaagaaaaaaaagaaatagatgcaagtatggaaaatcgttcctttgggaaaaaaatgccttttgctgtcttatctagtcttagccaaggaaatgtgtcccatatgttagttaatatatttgaaatattagaagactctactcatatgaaagactgctttattaacatgtaaatctttgtaaaattgtaacattgtaacaaaatcagattcatagctagatatttaaaatatatataaaacttagcttatggtaatttcctataacatattccatattaaactatagcataccttattctattcatatttacctcactggttcttttttctgctctataaagagaaaaaagggtatgcctaaagcaatactgtatatcttttatcagtttctgctataactta

SEQ ID NO: 130280 - DNA, 1123 bp, Homo sapiens
gcaggctgtacaagaagcatagtgccaccatctgcttctggtgttggcctcaggacgcttaccatcatggcagaaggtgaagagggagcagtgtctcacatggcgagagtgggaacaagagtcagtggcgaggtgccacacattttgaaacaaccagatctcaagagaactcattcactgtcgaggacatcaccaagccattcatgagagcacacacccagagtgacccacacacctcccaccaggccccacctccaacattgggggttacatttcaacatgagatttggaggggacaaacatccaaactgtattagtcagagagatcatttgggctggagcggtcatcacagattatataggacatttatagccccttgtaagaattttgactttttactcttagtgagatggggaagcctttggaaggttttgagcagaggaacgatatagtcctatttaaagttaaaaggaacagtctggctgttgtgtggcatataaaccgttcagggcataaaggtgcagggagatcagataggccgttaaagtaacccaggtgagagatgatggtgacttgcaccagaagggtagcagtggacgttttggaaggtggtcatgttttggacctgttttaaaggttgaaatcaacaggatttgctaatggattaatttggagtatgattgaaggaggggaggagtcaaggaagactccatgatttttggcatatgcaactgtacagacaactgaagtgtgaattgtatgctttgggggcaaaagggaaagcaaccaatttagaatattctaagggggcaaagaaaaacctatttgaactggtagaactgggccttaaaggacaaaaagagtttatgtgaaaagtatagggcaaggtgtgaaaggacttggcctccttacatttgtgagcatgggctcttgtagttttatgtgtcgatacatgggggattacagcaggagatgagagtggaaggttattttggggcttatcaaaaagggtcttgcagtgtgaaagaagtttgacgtttctatcataggtattaggagggatggcccatctccatcaaaactctgaagtccacaactgggcgtggtggctcatgcctctaa

SEQ ID NO: 130281 - DNA, 1008 bp, Homo sapiens
gggttgtgcagttgagatttcctcaggaggggtgccttcaatgtcattaacattggagcatgggctagcaggccggtccaggggtctgtggtagattttagtcatggactgtctggggctccatttgaagaacgatttgtagttttacagcttcaattctggaagagacaaacttaacaaggaggttaaagatagagggattgaaatgtatggcctgcagtgcaggggattatttctttggcacactttacaggccttgactatctgcttgatagttttgaaaaggtctggtccagtaaataatgatttggccatctgatggcacacccagctaatttttatattttttgtagagatggggtcttgccatgttgcccagactagtctcgagctcctgggctcaagcgatcagcccacctccttggcctcccaaagtgctgggattacatgtgtgagccaccatgcctggcctagtccaggtttttatcttttatttgaaccattacagtagcctttagttctttgaattcctacatcctttcacggtgccaatagatttgtttgaaggcacagttatctcactggttacataccacacacatggacatgcacacacatccccccccccccacacacacactcccacaccccactccacccccccaccacacacacactctgtctcactccaccatccccagaattcctcaccccctgacagtaaaacctcttaatgtttatttcctatggaatcaagtttttagcctggcattcaagtccctgtatagtcacatccaaacttaactttttctgcacctgcatgcattctgtatggtaatatttctatatagtacttcataatttaacttccattctgattttgttttctaacatcttttaatgaagtggttaggggaggtagattcatcctcattttatatgtgaagaaattgaaacttgtagaagtgaagtgccttgttcacgttttaatacctagtttataggaca

SEQ ID NO: 130282 - DNA, 1019 bp, Homo sapiens
ttggtaagataagtaaatgagttactataattacttattcttcagagaattataacaaagcacttcatttttaaaatttgaggcttgtgagatccgttggctaaaatggtaagacatgatgccagctctctctagtattgctagcaaatgagctattctggaaaatacaaccaaatacctgaaatatttcccagatactgaaaattttgcttgttgggtgctgaaatgtactatttggaggaaaatcatatttcattgtcactttaaacaatataccaaacacagcttaatcttttcttagttatgtaagagaagagataaagtcagttattgtatcatgctataagtaaagagataattgttttaaagcatagatttaaatggatactgactccttaagttctaaaattttcatatgagcagaaaactaccaagacttttaggacttatttttatcattttcataaaagttaaagtgaaagggtatgtgctattgtgacctctagatgtctacaataagcatttgtagactataataaaaagaacaaacatcttctctccagaagattgtcatcacttttgttgctttctggctggccagcatcatttctgactgtaaatgtgtggagacaacaggatctcagtctgttttcatcatcagcctatttgtctaccttcaactaagttcaatgatggtatgggaaggaagaatatttcacaccaattcaaaagcttttgactagggagatattgggggaaggcttactctgggagcttacagatttttcaccagaggaaaataatatttctgtaagcatgaaaccaagtcaaaaatgtgttctctaaactctttccttaatatttaattctaaatcaaatatcaaacttaaacattatgttgaatttcttctttaatatttctgtaagttacagcatttgtaataaattctccctattgtcctatttcaaattcattttatcctccttccctgattttatttgtctgttcttctaacatt

SEQ ID NO: 130283 - DNA, 1423 bp, Homo sapiens
tagacctcctttgccttttcttgcatctgcttatcttgcattaaaaaaagaaatctttacatgctagccaaaacaaaatattttcttcattgaatatctttttaaaaaatttccttaatcttttcatgccttctaggtcttccagcagattctccaggaaagccacccatttggctgtgctcttgaggctctggtggctgctgccagaactactattactgccatagatgtatttactggtttataggaaagaatattataatgcatacagatgaagaagtacatgagggaagggatgtggagtttccatgttccgttccagatgtgccaccctccaggaaactccatacattcagctgcctggaagctctagtgttgaaatagtttgacaatagattgtgaattataggacaggctattcaaattttgagcaatatgtatatagaatatataaggggctagtaaagagaaaggtatgaacatttggaggaaatttaatgatttcagattgtagaaggatattatcaaggataactggaaagatgttatgttgtttttttaaaagtgcaggctgagtgtggtagctcacacttgtaatctcagcactttgggaagctgaggttgggagaattgcttgaggccaggagttcactaccagcctgagcaacaaagtgagaaccccatctctaccaaaaaaaaaattagctgggcattgtggtgtgtgcctgtagtctcaagctacttgggaggctgaggtgggaggattccttgagcccaggagtttgaggatgtggtgagctgtgatcacaccactgtactccaacctgggtgacccagacctagtctcaaaaaggacaaattattattgatgttcttttctagaaacgactacagaaagaactgttggctttgcaaaatgacccacctcctggaatgaccttaaatgagaagagtgttcaaaattcaattacacagtaagtatttaattttaaaagggctctttgttttattaccaataatgtatgaatgttcacccgctttttaaaactacaaaattattttcacatttcattctttcaccaagaggtaaatagagtaaacagatcttattctgtgcatttatatatataatcaattttgttttacggcattataaacattgttgcataatttgtaaagctgtttttaaactatctttggtacatttttaaaaaattttgtttaactgagtagcactgactttgtttatgaagtgattctcatctataatattaaagaactgtttggtgtgaggttttatcaaattaaaaatatgtatctatttaggcatatgaagagagtaatagtcaaaaggtatcccatgccctaaaaacatcaattgcgtcctgtacagaagggcaacaaagtgaaagtgtgactctca

SEQ ID NO: 130284 - DNA, 1404 bp, Homo sapiens
cggtcgaagcggacaccagccggccgggaagttgggtgataaaggagggttggggaagaaagggcaaagtctggcgttggcggtctcagaatcggctccccgcacacacacacgggcgctgccagtctgctgcccgccagccccagggttgcctttacccccgctgtccctggcccgacggaaacagctgcgcccgcggttgttgccggggcaggggcggcggggggctgagtgtgcgggagccgagaatgcgtctccggagaaggcggctggctgcggacggcgcttagcggcctctgctccggcctcccacgccgggccccccagactgctcggccccgtccctctcttcttccctttgactcttaatcctgtgcccgtgggtatcttctatttccatcagcctcggtattctcgcggacattcctccagcagtccactgtctccttcctctcgaagctgccccgtgtccaccgcctgatgggcgatctcccgagagccgagtcctcagcccccttaaacctctcgggatagcttgccttctattttgtttcccactgcaaggccccacccttgcggtcgcgataaggctatacatctctttgcccttattcccagacctttagtggaaccttagtttggtaggaggcgtttgttaacctgtgccatatccccccgacttagcaaggcgtggttttctggctttccaacttaatttactcctttttcccgaatctagggagttgtgggtttttttgttttttgtttccaggcaaagatggcaaccacaattgtagttgtgcagggattgagtgcgttatctgtagcctgcatttaattcacaggtgaagactagcggtatcaaaggcattggaagagaaagtagaacgctcaataggagtgtcagctgagtaccctttagcgttttcataatatccccttgggtaaagagaccacattttcttagaagtgttttttgcttttgtttctggaagaagcaagtctctgttcctcctccatttttttttctttactctgctaaaagtgtttttcttcccttttctgcatcttcttcctcttttgtacaaatatagctttgcttcacatttactcctgtgcttttatgttattcccctttcaacctgttttccttacaatattctctttaccttgcttctccctctggacttgcctgcagaacagaaaagttttatgtaacatttctagttgaagagatatcacgaatggtgcagggaaaaaacaggaacaatttcaggaaacattatactttacactagtctccccagagacgttggagaagtttcgtcatttgaggccaaaaaaggaacagtggaatgctagttgaacagtagatgcaataggctacattaccacttaaagatt

SEQ ID NO: 130285 - DNA, 1027 bp, Homo sapiens
tgctttttaaattgcttatctttcatgcagttattatcaagataatcttccttttttaatttaatttttttcattttgttttttagagtcttgctctgttgcccacactggagtgcagtgtgatcactgctcactgcagtcttggcctcctgggctcaagtgatcctcccagcctcccaagtagctagaactacaggcatgccctaccatgccgggctaattttttttctttttaatcttttgtagatacagagtctcactttgttgcccaggttcatctcaaactcctgggctcaagcagtcctcccgtctcagcctcccaaagtgctgggattacaggtgtgagtcaccatacccagctaatctctctgcttagaaagtggggacatacttgttgatactgtgaaaaagaatttatcttaggtggcaaattcagctcatgctaacagagaaatacatttagagacatcttactatgcatggagctgtcatcttagtgtaattttgctaagcttatcaatattatttgaaaatagtgcacatagtctaagaaataatataaaattgttgtttaatggccaggcgcagtggctcgtgcctgttttcccagcactttgggaggctgaggtgggaggatcacttgaggccaggagttcaagaccagcctggggaacatagtgaaaccccatctctactaaaaatacaaaaattaactgggtgcagtggcatgtgcctgtagttccagctactcaggaggctaaggcaggaggatcacttgagccgcagaggtggaggttgcagttaactgagatcacactgcagcactccagcggggtgacacagcaagatcctgcctctgaaaaaaaaattgaccgggcgcagtggctcatgcctgtaatccagctctttgagaggctgaggtgagcggatcacttgtggtcaggagttcaagaccagcctggccaacatagtgaaaccctgtctctactaaaaatgtaaaaattagccaggcatggtggtgcatgtc

SEQ ID NO: 130286 - DNA, 2013 bp, Homo sapiens
aggttgaaagtagagttggtctcttctgaggctctctttttgtcttgtacatggccatcttcttcctgtcttcacacagttttccctctatgcccatctctgtccggatctcttacgagaataccaatcatggccgggcgcggtggctcatgcctgtaatcccagcactttgggaggctgaggtgggtggatcatgaggtcaggagtttgagaccagcctgaccaacatggtgaaaccccgtctctactaaaaatacaaaaattagccggtcgtggtgctgcacacctgtaatcccagctactcaggaggctgaggcaggaaaatcgcttgaacctgggaggtggaggttgcagtgagctgagatcccgccattgcacttcagcctgggtgacagagcgcgactctgtctcaaacaaacaaacaaaaagacaccaatcatattggattgccaccctaatgacctcttttaattacctctttaaagaacttatctctaaatacagccacattctgtggtacaaggggttaagacttcaacatatgaatttggaggacacaattcagccaataacatacataattcttttgttttacaggtcagtttgctgagaacgaaaccaatgaggtcaattttagagagataccttcacatgtgctatcgaaagtatgcatgtattttacgtacaaggttcgctacactaacagctccaccgagattcctgaattcccaattgcacctgaaattgcactggaactgctgatggctgcgaacttcttagattgttaaataaaataaattataataaactgttaactcttttcagtatttaatacctgtagttcagttagtaactttttcatatatagcatgttgcctgtatgcagttgaactatataaagttcattgcaaagcagattatcttgtttttttgcatagcaatcaaagttgaaatttgtttgctacatcaacaaattaaggacattttcacaaactgagaaataaacaaatatgccaattcgtaggtggttttgccttatcctttgaatgtgacttaaaatcagcaatgatgatatagtaaatactgaaatttaggtgtaaatcaatacgttctacagggaaataatgaggctaagtatttttatgtttttagtggttttttagaaacctaatcttatagccgccattagcattactagagttatgcaaataattgcattataaacatgtttataacttagccaaaacattgatttttataactctccaagtatgagttgaaatttcttatgtcttttgataaactgcagtattctttaagtgtactttgtccttttgtttattgctacaatttaagaactttatttaaaaacaattttggaaggttactaggtacagcttttgcagaagaaactgaactgtagccagatggtcagcaagtaaactacatgacttagagttcttgtgcattatacattttgggtaattcaaagtactgtatttgcattgactataaagcgtcgtttgcaatatttattcttccttcatagtcccttgttgtgattatacttccagttgtttaaatgtattttaaaagactcactattaactttattcagatcttaaaagctacacctttttgaactattccagtctttctccatccaattagaatgttatggaataacatgtgaagagatacagtgaaaatcatattataatgcattgaagatatcctacatgaattatcttctattaaaatatgtcccaataaatatacccataatcagtgggtcttctactgaaatcaagctcattcagcttttctattaagcagccaaaaaattttttgaaaaaatatgacagcatcattccttatgcatggggaaagaagcactggagatgggtttagtattgtctttatctcagaggtggaacaaagttgtcattatagggtctataaacttaagtctccagcttatttgagactggcttaatatggctgagcccggtg

SEQ ID NO: 130287 - DNA, 1031 bp, Homo sapiens
tttagagataggatctcactgtgttgtccaggctggtctcagtctcctgggttcaggcagtactcctgcctcagccatccaaagtgctgggattacaggtgtgagccactgcacccagccctgtcttttttattctcatggaagttacttcatgtccttggttatatcatgccattcattcaagcaaatatttgcttattgtctaccactgtgtactaaatacaagatccagaacttgctgtgtcctcactgttttaagtcagtatgcatcatccttccagcatgtgtaccatagcaaggtgtacagagcattgctaacctcaaaagctcacttgagctttggtgtccagggattttcttggggtttcattctgtagacatgattgatgagtcataagcaacaaggctgagctgagtcttcagcacccctccaactggaggtcatgttgatatcaaaaaaggcacctcaaagctttttgtcctgagtccttttgttagtttaaactatccaaaggcccattatgagttacctggttaacataaactaccaggacccatgaagaatagcaaggacttgtatcactagggaaattccaaggatttagaggccacctctcaaaacgaggatcaaaaaccagccaaattctttattatacaacaggacccatagttttgtttggattttcaacggaggcctttatccagaaaaagaataaaggacctctgccttaaaacacctcagtatggcagttttttctcgataattatgttccgtgtatgtattttaatggaatgaacatttttacacgtctgttacttttaacatgtcacattttacaacctcttcaacaaccccacccccaatcaatttataatgattatatgttatgtttctattttaagtaatctttctctgattcagaagtgccaactgatcaagctcacaaagcattttggtattcttcaattgattttataaaagtacagtgtttttgttgtaggaatggtgagctcgtaatgtaaccaggagg

SEQ ID NO: 130288 - DNA, 1182 bp, Homo sapiens
cggacagtctctgtaaccaccaaaatcttaacacgcagtgcgagaaactacaagtcccaggatgcagggctgcctcggtcccaacgccgacggtatccaccagagaaactacaaatcccagaatgcagtgctctctcggactcccgagagcctctctaaggatgcgtctttacagcaattggatcagggtctgcgctgcatgctgggaatccagaagagctagactcggattggtcgaaatttgccggttgcgttcataggctggcctactataggggaaaagagtagggcgctacgccctacctccagacggaagtgagcgacacactctgcgtcctcgcctcaccaggtacggatctcccgcgcgtcgccgaaagcggctctgacccagcggaagtaattctttcgactgccccggaacccaccggagcaggcagctgggggtgggggggcggccctgggataggggctgtggcagtacgcggggacccggctgcggtggctgcgggactgacgagtgagtctcgggctggggcggaaacggagctccgggtaagggtggagggcgagggaggccgagacgggacgagctcgcaatcccacttcccaccccttcccttctaggcggggaaggaacggaagctgttaacctccttgggcctccccagcccctagtttgggggaggggagaagagggcggcgggacctttcctggcgccgctcggtgggtttggaaagaggtggaaggaggggcagcagccagcgagactgggccttctccgggctgagcgcgggagggtggagttaggagcatggtagccctgtcgcttttcctttctgcttgttcctcgtgtccgctcagattagttcttttcttgaagtcagtccctagcccagggagaggtctctcgcttcttctagctgcagtacccgagaagtttaccttctgggtaacttgttgggtgattctatgctcgacttcatgagttgggggtatcgtgcatctactggccgtccagtcttgtctgaaaggaggtatctagtgtgaaatactgtgcccattgagtttctcttaaggaactgagatctgttaagtaacatataactgtggagtttgtgccatttagcgtgagcatttctactccacattgcttttagtgtagaaaaccgaaattctttttt

SEQ ID NO: 130289 - DNA, 1109 bp, Homo sapiens
gaggtccccgggcctctgtctcccgggcgtcctccagcagcgggccttcggggccggtagccggctggagtacggggccttcgggagccgcgcgccttctccggcgtccgggtcgagcgcaggtagggcgtccgaggtctggtgtcccaagtgaggcggggagggcgggcgtcgtgtcgggcctggggagccccagcggctcttcgcgacctctcccaggtgtccgtggctggagcgcgggaggagccccctctgcggggcttgcagaagtagcaggccgagggccccggggtcctcagcctccgcgagtccaggagaacggctggaaagtgcttacttttatggtagttccaaatccagagggtttgtggtgacaactatatgtagttccttttctgcccttgagtagaagcttagaagtgttaatttgcaaaaaattggatgcagcacctggaaatagaaccgaaagagccaggttaacctgactttgagcttgttctacttttatgaggtggctgtacttttaagaattactttggtccctgggaaaagggggatgcagatgttaattcttttattttgatctgaataaattgtcttctaattctactctgtaaaatatcaggattggcaaacctggttaaaacttggaagaaatgcttaaaatggaaattggaatctaattacatttcagcattgaggaattaggcatgccttttacattttgaagtgtatacactgtgaaactcattttcagatgtatggggaacgcttctgttcccttgaaatttgatgtaggatttcaagtaaattttatttctttttttttggaggtgaagtctcgctctgtcaccctggttggagtgcagtgacgtgatcttggctcactgcaacctccgccttccgggttcaagcgattctcctgcctcagcctccccagtagttgggattacaggcgcgctccaccacaccccggctgattttttttttgtatttttagtagagacggggtttcaccgtgttggccaggctcgtcttaaactcctgacctcaaatcatcctcctgcctcggcctgtcaaagggttgggattacaggcgtgagccgctg

SEQ ID NO: 130290 - DNA, 1048 bp, Homo sapiens
tgtggacgtggttccaacattcactcctatctcattagaagaaataggtagcagcatcactcaccagtcttatgccatgacctgctgctttaacatctcctggaatgttctgggagagaacgtttcgtttgcttgtgcacgactctgttcatttttgctgtttatttaaatctgacgtatagtcatctaccacctgcggtcctggccggacgaaacacacgtgttgcatctcaaggaaaagaaacaacaaaatgctagtgaaaatgtgcttattttgatagcaatataccatcttttatgtcatttattcttcctatacttgtaaaaggttatttatctttaaaatttagcaatttgaagacactatgccttcctaagaactaatttaattctaaatatttttaacattactgaggtgaattatttatgcacttaggaagtgctaaattttaaaagctgaaacacaacagaattctaagaaatatagtccaaacgttgcatggattgcagtaatcagtgtttaaaggattcagtttctttgctgacgtactttacaaccaaataaaatcttgtcggtggctgtgttaattcccatgaaagttaagcaagatgctattaataaactgctctgctctttcttgttttctttttccaacttaaatttctgttgaatacattcaggtagaacataaagccttgttcaatcactgcctctcagttttctgcctttcctgtttttcaaagtccttttgtaatttcatttcacattttaaaggcttagacatttttattttaaatatgtgtcttttacagtcttttgtcattctgacatttctggatttttgctgttttataatttaccctttgttattcagaagcatgcttacttatagaaactaaatggtctttataaaagtaattacttaaaaagaaatcaggggaagaaagatatctatctaatctattaaatctttataaaacattacattgcagagggggagctactcctaaatattttcatgatttgcatggtttaatcagatttttt

SEQ ID NO: 130291 - DNA, 1032 bp, Homo sapiens
ttcctctccctcccccattttactcatcaccctgtttgttcttcatttaattcagtgatttaatccatttcgtttaacaacccacatttgggtcaggcactgtggtacacgcctggaatcccagcactttgggaggccaaggtggcaggatcgcttaaggccaggaagttgagaccagcctgggcaacatagtgagacctcatctctacaaaaaatacaaaaattaaccaggtttgatagcacgcactgttggtctcagctactcaggaagctgaagtggtaggatagcttgaacctgggaggtcaaggctgcgatgagctgagatcacaccactgcattccagtctgggtgacagagcaagagcctgtctcaaaacaaaacaacccacatccacggcacttggaaatgtgctggaagatagtagagtctcattaaatattggttgcctgaatgaattgggcaatgtcacgtgtctgtgcactgggtacatagcagtgaataagacaaggcccctgccactgtggagctcagagtcttgtgggggaaaatagcagttaaacaacaaaggataatcaagtgtgaaacgccttgtgatagagaaagagcagggcactctgacctctaccacggagatgtgggctcagtcagggaaagagaccttcttgagtcaatgatgtgtgacccaaaccctagacccgaattgattagtgtttgaccaatgacagctccaatctccattattcacttaccccacacccaaaaaacatcaatacttttgaggcctctgtaacattgtttcagtgtagtcttacccagtatccaaatggagtaccactgtttcctcttctgtaaaatgaggacaataaaactacctacctcataaagccagtttagaatacttttaatgctatataagaattagacattattttaacagtaaataccacaatcatgtctttgtaataaaggtggcttcttcatggagcagatctgaaaagatgggttatatgaggttggtttgtttaaacaag

SEQ ID NO: 130292 - DNA, 1035 bp, Homo sapiens
ctcttttacctaaaaaccttgacctgtgccccttttttccagctcccaacacctatggttttatgtgtccatttaatgttagtttctctcctggcctccttaaaagaatatacactttctcttaacttctcctttaccctcttattcctagaaataatgacccataaccctttcattcatttaaatcttagagcatgtatgagctatatgtgtgcttctagttgataatattacagggaagcatacaatataatcaaattcgaaccataattaggaatatttttaaaaatatttttaaaagctcaataataaccacttagattgttttttaaggccagaattggtctctttcctgatttgattctgacgtaagaaagaggactcagaaacctttctccccattctcagagcagggggtggggaagtgtgtctgcctcatatccttgttctgtgaagaaaaactgatgactgttacattaaaggattggaagttcctttaaggacgttatgctcccattgtctgttgtgatgtagccacagtgggcttccaaggcaggttcttgatccagattagtgaatacacaacctcttgccaagtgcagttctgcatagttacggtgaaagagccgctcacatttttcgttgtcatgctggctttaagaatgagcttaaagaaacatcttagaaaaagaaaagaaaaactaagaagaccttaggtaattttcttacttaaaagaataccagagagcttgggaaggcattcaggaaagaagatgacatcttgtttattgaaatctggaattcgctctctgaaagctcagagcactaagggtaacatgggatttatttggggttgtgttttcatgatattcaaagcgtaattatattcagtaacatgtgccctccagtaaaaacagacatctctgttttgatccattttcttcatctctgttttgctactatgtagataagtttgaaagtctgtatccctgactacatgtaaccaaatagtctgtgaatggtccctcctgtgtt

SEQ ID NO: 130293 - DNA, 1426 bp, Homo sapiens
cccataacattttaattatttccaggtgaaagacagaaccacgcggaggaaagaacatgagctgagtcattgaacacactcaggtttagtcctgattctgctgtttattggtgtgtactttggacaaaccattacctgctggagcatatttccttatacataaattagagcgaataataaccttgcagaactgttgtgagagtccagcataatgatttgttcataaagtgcttagcaaagttcctaaaatatagatgctccgtaattgcaaggcaggcagtatgatatgtgtgtattatttgagtgtatattttcatgcatgctatagtcttatataaatattcagtttttaatttccacatttttgagaacttaagatagatttttgatgttaaatttaactctaaaatgtcttctggttagttaccctctggtgtgctgaatccacagtagacaatgtgtcgccgtctttcctttcctcctcagtttccctgttatccacttttctctgtgctgttccttcccttcctgcctcccttcttccttcccacctccattcatttcatcactaataagaaaggtgaatgtgtcagtagaataatcaaaaattaaaaaccaatattatgtgaaccatctgtctgctttgctgaagagtaggccagttcttggaagtcaaatttaaaatggccatttctgcacataatgagttcttacccatgaggatggcaaagtcccccaagttttcaccacctcacagctgaggaggtgataccttttgcccagtccattagggatatttgtactttgcaccctgtatggttctattatgatgcctcctaccatgcacttataaaaataatcaactattaatcctcgagtgttatgttaatatacataaacatctattgctagactttgcaatctacagttacaaatacatataacttcattttttacttactacagatttcattgctgtgcatagtccattatttaagattctttatcattcaaatgataggaaagtttagttagaaggtatatttgcctctcctttgttgaatctgatacctctatgcttatttaccaaagcaaaaaaattcaaatttaatatgaagactatcatcactaaataacaagaggtctagtttttatttatacaaataaatgaatttatttaaaaataaaatgcagctaccacaactatcgaatattcaagttgaagggaactttagaactctttagttttccagtggttttcaaactgtgttcctcagaattcttaggttttattgaagggctgttgttggaggcaggggaaagccaaggggtgaagatgggtaactgtaagccagaacatacacacttttatctgcttttatagcaaggggagagaatatgttagatttttgtataagaagtgaat

SEQ ID NO: 130294 - DNA, 1007 bp, Homo sapiens
tctctacatacttaaaatatctacaagcttttacctgaaatgtgcaaacaaaaggttattcaaataactgaagactgttacagttacataagtctgtggtttcacaccttctgtttatttagtattaggttggtgcaaaagtaattgctatttttgcgccaacctaattaattgcaaaaactgcagttacttttgcaccaaccttggtatttaccaaagatgacatgcattcatctctcttgagaaattgtccatgggcttaactctgtgtttcaccttcctagtaaagcatttccttgactattcctgtgctccttaactatcctttccttctccctcttgcgttttcttgtcttctgcccacatttgccattcctgcccaaccccattttcttactcttcccacctccccacttatagactgtgatcctctgtccttctggatgtctggctctactttccccattttcaccccaaagtcgttcatcaatctagttcatttactggatgttaattgagagcttactccttgctgatgacatgcatgctgttgaagaaatgggttttcagaggcagcccttgggtgagacaaataagtacacagccaattgcaaggcataagtgctggtgcagctgaaattctgctgcagagggtggcagaggcttagcaacccacggaggatgggaagatgaaacctgtcctcgccaaagcccctcctggggctgcttttccacccgcctccatctgccctcttctccatggcattcagtacagacctctgttttggtgtaatacttattagacaatattgtactgagtccagccagttctctttaataattgtataccttgcagatagaacacatccaataaattgtgacttccctggagttaattttctttgcagtaaagcgagactggtgacttagaattgttgtcaagggttttctagctgaaaaaaaaaaatattgtcagctaaaacaagtacatatttgtattgaaaacg

SEQ ID NO: 130295 - DNA, 1099 bp, Homo sapiens
tgtgtgtgtgtgtgtgtgtgtccttactgagattgctacataccaggttgttccctttcgtggaaatggtgattattcgtaactgaaagtcctttgtggttagtgatagtgatttcacaggactcgggtaaaacacacacgcaacgcctgagtggtttgagctaaaaccaatgagttgcagttttggaggttttcttgactcatgacctggggactgtacccactccttgaacaggtttcagatcaaggcctaggagcaagaacccgagagacccatctgcaggcaagctgcaagagaatatcctgcttttcctcaggatactagccctgccctctgtttagggccaagaatgccagaaagactctgggaccttattaaactgagctgaggggggagattttattcaagtgttgtctatgagatctgttaagccttagatttcttacccagaaaatgggatgatttggtactcagctcacaggagtttaggagaattaaatgagatcaagtatatgtgagtgcccttggcacagtgagtagcacttagtaggtgctaaataaactgttacagccaacaattgttaaatattttcatgccaagtattgtgaaaagacagtgttcgtcctcagagtgttctgggctgagaaattgagaaagccagcgtataatatatgaggtgatgagagctgtgatatagcaaagaactatatgtacacacatatagaactatatacacacacacacatatagtcacatgggtgactatatcatcaatgtatacatgagcccagcagagggtccctaatcacttagaggaaccaagagaccttctagagacttgagtcttgagcagggcctgaaggaaaccagtaggagtttctagaaatagaaaggggagaaaagctttccaagcagagggacctgcaagggcaaaagcatggaggattaggagctctcatttgtttcttccctgctaaagtgctattgtcattcaaacttatgtaggtccagggcacagagaagcagcatgtgtggttagtggtaaagcacacactctgtgccaccagacagtcgtttagaccctggccctgccaatg

SEQ ID NO: 130296 - DNA, 1189 bp, Homo sapiens
aatgcagtggtctggggctgtacctctgggaggacattactaggcattttaactgcatggagtcggtagggcaaagaacagtgagtgagttaagagtcccgcgaagcacacttggatgcagcttgagaacaagagcaaggggagctgagggtctgttttgtgttatgttctgtggtaccatctgtatctttatgttccttggtccctgctggaacttgtcacatgtttactctgtttgacgtccctctctggtttgtaatagagaatctacatagtctccaaagctggtcgggagtgcagtccagctgcaaatctttggtgatggcaagtccctgcttgagaggactccttgcccgtcggagtctgatcaaccctgctcctgcaaagaaacagccaggtgttgggtgtgtttgatgaagtacaagagtctctgttgggcagtctgatttttctgttaagaaaatactagttatatgaatgttctgctgtagtccaccagcagttttttttactgttcatcaaacatgaaaatatgtaaagataaaaatatttttactaaatgatgaacaaatgagtcaaaatataaaattgtttatgtcctgaactcttcaggtatcaatttctcctgcaaaatcatagcttgcattggcttatgccttatactttctgtctatacgtggacttcgagttagccagagatgtaaaagttttaagttttcaagccatggaggttaagaagggatttcttggatatatttattagcttgatttaataattctgcagtgtatccatatatcaaagcatcacgttatacgctataaatatatacaatatttatttgtcaattatatcttaagttgagaaagggaagagggatttcttggtagaaaaaaatgaaatttttaggcaagctgatatatttgcaggccctgaatcaagcagctataaagacctttaagaatttaaaataggctttgcataactggattttctcatgacattttgaagaacttttttcctttgagttttctgttcctcctttccccattcattgcatcactatgattaatatgatattctgctcacttaaattctaaataacttttagaagcctgaataaatactgaactagtgaactttaaagccagatagagttgctataaaatatttttcccaatagttaagcat

SEQ ID NO: 130297 - DNA, 1003 bp, Homo sapiens
agatttgtaccctgtagcttcatcctcttttgaaaagtcttacaacaaacccacctggattttgcgttgcagtgccgtcgagtacagctgagtcatggcaagagaagaggacaattagataaggggtgcctgactattaaaggatctgaaaagcactaaccagggtattatgcaacacacaagtggaaaccgtttcagagtgccgaggaagttattaacaggagcaaaacaacatgtgaggagagtgattttagctacagtgctcaaggtagattgcaagcagcagaagttggggatgagatcataaaggacatgaataaatgcatctaggcaataaagaactgcacccttgaaatttgtaaaggaaaacccatcttgtatacaacaaccagctgtatacaagggagttaacgttctaaggatgtgagtacaattagctaagagcataagtggcaccataaaggctgatggagacattatggggagaaagatagtgaatctgatgtgtggacattcaaggtgatagataaaaagataacatgagtttcaagtaagaacagtactttgaagccttgagcacttagcagcttcccgaggatatgaatacatcaaaattggagattggcactggcatttataacagcaattattaggaaagtgagtagagggggctggaatagagaaatctctaaagaagaggcagagatgatgacctgtgtgtggaaagaagcagagaattatttttgtgctactattaagacaaaatgctagacaaggttcaattgttgttataaatgtaatttctctatataatttcatcatctaaaatcaaattagcaagtactttttatttaaggggtaataagagtagtcatcacactatctagatagccacacactatcaaagctttaactcttcatgttgactctgactacgtttatataaaagaatgaaattcacatctataactttctttgccttagaaaaggcattttccagttt

SEQ ID NO: 130298 - DNA, 1120 bp, Homo sapiens
aggtgggtgcaaaggacagtggaccatgtgtatttggggtctggtaaaatgtacattgtggttgggaaagagtgctaggtgtagggtgttgagagatgaggagggtctcttgaacctataagagggagtttggacattatcccaaggataggggaaggctattgataggtgttaggcagaattacatcatcatctttagaaagatcactctggctgcaggtggtatagggaatggggacagtaaggggcagtgaaactggagacagattaaatagtcacaggctgggcacagtggctcacgtctttaatcccagcactttgggaggctgaggcaggaggatcacttgagcccaggagtttgaggctgcagtgagctatgatcacgccactgcattccatcttgggtgacagagcaagaccctgtctctaaaaataaaaaaatagttatctgctaactagtgatctaagtgatagcctatgtgttgggctaagctgtggcagtgggatggaaagaagcaaatgattgaatgagagcctcccaagcagattcactaggacctgtggctggttgagttaagcatggtaagcctagaaaaggagtcatcagagtggctccaagttcctggcttagccaactaatggatggtggtactgtttactcagaaggataccagacaggaagggacagatttagggaggaagataagtttggatttttggcttcttgaatttcaagatgctagcctaaaagataatgggggaagatgtatttggaactcagagatttgagctgtgcttgcagagcttggagccaaaccctgggaaagacttacgggacatgcagagaaagaggaaatccttgtatgtaatactagacacagctctttttaagaagtacaagtaaagcagttctcacattaagtgactaggaatttgttgccttatgacaatgcaattcaggtatctgaatttctattcttgaatttgtgaagttatgctttctaaggtttgtgctcaagggacctacccagtgagcaagctctgttggactgtttttttttttttttttcttttcttggcaacctactggaacaaaatatcactctcacaaattattatg

SEQ ID NO: 130299 - DNA, 1647 bp, Homo sapiens
aggctgaggcaggaatcgcttgaacctgggaggcagaggttgcagtgagcagagatcatgccattgcactccagcctaagcgacagagcgaggtctccaagaaaaaaaaaaaaagttagtgtagatcaccatcatccttttatacgttatccttttgttgtactttatactttatattgttatcctctgaacttcagagtctgggtgtttcaaccaaacttctggaatttgctcctagaagaatatatagttttcaaatatgtttctcttctttatcaaagaatgtccatttcccatgggagaaagggggggtgcctagtctaacttcgtcacattttttctgggctctttaaagaaagacatgattgtccatatcaaggggcccaggagcaatcattgagaattctctctgtgtgcatgcactgagggaacagctgaaactggaaagatgacctaggtgccagctctgtcctgcccctacctccaagcgaggggttaggcttggatgtaatagcactgataggtgtgacttggtagcacagagaaactcctctggccagctcctggccttcagctctgatgtcatatcactcaccacgcaacgggtcattacgcataacatgggaacactttgtgttatgacagccttgtaaaacctccttaggatatctcgtttctaaagatctttctttaaaacaaaacaaaacaaaacaaaaaaaactctttctccagccctcccaagtccgggcccattcagacactcggaggcattgagatggacatgtgttttcgtgactaacaagtaggttcaagagaatacaaatataatgaaaattagtcttaggccataataaatgggaaggtcacacagttctccagactttcaagccattaaaaaacatggttttaaaaacttgaattgtgtaggcatggacttccattttgattaaacagggagggcaaggagaagagactgtatagggtatgaatgggatatgagacaacattcagttctgcagagatctacttagtaaaagctggcactgaagactggaagggaaaactgaaattccaggatgatgataagccaggttgtggggacacatgttgaccctgttttaactgtagaagcctgagcttgcttaaatagtacaaacttcaacagattccagctcatttagccctgaaatatgaccctttctcaatagtacacatatgaagaattaaagtagcagtttctaatgcatcatttgtaatgaaaaccaccctactcctatgttttctggaaagcccccaaaatgggattgcattcatattttatcctgtatgctttgtatgagtttcagctttgacctggagaaactctgtttttaagcaagtggcagagttctgcctgcatgctgccatagctggtaggcttctccaagcagcagctgccaggcagccgaagcaccctgctcacaactttccattatggattaagctgactctgccaatctcactttactcaagacaccaaactggacgcttgcaagactagtgccttgcaaatctttgagatgcttttcttattatagatgaaatatgaacattgtgtttaggagcaggatccaacaaatgccaaaggtatttatgtaagtcattcag

SEQ ID NO: 130300 - DNA, 1097 bp, Homo sapiens
cttagggaattaccactgccagtgctcctaattttgttttgctgggcaaaaccacattttaaagatggaaacttagctctcataattcatgctataatctaacaatagtcaaggagtgcagaaaatgtcaaagtgtgtgctacgggtaactttttccttaattaggtcaacattgttacaggacataaccagggaacaagagcatcaggttgagccaaactgttatttccattcttcataagtattgagctggtcagtgatacatgtaagagattcccttccagatgtggaaactccaggaagtcagcttatcctaactgtgataacattggcttagcttttgtatttgacagcaccaaaacatgtgagataccagaatgtgggagcttattattaatttttttggaaagtttttcttgtttggaggtcattttacttagactcaaagaatatcatttaatttaacacataaagttggctgggatagaacagttattcacaagatcacttgacttgattcacattttactcataagtaattaaaacccaaagtcaactatgagtcaatgcacattatggatccaaattaaactgactattaccaatatcagaaaaaaaagcctattctctgctaagttattataaagggccaggactttgaaattcttaaattattctcaacaaggggatcttttgcaagtcaaagctgtttataagctatcgttatgtctgtactgtaatgatagtggttgtattatatttttaaacaaagtttagatcaccttttctacagatttttttttcttctggtgctctggttaattttcagtaattagcacaagtgattttaacgggaaggggaaatccttctgatgccttctgagtcattttaatgaatagattgttaaatagttaaagaaattttaggacaaaatcacctaaaatgtgggcatttattgctaaggaaagcattagttattttctttagttctgctacctgtattcttctatatctgcaccttggctgcctgtcactctttgcaactgttgtaaccagtgcttctagggcaaattccagacgcttggttgaaataccc

SEQ ID NO: 130301 - DNA, 1078 bp, Homo sapiens
caaaagtggaaaataacatgacaaaatctggcatgcattgttaaaaacaacagctacatgggaaaggcaaagagacctacaagaatcgccacattctatgcagaagagattaggtcactggtgtattaaaaggaaaggggtggagggaacctgacaacctgacatggacagatgggactctcaatgtgccaaggttggaagaaagaagagcagtagagaagggctggagtgagtaggagaaaaccggtgaataatagattgacaagtggggtgtatgtgtgggcacagaaggactacgtgcttgaagttttaccattaatagctggtttcagggatccagcaagagggatggaaaaatctattgggaataaagttctattagggaaggatatcataggtgagacaaaaagaaaaaggtgtggtaataaatggaaaattttatttttagtcttatttaagtgagtactgactagccacagctttgtaagacttgaagcataaatgtagcatagaatattaaaaatcctgtttctgcttcaataacactcttccacagaagtaaacgcccttttgaaaccacaaaatgttagcatgtcttcaggtttttgttattggcattgaattaatgaacctcccttttttttgatggagccatatgaaatttccaatgttcaaattttttaatgtacaaaaaaaaatggtgacatcatatggttcaacttagtacttctagagttcttttttttttaattcctctacttaaaaaataagtagggctaccactaaataaggttgcatattttgcattacttttagatatatattatattatatattaaaagtcttcaaggttttcatctttatcccaaactaatttcatttcaaagctattattttttgttgatcagcacaaactttaatgaagggtctctctctctcctgtcttctctaccaggcatcttttacttcagatcacagttttggatctactttgcttttcagtttgcttatagatcagatactcagcacatctaatcttgctggcttacttttagacctagtgataaacatttgttag

SEQ ID NO: 130302 - DNA, 1060 bp, Homo sapiens
gtctaaagcaagtttattgctgtaacttatttcatacaaaggttttggccaaaataggaatatcactaaaaaattagcttgttttctgctgttctcactaaggagttagcttgtttttgtttgcactctccccatcgccacatgtccatccctgtacaccctgtatcagattcagggaaaatctgattccgagtttttttgtggtgacattaaactggaggaggaaggaagcagtaattccatgtgagacgtatcacttattttattagtgatttgtgtattacatgttgctgaaatagaaaccccctgaatattaacaataagttagtatcatactcatgaaatccaagtctaggtgcccagaattttttgtgctaattctgatctgtactttgttttttcacttgtcataaaactattgaaaatatctgggaaaacacaacgttttgttaactagatgcatacttgcacatacccattcggagcatataaactgaagtttggcatagtgcagtgcaaatttgactgaaactcctaaactggatgccttccactacaagattgtgtagttaaaatgactaaatctaaaaaattagctcccaaatgaacacagtttaaaactggtaaaagtaatttttatacttgtgaaatatgcatctacattttaggaatcaagaggaactaattagaactttatttgagcagcagggagaagttggaacccacctgcttcataaagaaataggccctttcttattctaggttcattgactaaactaaacctattttaaatttcagatgaactgctaacagtttgactgcaaattggtttctagcaattctgtggaggaattctttcatatactgtgatttaacaaaataggagaggaatgtggccaatgctcttgtcccccccttccctatttgacagttaagcagagacttaaactttctaattattgctgttgccttaaacagcttggattttcaagccatacttttttggaaattctaaatactgtactagtcttatttttggagataacagtttaaagaaact

SEQ ID NO: 130303 - DNA, 2327 bp, Homo sapiens
ggcggcggcaaaagaggagggaggacgggggcggcgtcggactggagccgagcggcagcgcgagctgcccagggcgctgtcgtgagctcgcccgccgggcccccacccccgagctacaccctgccgtgcccagcactgcccgcgtccgtgcccctgcggggagcgcgccggggctgccccccgaatgacgggcggaaggttcgacttcgacgatggcggcacctactgcggcggctgggaggagggcaaggcgcacgggcatggcatctgcacggggcccaagggccagggcgagtactcgggctcctggtcgcacggcttcgaggtggtcggaggctacacctggcccagcggcaacacctaccagggctactgggcgcagggcaagcggcacgggctgggggtggagacgaagggcaagtggatgtaccggggggagtggtcacatggtttcaaggggcgctacggggtccggcagagcctgtgcacccccgctcgctacgagggtacctggagtaacgggctgcaagacgggtacggcgtggagacctacggggacggaggtgagcggcgtaacgggcggctcggctgctccgcgagctggtgcggtgggctctgccccggctgcggggaagcggggaggacgccgggcgcacgtgtccggaaacccgccaaaacacctgggggcgcctcccacccccgcgcccgcgcccgcctttcccagagagggcgctgggaccggactggggcgcgagggctggatctgaccccgttcttggagcgggccgtgtatccacactcaggggagctaggcgtgaatgtacctggccggcgccagcgctgcgctgccaccgggagggagcgccgcccgggagggttgggctggagagaggacgctgtcacttgagcccgtcacattacgttcctgatccctccctctcccggccgggtttgaaatcgccactcccgtggagttagagcgaacaccctgagcgggtgaggttggcggtccgtgctgaccgctcccgggattggtttcacgtggagtcgtatttcgcttctggtcctccagtagcctaaagatagaagccagaaccccgtaactaggatgttggggaattgtaccttatttgggggtgcatttggaaacgtcctagttatgggagcagaaaggccacctgatgcaggtggagttcagagtgtgtgagttcctagttttcattccgtttcttaaagtattggtcttaaaagagtagcagtctttgctgacctggagatcttggacaaattactaggaagatattttagaaatgggtaatgaagtctacattttaaagaatacaattagcaggtgtgttcctatagctgctaagttagcagctactactcctgagaatggcaatactgaaacaataatttgcattatgtgtgacctaagccagtattcctggctgtgaacaaagatcaccttattttaatatttaacaatatttgccaaagagattgtgtatataccaggacagaagttcctcttttattaggaaaagtatacattattgaaacaggtgtcaaaacctgatgaatttccttgtgtaatacgctgagaaagatattcatgaatagcttatgctttagcaaagtgcatttcctgataaacataatcatatttagttgaaaagggttgtaggaggcgacatcactttttggaattaagcagctcagagttggaggatattaaagggatgcaattaaaagtttctccagcccactgcaaccccatttataccattgcttatataaaagcttacacaatttgtacacttcacttagtcagaacacttgggccgtgtttcaaatgcaaaatggcagaatggtagaacttgctaaaaaggacatcttttcatcctacagtataaattaagcatatggttctcatggattaaaagaaaaaaacgttctctaatagttttatgtggggctgagtcccgagtttcacagtagttaattgggacccttaaatgttctgaatgggcataaagtacctggttgacagcgctgtaaatatgtcagtttgtgactggattttgttggaggccccagctctactatataactaaattccatgctcaaaagtagaaggcaaaatttattgttttaaatgtgtgcattattttataatcttttaagaaggccagggatggttctcttcagttttggaaggttaaaaatcgtctccttttaaagatactattcattaaacacactctcttggtttagagtattcattatacctagtaatcaaaatatatatagcacagtagaggctg

SEQ ID NO: 130304 - DNA, 1034 bp, Homo sapiens
agcaaatggaaagaagaagatactttgatgaattgtgtttgtttcttcttgagtttagtgggatattggagcatttcaagactagttctcaagttgtaaggatccatttccacagggatgatataccaggttaaatagtgtcacctcaaaattcttatctacctggaccctgtgaatttaaccttatttggagatagagtctttgcagatgaatcaattgtagtgaggtcatattggattagagcggcccccagtccaatatgacttgtgtccttataagaagagagaaattgaggcacacacaccaggtggggatttgagaggcagccacagaagatagaaaagaggccagcagcacgctcttcactgagcctccagacaccctgctgatatttcaatttcagatttttggcctccagactatgggagaaaaaattttggtggttttaactcaccctgtttctggtaattagtttgcgcagcccttggaaactatacaggtgataactgggtctgatagtgaattggttcactaatggggcaagaaaatattcataaaaatggaggggtacaatcagaccctggtgtgctgtgccaacacttggtgggtggaagcccaaaagaggtaagaaaacaaaagcagagaagtaccagaaataactcaaacaagctctacttttcaaaaaaagagagcttcatcagtgtcatatataatggaaataatgaggagaatgagacctagagaaagggagctggcaggatatagattatcagacacttttgagaaaacattttaaaagagcagcatctctcaatcttgagtgtgcataagaatgacacacagacctttttaaaaatgcaagtcccagagcgacctctgtggatagtaattctatagatctagtgttttgtctgggattctgcattttgacaggcactccaggtgattctgaggcagaagcttctggcacttcaatttgtgaaacgctaatgcaatggtgaagtcagggtgaatcagggtttgtggaaccaga

SEQ ID NO: 130305 - DNA, 1051 bp, Homo sapiens
aaggtattggtaagaaatagtcaatatgggtgaaatggcagtgagttcaattgtttgtgatgtatgtccaatttttgtatataatatatacaatatatgtatatatactttaaaaagcgtaaacatatactttaaaaagtcatctgcagtcctagaagatggatggcaaatattaatatttcagttctctgtgtctttttcaagggattgttaatgagccattttgcatgttacattcaggaagattttgaggttgtatctgaatttggtggagaaagaagtgttttgaatgattagccatgtttgaaataggcaaagaaaagggaaatggcacttgtgccatttttttttcaatccctgacttagatctatcatggactatttccttttatcatcactttaatttttatgttactgcaagcaaccagtgtttctgtgtgcctgaaatctaatggaattcagtattagttctatgctgtggtgggaaggacaggtggattggatttgaatctcagttctcctaaagactagcattagcttgagcaattttcatgagtcttagtttaacatctataaaataggcataataatacctgtattctatggatttgtgagaattgaatggaaaattattagtaaaaccccagcactatatctgaagttatttacttacttgccttctttcccagccagtgctggtatgtatttgggaacataatgatattttgatactgattttaagtagacagataaatctgttacacaatatttgtacattctaaagaataatatacatgaggcttaaatatgagctcgattcctcacttgcataaatgtataaaactgagaaacgtctattttacctgaatgcaactcttccgtgatttggtataattgatgtgcaaagatattttacatgctcattcatacattgtaacattttgagagataaaagtacagcgacacagtctaaactaattaaaagaagattaagcatagaatatgtaatatcaacatataattgatttatttaagcaattctgtttactat

SEQ ID NO: 130306 - DNA, 1050 bp, Homo sapiens
tctctcacaaaatcttgtcactgatctcacaaagaatgagagtgacagagtgtagatgcttggagtcttcttcacctatgcttgctgaaaggcatccttttgtttatgaagggaaaagccaagaggtactctgagaataggccctgagggaaaacaacattccttgactgtcttggggaggttcttgagggctgatcctgcctagggttgattttgttggctcgagtgagaagatacatagctccctacccccatccccaatctagtaatcttactcctgatgagtaatgtagaaatatttttaacttgaaggattgaaaatatttgctatggggattatgatgtttggctattgctggagtaaagtgaaggaggttatatatgtttgtcatgttaagaaaccagcaattgtgaatgtaggctgcaataaacatggatagagcttgcaaatttttgcaaaactaaaactgtagttattggttcttcctcttcatttcaggatccatggcattcattgattgactctggatgcaatccagattcttcaacattatgtctgtttctgaatactgtgggttatctttgacctagaggcagaaaaacctctgctgtctggtgtcccaactgttagcaaaaggactgatgtgaaagttgatataatgagcagaggtgtggtttcggggagtgggctggctctggacccagcctgcctgtcatgcagatcctgattccacatttgctagctgtgtaaattggccctttacttaacttctctgtgcctcagtttgctcattcacaaaatggagcaatgatagtaccttcccaggatcaaaattgtttctcaccttaagaggtttttgggaggactaaataatgtacgtaaaacatatagtacagtgtatagcacataatgaacatttaataaacattagctattatgtgagaagttctagagtctctatgaacctttaccagggaattcagctaagtctgctttattgaggagcccttgtcaccttcatttattaactgtggaacattaaagccttt

SEQ ID NO: 130307 - DNA, 1706 bp, Homo sapiens
atctgggagacggaagttgcagtgagccaagatcgcgccattgcactccagcctgggcaacaagagcaagactccgtctcagaaaaaaaaaaaaaaaaaaaaaaaaagtaaagaaacaaggccggcccagagcagcttgagcagccgcagtctgcaccctctcccgcccgcccgccctccacggcacccccacccgccccggggtctctttcccccttcctcctcctcctcctccaccccaccttcctcctccgcccgcccgcggggccccccctcaccttcccgcctgcccctattgttccgcccccggcctcccgcccttccccttccagcccattccccttttcccctcagtcgcctcgcgccagcagtttttggctttcaccccccatcagtgaccaaagacttgaccactcaaagtccagctccccagaacactgctcgacatggaaaccagtgtgattgaaggtggattaaatatcactctcaccatccgactacttatgcatggaaaggaagttggcagtatcatcggaaagaaaggagaatcagttaagaagatgcgcgaggagagtggtgcacctatcaacatctcagaagggaattgtcctgagagaattatcacttttgctggacctgctaatgccgtcttcaaaggctttgctatgatcattgacaaactggaagaggacataagcagctctatgaccagtagcacagctgccactagacccccagtcaccctgaggctggtggtccctgctagtcagtgtggctctctcattggaaaaggtggttgcaagatcaaggaaatacgagagagtacaggggctcaggtctagatggcaggggatatgctacccaactcaactgagcaggccatcactattgctggcatcccacaatccatcattgagtgtgtcaaacagatctgtgtggtcatgttggagtcccccccgaagggcgtgaccatcccgtaccagctcaagccttccagctctccggtcatctttgcaggcggtcaggcctatacccttcaaggacagtttgccattccacagccagatttgaccatgctgcaccagttggcaatgcaacagtctcattttcccatgacgcatggcaacactggattcagtgcaggtttggatacatctgctcagactacttctcatgaacttaccattccaaacgatttgattggctgcataatcgggcgtcaaggcgccaaaataaatgagatccgtcagatgtctggggcacagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagatttatccacaatccctttctgctgttcaccaccacccatgatccatctgtgtagtttctgaacagtcagcgatttcaggttttaaatagtttgtaaattttcagtttctacacactttatcatccactcgtgattttttacttaaagtgttttaattcctttctctgttcagctgttggtgctgagatccatatttagttttataagcttctacctgggatttttttttttttttttggtgttttgttttgttttgttttgttttggctcatgaatttttctgtctgtcatg

SEQ ID NO: 130308 - DNA, 1082 bp, Homo sapiens
atggtctcatttgactgaatacttataacagttccacaattgtagaattatgaaatatttatgggtacctattatgtgcaaatcactatattaggtacagaaagcacaaaaacagatttttttttttttttaccgtcaggaaggtttacctctagtgaattgcattaaacatacataaataaatataacatgagatgaagtttgtcaggtgtctaggagatatttgaaagagtacattttcagctctttgggtatttggaggcccaatggagatgtcatttgcactggtccttaattactggataagtttgggatccacagatatagaaagaaagagaattacaagtgaaaggagctgtaagcaaaaccataaagacaataaattaaaggacatgcacagaacacaatttgttccacttggctagagtcgagggaaataaagttcgaaattcaaactggggtcatctttaatgccaggctgaagaatttgacctttatttaataggcaatgaaaaatgttgcttatcaatgtcaacacgtaattcgtggctggattacgcagcaggattttatcaatctatgtcatcatgacctctgaaatccaacctttggtcaggagcatatattgatgtctaagaactttaggattaacttccccagggaaatttatagcacagctttagatttgattctttagagaatttttatttgaggcaatataaaagtctgatgtgtgttgactacaagttttaaaataaatggtggaatgcttttggtttgccaatttctgaaaagtaaaataatgacatattaagtaatggaaatgtgggaattaaaactttcacagaaagagcaaacaaactcatcatttctttccttatctctgtttctgtgtcaggcccccttcctggctcatgtcttgtcctccaagatgtcctcagttgcctctatttcagttcttttttctttccatgaggggtgagacaccattttagaacttagtaagccacgcttggcctcagtgtccgaaaataattggagtaatttcattttgtttcttctagagggggatccagaaggtt

SEQ ID NO: 130309 - DNA, 1049 bp, Homo sapiens
tttttatggctgagtagtattccatggtgtgtgtgtgtgtgtgtgtgtgtttgtgtgtgtctgtgtgtgtgtatgtatgtatgtatatatgtataccacattttctttatccattcatcaggtgatgggcacttaggttgattccaaatctttgcaattgtaaatcgtgctgcaataaacatgcacatgcaggtatctttttgatataaagacttcctttgggcagagacccaggagtgggattgctgtttgctttctctttcacagagatgaacactagggcatttgctgataaacctctcgcacactaatctccatcttcaagcctgcatcttggggaatccagtctgtactctccactaaaatagggtgcaaattgagctacaggccagatggccttgtaacgtaagattcactccattgtgtcctacagccaacaactagatcacaacatgggcaagatattttataaataaatttttaactataagaatgactttaagaggtaaataactgaatgaagaaaaccaaatcaaaacttttatgtgagcatccaacactgctgaataaatgagtattcaatgaatgtttgaactgaataatgtactgaatggatacagtaagacaggataattttgtccatgtttattaaataccatttatgtgtcaggctccaggaagggacccaaagttaagacatggcctctcttctcaagaagctactaagacagcagcatttctagtctatccataacccacattaatttatgctctgttatttatggagaaacagatgtcaatttgtgaagcaaacaattttctaagcataaaacatttatttcttatgtgatataaaccaagtcatattggataatatggattttttatgtgtaaaaagagattgtgttttaaaaaactgaattatattgtacttattcctttatcaggtcaaatacatttcaggtgaatgccaaatttatttattaaaaaaatgagtttcagaaaaagatataccagaaagtattgttataagttactttaatgggaac

SEQ ID NO: 130310 - DNA, 1049 bp, Homo sapiens
gacccggaggtccccatcccctgtcctctccgcggtcgccgcatccggggctccagccgcagcgctgggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtaagttttttctttaacttttattgagtagtttctgttaaatttaggtcgagtatcgattatctttccagcctgatcttgcacaatctttgatatttcgctccctctctctccctctccgcctctcttcctctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagt

SEQ ID NO: 130311 - DNA, 1028 bp, Homo sapiens
cgtctaccctctttccatgttaggcctctctttcctctttagatgcattcctagtggtagcttgtgaagttttcccttcataggctaaacttctttcatcttctaagaattggccaatataatctcaacagaaaagagcaactaggatggtaaggcaactagaaattaccaaaatgccagagcctgggaagtggccttacgatcattcagttcaattaactcattttaaaatatgggctattgaattaaagagagttatctttgattacccagcaaggcaggaaaatgttgagacaagaattcacatattctaactctaggaccagtggtcactcaactgtattggctatttgaaaaaggcttgttgaatgaatgaatatgaaggttgtggagatggtgaagagttggaaggaaaaatgtgcatgataacctgtcttctctgagagagtgagctctctgttatcgacaggagacaagtagaatctggatggcctcttgttattgtgactgttaaacatatttttgtgttaagtaggaggtagattaggtgctccaaatggacaagaagagcctatgattcataaaaatactgatgatttcagtgacttaaagtgtatttatcataatcataaacatggtgtgaacaagaacaacacttcaattccgtgtaaggaaaggatatgaagtcaaggctgtgatgttttggaggcagcataatgtacagaaagaataacacctagttaagaccagacattttttgattctgcgtactttggtttcttttttctttttaaatgatattatttaaacgacattatttaaacttacattttaggtattttaacacctactacatttgttggcaacccaatgcttaataggaatcttattcaacctataagatacctggattacatttctgttatgggtgcccttgtccaagttacttaatcttcctgagcctcagttttctcatctgtatatcagggttgctgcagagattacataagataaagtgttgtgaacat

SEQ ID NO: 130312 - DNA, 1046 bp, Homo sapiens
tctatgtagcgaggaatgttttacgtccattgtctcattcgatcctcacaacagcccactgaagtacatgcagttgtacagattaggaaatggagcatagcaaggtcaggtgtctttcccaggatcatacagatatttgaggagctgggatatgaaccctggcttctctcctggaggctgtgctctaataatcattctttactgataagcttctccaaaggctgacgctacccatctggggcccatacacatggaagacatccagaaaggtgtggaaggagactgtcctgagtatatacaaaaacacacatttttctctctgaagagtgtgtccatacctttcataagactctcagaccctgtatatgtaaaaccagctatctagacagtgctcacaaagagttacaaagtggtaagcccttttacaactaaaagagagtacagttagtagggcaaaacaggaagtgtttggctcgatactagcaggatttggataggtggatgtcaagtttggagatggggagaagggagagaagcccattgtctgagtcaagaaagaattggttgtttcctcttcaggttatagttgagagtcagtataattgaaggcatttatcttcttagcaatgggagactgtgatgcgatgcagctattagcagtacatggccagtgagtacatgggtttgagtgaataaaagagctgctccacttctttcctcctcagtctgtgaatattagcaaaaattttattacaaatataaataaaataatctcaaattttgaaattaaataagtccattgtttcacactttcagtattagtaaagtagaacaatattctatcaatatataacaaaattagtgtcaatatatattttggaatcaaaggaatgaatgctgaccacactggacttactaattttagctagcatctttataatgcgatatgataattaatttttactttatgtgacagttgttggtgccacacattattattattattattattattattattattatttttgagacagaagctcgct

SEQ ID NO: 130313 - DNA, 1088 bp, Homo sapiens
gggctctttgacttgcccatgggcatggaaggtttatgcccaggtctgttccattctactctcatggtctcccacaccccaaccgctctcccttggttgcaaatgaggaggaaagtgcagagagaaaagtgttttaagttcctgtaaataactgagaagagcttgagttagaacacagtcctcctgatttacaaaataggcaccatgcctatgtctcttgctcagaataggcagggtaggaggagcccaggagagaaggaagattaaagatgagcgtgggagtagaatgctgaagtgcacaatgaagggagtcttagtgcgtagcaagaggctcctccacatacggcagccctgagccagcaggtgatggtggaccagggatgtccctagtggtcctcagaggtcaggtccttttagattctgagcgcagataccttcattcatgaggtttattatcattgttaaggcacatagtttgtctatagaacactgttcgttcatttccagcaaatatattgagctcttaatatgtgccaggaactgtcttaagtcctgaggataccaaggaaggaacacagtctcttcattcatggggctctgatagaagaaatgggcatgaaaacaagtaaatgatggcacaatatggtaagtggagaaacaggtatgaaaaatgctttctgggagcatagaggacagagaatgttactgagcactggaagggactcaagtaagacaactttcaattgtagctctgaaaggtacatgaaaaattaccaaggaggatagggaagatacctcaaaataaagaaacatgcgtaaatgcataagtgatttataaacaataaaaaaagacaatgagatttttactgggtcttaatatcaagcataagaacaggtattttcctctcagccatgattgggtttttgggcaaatgttatcataaaagagtttttttgtttgtttgtttgtttgttttttttgagacaatgtcttactttgtcacccaggctggagtgcagtagcacgatctcagctcactgcagcctcgacctcccaggctttagcaatcctccagcctcagcctccc

SEQ ID NO: 130314 - DNA, 1097 bp, Homo sapiens
gtctctctctatctctctgtctctctctctctctctctctctcacacacacacacacacacaaacacaccacaccttattttcctttaataccagggttgtttttttctgttacatccagcctcttatctagtgcaccttaatctttcatttacatctccaaagatttgaatgaaaagaccatctggatatcatacccgtatcactcaaacatctctgtgattgcaatttgaaaaagaaagcagtgttatatacccctaaaaatctagacatttggaatatagtctttagtacttttatgtcataatatattggcaatactgcttgaataacgcttgtcttggtacttttatgtcctaatatattggcaatactgcttgaataaccattgtcttctaatgaaacagggcatttttgcaagtgtgaatgtggttatctagcacaaggctagcaaataattttgatctgtgtagcttcccttagatatcatctcttaagcataacagcacatagccatgttttctttttttccagtttgacaaagaaagcagcaaatttaaaagaatacaaattgtattacatgaaattcattgtgattaacctaataaagtaaacgaaggtacttgtagctttcctcatatcagcaaatatgaatattttattcttggcttcaaaatttccctgagaaatagtctaaaaactgtagaaccattatcagtacccctttccacagaagggttaattttgaatagtacttctaatgactgtctaatacttttatgaggccactaattgaaggtgctaggctttgttttcccttctgaaatttccatgtgtaaaaataccattaataaatgctcttttggattgggaaggtgaatcaaattagtaattaaaaaattaaaatgtataaataatagaatttgtgtgattagtgacatttgataatataaaataacccagagttaacttacggtcttacgttgattgatatttgaccaaaaagtaaaaaatacagcataattatatttttattccgaagacccagtcaaaaatgcaagtcctatcattaaacttctatcaataaatatgataaaa

SEQ ID NO: 130315 - DNA, 1060 bp, Homo sapiens
actattctttctgttagggtattggctttttaaaggcctagacatgataatcaagcccggtgtggtgatagcccattttaatttttttgtgtttttttcccctagctttattggagtataattggcaagtaaaaatggtatatattcaaagtgtgcaatgtaatgatttcatatatgtatccattgtgaaatgactgccacaatcaagttaattacatcaatcaccacccgtagttacttaccacctgtgtgtatgtgtgtgatgaggacacttcagatttgctcttggcaaatttcaaagaaacaatagagcatattaactatgctattctggacatgagttcctcagaacttactcatcttataactgaaaatttgcaccctttgactaatatctcccatttctctcaccctcccagcccctaccaaccaccattttactctctgtttcaataagtttgacttttttagaatccacatataaatgagatcatactgaggtccattttagcaactaaatttaagcctcattttttttttttttttgtcatgggtggatttgccagttaataatatttaaaatatctgaactggtctatatactggattatggcagtgacttggtgttttaattatatcagcttgcacataatacatatttataataatatatgtgtattgaatcagtaagctgtacctagctaaccattcagcttcttatatttcatttaaatttttttccctttagcaccaatttgtttccttagtctatttatggcattattgtggtatatatttttatatcatagttttcttagagtactgtgtgatatatacatttttagtaccttaataatgatatttctgcattcttgttccttcatactaagatttagtactatttattttcggcaatagcgtgatagaatagtaaccatgtattgttcatttagttttctttttaacttcctttacacatataaaatgtatttgagaaagattaaatgacttgctgaaaaaataacacctttggagtcagtagtagtgctggaaaataaac

SEQ ID NO: 130316 - DNA, 1030 bp, Homo sapiens
acttttccacttagatgtctcataggatcctcagatgtttaaaattgcatgtatatattttctttctgttcaaacctgtattgcctcgtgtatttcttgtttcagggacttggatcactatcactcaattacttaagtcagtttttcttggcttatttctctccagatagtgtcacttctaccacctcaccgctgtcaaagataacccttttctctctgtccccattgatacttttctaatttaggccatcattagtttctcactagatcattttaacaacctgttaactcgtctctatgcttccagtctttctctcagcctctattccattcttgctcagggtggccagaacaagtagtctaaaatgtaaatcttactagttatttgcgtaccactattgggggcttcccgttaccttcctcataaaatacagcctcctcagcttggcttctagggcctttaggacctgtctcctgcttctttccagccttatctcatctgtgcacctctagtccttagtacctactcttctcaccattggcaatagtattcttaccctcctttaccaggctgacatgctaatatcaggtggctgcttaggtattgcctctcccaggaagccttctctgaccttctgaagtatagttgtaaccatagtgccctgaattttcccttgcatatcactgatcgcaccttattgtaatcacctgtttattttatatagcacacctttacttttctctctcgttccacaaccctccacaagggttgaaaacagtgtctgttgtaccattatatcactagctctcatattaacaggtaaataacagatgcacaataaacatggtgaaattagtaataatcatctttctggatatggtaatttgaaatagttttaaagggtaatggatgggaattgatattttctatccttcacacatcccagactttcatcctattcatttattcatttatctagtgtttgtagagtgccttctgtgtaccaggaactgagatagttgttctgat

SEQ ID NO: 130317 - DNA, 1465 bp, Homo sapiens
aatctgttagtgaacctgggctagaatacagagctaatcagaggcagtttaactctgctttccccaatactcgctccaacatctgttctttattttcacaataagcattctcagactcagaagtatcaggtttctgaaagaaaaaaatatgagtgccatgctgttatcttaaaaatatacttataaagctaggcccaagtattggaaattcttttctaaggtttaaaaaaagtattttgtgctagttttagatacttgaataactatattgtgtatgagataagtaaggcactcagttgattgtgtaagactcaatataatcttgagttgtgttgagtttcctcttctccctaaatgcaaaaaaaaaaagatattttcccctcttctagggcaggttacttaccattgtccatatttttgagaaatatgtgcaactttgaagtttatctttcagatacattttagaaatgttttgtcatgtatccactaccacttcaaaaagaaaaatcctatttggattttgatgaggcaatgttcattgaagttaaaagtaatttagaggtctgttggacataacacagttttaaaatttcacatatcttggctatacccaaatgagcacaactgggatttacaacatcaggtgtctataaactattaaaacttagtttatgtatggtgaaagagaggaacgagaaagtagtgacaaggcacttagcaagtctgtgacagaagcgggatttgaacttaagagttgttaggcctgttcacagtgccagaggtcacagtgttctaatgggcttcagccatagccttttttcttttgcccatatttgaaacgtgttctgggaatcagtgtccagttaaatccctctttgatgcacgtcccatttattagtattgatttcaatacattggacagtaaatctatctgactacacaaaggaaataaaatagtaggttataggttcaaaacttaagatgtctagtcatagaattttattcatataacctcataatatgaaatgctagtttaacattttcagaaagagaaaacaatgaacgtggtctcatccactttgattgccagaacatttaagatggtgtggcagtgacattttcattctaaaacttagtttattattgtggagatggaaaagaatagcctggcagggggtgcatgagtgggtatgacacagtagagattacttgagaatcacgtttctgctgacaaagtttacaggactgtaaatttaaatgcagaattttgtagacagtatgcattgacaaatatgcctaatggtaatacctctaatactgagagtcttggaacaggtcaataataatgtgtatattgatagcagcgatgtaggagatgttacatggtattatagctaaaatccatgttatccccttaatcataattacgttaatattgacaggcccttgacaatacccacattat

SEQ ID NO: 130318 - DNA, 1088 bp, Homo sapiens
tgagttgaaatatgtgaagttgccctaaattatgtagggcaaaacagttgaattctggtaatttcaagcagttcaatctaataaaagctcttgagaattttctgttgaagttaggatggtgcctttctctccttcctccttctcccctctccctcccctaagagatcacaccttgcaaatatcaaactctgagtcttaaggttaccgttcattaattcatccattctttcattctagaaacattgatacagtgatagattaggtagtttcttacctctattggaagttaaagtctagtactttgaaggtgtttaataaatattatattgcagtatccagtaagaaatattcaaaagtttgcttaatgtgtcagagtaattgcgtaaatattgtactctggcattagacatatgtttctagttgaaaccagttaccagacattaatcttggctataaaacaagaaaatatatggactcttgaaaatttctattaaagataatcttactctttcttataacttacgttatttgcatgtaatcatataccatttgttttacttttggtcttcagggtctttatgcttcttgaatagtcaatagatgaggtattaggctcaaacactatactttgaaatgaaatataagttatctgtttttgtagaatcaatatctgagcacttctacattctgtagatagttatagcaaaaccttttaattccttttcatctaataaaatttgtgccccacaaaatctatctaaggataatagaagtagttctagacttgagagagttccaatctcttataagctttttttatttgtaaaatggagagatggtaaaatctaagcagattttatccttatatacagtattgtcattcccttcatatccctgataaatggttataaaaattgtggcagagatcagactgtccgttcctcttgtggattgttgaaattattagatcttagtactgccctctaaaacttgattagaagactgattgctcttcagtgtagcccttggtttaaagatagtcgtgtctcatcaaaatttctgttttgttttattttttcgtagtataa

SEQ ID NO: 130319 - DNA, 1367 bp, Homo sapiens
gtagctgggattacaggcatgtgccaccaagcctagttaattttgtatttttagtagagatggggtttctgcatgttggtcaggctgatctcgaactcctgacctcaggtggtctgcctgcctcgacgtcccaaagtgctgggattacaggtgtgagccaacgcactcggcggaatggatgtatttcaatatagtgcttggcctgataatgtctccctgcagttcagacagtgagtgaatgagaggcagagaaggactaagcagaaaatgtaagttagtgtttcaaaaaatgtgctcatcaggacattggtggagaacattggttttgggagtacaaaggatttctgataaaataaatttgggcaaataacaacatactaagcttctttttttaagactaagggagttctgctctaagagaacccatttaacttaggttaatgtaccattttccaaacatttggccatgtagcaagggattcgtggataattcctagtataaatgatgggtcatgttcagactgggtaggaaaggacatgcagccaggaatgaacttattaagaaaagcaagtcactctgagatcaagatagtaacttagagaaaggtaggaggtagaattctatggttaaagaggaaacttgagtgttttaaagtccagagttggttgttttggcagtagttttgctgaactagagtgtaggtgactaaaatgctgtgaaggatgaaggttgtgtgttgagtcgggtaggcattgactaggttaagacaaaaactcttctaggatgagctgaaaagggtaaatcttctgagacactggataatattgatctgaaagtaattcgattttggaaaggatattgggaagaaagtgatataacatatttagtgcttcagaagaaagatttgttgagtgttaaaggagtcaaatgaacggtgatagaatataagacttaccagcagtgaggagatggacatgccacaagggaggccagaactgttcttaatttccaagatttctttgaaaatgttctctcatagttcttaaatgtatgcattttaaaatgtcacaactatttgaaataaaatctttatttctcatcacttatagtgttagataaagataccatttcaagtcttaccatcatgcaggttttgaagttgcaaaacataagcaactcataacagaatcaacagtgtgtgccagatagattttgtaaggagagattggcttcttaaaagttctagaatattaaagtactttattgacttggttgtatccatcaccttgagtgcttatttcaacagtatttgctctctgatataatattcaccaataatcacccctctgaatatcatctttctctt

SEQ ID NO: 130320 - DNA, 1152 bp, Homo sapiens
atagtcatctgctatcctcattttttaaaaatacttaagagctgtaattacagtgcttggttgttgaaatgaaaactgaaaataagtatgtaaaacacttgattgctaattgtgtactgaaagcctaagaggctgcaagacacgaaataatccagttttgaggttttattttttcccaaagtttgacagttctaccttctttagtgtttgtcaaaatacaaaagaaaaaagagtatttagtttaccgatgtcatcaatcatcatgcttaatatagtggagggagaatgtttatccagttggcttattggaggtcatttaagacagcttccattctaatgtccctaaactgaataactgaataaatgaatgaatggacaactctttaaaaaaaaaaatctgaatagtagtagaacactagataagctcaagaaaaatcttaggcgaagaaaactgcaaagtttgagttccagaagggaggaaaagaattagtatgggagaaggacacaaatcagaccacctgtcctattattttgtgttaactttatattagcatattactattatgttaactttagtaatccaaactactactcttacattaacttttgtaatcctaaaactaatgtattctttgtattttctttttctagtatctatgttcaggcatttagtggagacttttttttttgcagtgtagtaactttgactttgttactttttcttattcttagtgttacagggcagataaatattttacagaaaaagggtcccaatccagacactaagagagagtttttggattttgcacaggaaacaatttagggcgagttcgcagtgcaaagtaaaagcaagttgattaagaaagtaaaggaatgaaagaacgggtactccatagacagagcagccctgaaggctgctggttgcccacttttatggttatttcttgatgatatgctaaacaaggggtggattattcatgcttcctctttttaaaccatatagggtaacttcctgatgttgccatggcatttgcaaactgtcatggcgctggtgggagtgtagcagtgagaatgaccagaggtcactctcgtcaccatttttgttttggtgggttttgcctggcttctctagtgcaacctgtttttattaga

SEQ ID NO: 130321 - DNA, 1034 bp, Homo sapiens
taaactatttcttgacagttttccatttgatgaaataaaaaattttaatagatgagcctgtattttaaaatgtattttaacgtcatgtattattacttcctaactagtctgctatataaagtatgtatccattataaatgaaaacataaaggcaaaaaagaaataacgtttttcctctgcttactcttttgtactaaggatttatcttttgttttttttccttcacacatttgattcaaagctagaagaaaattggaagtcatgtaccagcagactttttttttttttaactctttactaagtttagacaagtaaaactgggtagttataaggatatgggaatttttgcttatcagatgttattacttatattttttgaatgactgcatagaaacttaagattttttaatgtccgtttcaagtactatgctattaatctgtttccgtttttatctgttatagattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtggtaagttcagttttaataattgctataaacgagaaaatggctcatggacattcatagattattgtttatgcttttcatgacattagactatatttttctcacctgcttttatagatatatagttttatatatctataaaagttgtatgcttttagctcttatatctgtaaatcatttcaagctaattgtgtatagtgtgaaggggcaattgttccctttttctatgtggatattctattgtcttagcacgttttgtatatataaaatatataaaaacattatatatatgtatacatgtttttagattatcgagtgaaagaccttgttacatattcttggtcttttctcagatgtatattaagaatattttctcccatcctgtgacttggctttccattttcttaaggatgtcttttgagg

SEQ ID NO: 130322 - DNA, 1088 bp, Homo sapiens
gtttttatgtgggaaatatatacaaagatatctgtcaaatgatagtaactacattttgcttctcaattcagactacatagaaaatggaagacctaaaggaatataatgtaattatcattatagaaaaggaaaaaaaaatcaaccaacaatatcttttgagttaagtgatttttcttattgttgtgcttccaaaaacaagagacaggctatccataagaaagagacagtttatcagtagatcaggtagttgaaaagtaaaaaaattttatcttttagtggtaagaaactgatctgatttattttcttctccaatgagttgactcattggatgattaagtgaagtatagacatagcaatatgtgctttaattttacaaagtcattttaccatatcacagagaattggcctccatgttaggtaacaatatttgttcatagtgttgtttatagtttcacttacagttgatcatagattaaaagctgatatttttcagtatttctatagtactggcaattttatcagttggcaatattaaattgtactgacacagtattcctagataggacgtgtaaagctggctggtgtaatgaagagaggcgctgaccttggagttagaagactaggtttctgcatcataatctgccactaaatagctttgggcatgtatctctttgtcatgctgtgacatattgtctgactgtgacaacatctgtgactctggttagaccttgacaactgatccaagaaaatctgaccaacatacctggttactaatggaaaatatgcttttgctaacaagcagagattttgagtacaataattttgtcagttgtgcattgcttatgatgaatgccatgaagaatacatattttttggctatcccacatcatatataactgtcaatcatacctgttcaaattctgattgtccattctgtataagatccttgcagattaaaggaagctttccaactactggaaagagagctgtggagctcatttctaccaatatattactatattaactggaacattgtgttactgtattaaattagaaccattcatagctgtctatttagtgacagagtt

SEQ ID NO: 130323 - DNA, 1071 bp, Homo sapiens
aatcattactggaacctgtccttcaattaggttttcaaaatctgaaaatattggcaatctttttatatatgtaatgtttccattggataattacctttaggtttttattatattttacacatctttcttgaactgaactttgttgtatcacatgtaggatttgaccatttcttatcatataagaggaatatgtttttaaaatatagtcaaaaattttctaaattttaatttcaggaagttttttctgagaaagaaaaattttaatccttatttccagaatcatgtaagataaccactgtttggaagaaaaatgttttgataattaaggattagaataaaatctgaatgtttaaaattccaatagatgggtttctttgtactttaacaaattaaaaacaaattttaatttaaaatattttagaaattttacttaatacatttatttaatgaaggctgcttttaagaactttaaatcctcacgtaaacaccaccacctgcaaagtattaatatcaactttttcaacaaaatgcctgctatgtataagctactgaaagaagacaaaaattaataaaatgtgtccctcctcttagatatctataatctaggaaaatgaacacattcttttcagacactaaactccataagaacaggtatcagatctatcttatttaccaccacatcctgagaatggagcacagtgcctgacacataatagatgctcataatagatgctcagggtttatagtcagtgaataagtaaagaaatgagtgagcaaatatctcttaaaaagaacagacttttaaagttaacaagcagtgatgtgttattcagtagcaaataagattgtttcctaatgtcataattcaattttccctgcttcctactatgactagatgttggttggtgatagtttatatgattcagttatttggttggttgatttaaaacagtgaaatatcctacaaacctgcagtttgtcctgctatcctctagatggagagcctttataattttggtcaaaatgtgtgtgtgtatatataggccccttaccattattatatgtgatttt

SEQ ID NO: 130324 - DNA, 1093 bp, Homo sapiens
ttttggacattagttcttaccttgacagtcagataaaattaaggacttggggagtagatatctgatgaaccagaataatgtcttttaaaaaaactttatataaagaagcagtagcaatctccttatgggtacacctttatatattttaatagtaatatggacaagttaggccctccacttcgaacgggaagacttgtgcaaaggttgtatgacagtgatacaaaatcagacagtgccatcaaaagacatgagttattacctatttacaagtaagtatttgtaactcagtttggttaatatttttcagatatttccttaaaagctttatataatggaataacataacttttactgtcctatacttaaaaaaatctgttgaataatttctaagccaaaatgtgtcaaataatctaggatttaaaacattttgatttttagtaagcatttctgttgtactaaataaaactttttaggttatacattttattccattaaatattaattttttgaggtttcaaattgcagtcacatttaataattatttttatgaagttttttttagtagtaattagggttttttgtaatagtagttttaaaaagcagagtttgagaaaaataatgtcttgtacagtatataatattgttagattatctcttagataagccgatggtgaactattataaaaagcccagaaaaagaaaagattttaggaaactttcaatccaagggtccttagtctttttgttagatggttgtaaattctgcctacaaccgggaaaaagtatgacactgccaaagagtcaagctcgaggaagagtatgacacagccagttctgacctggctggctgaaaagagtgtgtggcaatggcagttactttgaaactctacagcatgagtcttcaaggtttactaatttgggtctcaattctagcccacattttaaatatgaaattagggcctaaaaattaatatacctattaatggtggaaaatattaagcagagtaacttagttaacttttaaaccaacacctactacaacagtctgctcagtatgtatgtatgaaaagtaataataaatttaactagataa

SEQ ID NO: 130325 - DNA, 1089 bp, Homo sapiens
agtgatcaaggccattctagatgttactaaaaataaatgacaggtatttaatattggtagctattaatgatgataatctcttatattttcctctaaatataaacattttgaacaacctcaagttaccgatatggtgacattatgtgtatatattcatgggtgtgtttgtattgtttgtatatctcatgcacttaagacgattctatagccaaaaaaaaaaaaagtgttcttcctatttaaagtccattctttgacaatgatttcctaaagattgaatttctagaaaaagactctagtagttctacaacatccccaaagaggctatacacaagagtagagtaaacctcatgaatggacttggagtgagcatttgaagaggtgcagggcattccattcatgcaccaaagtgattctttgcttgttgaagtttagaagtaatttaaagaagtaactatgcaaagcaaccactttgaatgacagcattgtgtattgaatatgagttctgtaatacagcccacttaagttcaagtactactctggccacgtagtagcctcacaatttatataatctctttgaacatgcttccactttaaaatgggaataatatcttctgagatttgggggacattaaataaggcatgtgtagtatctggcttcataattgtcatgtagtggctgtttgaaaaatagtggatgttgttattacctgcatgtactttggaagcagctatttacaattttagggtactctctcctactttgccatataagtagagtaagaaaaatttcaactaaagtttaagaacctctaatctggaggtattttttaaagtattctgctgttcatataacactgttcacctgtgaaatttaaagatttgattaaagctctatagagagggagggaactatgcttcaatgaacatctaaatcctagctttggaacacactagcagggtcaccttgggtaagttacttaggggctctttacctcatttgtcttatctgtaaatggagttatgaacgctacctatttcataggattattaggataaataaatttctatgggcaaaataattagaattgt

SEQ ID NO: 130326 - DNA, 1049 bp, Homo sapiens
attatataaatgttaacttatagtggcaacaacagtagtaatagtattagcatcagctatctaaatgtttatatgaattgtactttttttctcataacctttctataagtgatcattttataaatgatgagactcagacttgctgtcacaaagctgtcagtagcattagcatttgaatctaaattcatttgaattcccaagcctctgcttttagtgttatatcatcatcatttagttttctaacccttctttgattcttaaagtttcaaaatggagactcatggatgatccaaccagaagtccctctgatttcggatagcccaggctgtgcagttggtaaaattaaatctttaaagggaatattatattaactcatttattttagttgctgctttttagaactttcataagttgaatattattctttaatgtgactagcaaaaaaattctttttttaactacatcgtatatgcctagaataatgaaacttgtttgtttatttaaccattatccgtaagcatttatcagaatatatgttttgagggaaatataaatttaaactgtttttaaaaatgtatctttcagaatgattaccttataaatttcatgtaaagcatatatacatattttagttgattttatttactatcagaatagtattagtaaatgcaaaattatttggtttatctttaatattaactactatttgctttcagatttaaaataattattgggactttaatcttttgaacttctctgaagcttctaagtattctttctagtcatgtgaataggtaatttgagaaatacatgctcactgttcaatacttttccattatttttcctcttttttatagagctaatgtcaaaccccgaaattccacaccacctagtttggcaagaaatcctgccccaggtgtgcttacaaacaaaagaaaaacatatactgagagctacatagccaggtatgtttagctctgctctcccaataactaaaataaaattgagtatatgatagttttccaaggaccatacacaaaagtaagtaa

SEQ ID NO: 130327 - DNA, 1053 bp, Homo sapiens
atatcatgtactataaaaattgattcaacatgattgttactaagttatatcttggaaaagtgactgaatttcaagagcaaggaagaataattctaaaggtggaaatggcaagtcagttggaggagaatcagagtggcttcagatttttcacatctaaatgcaaaagataatggaataatgtctacaaaattctgagagataaaaatgtggctcagaatttgatacctagacaagatgttgttcaaatataaagtgcacaggcagaaatttatgtatgtcagaatttaggcaatagaacactcatgagccttttcaaggagaagatggagggggaggggagctactggatataaaatccaaccaaccaagagaaaagtgaagacactgtagtaaaaggtcaattgatagcacaaaattcacttccttgtagaattagagtagcctcttcaaaatatattatattcttttattttcctcatggttcttgctactgtctcaaattatcatatttttaggacagagactctctgtcttgataatccttgtatccccaccatctagaatgttacctggtacagacaagacccttcataaatatttattgactgactgagtgaatgaacatagtttacattaaaaaaaacttaaatgttattttaaagttataaaattacagtgtagcataaaattatatgttatatcgtgtatatagtataattcaaaattatgttgtaaagatgttgatatacataagtgactgtgttagacacttctggctgccatatcaaagaaccatggactttggtactttggtggcttataaacaagagaaatttattcctcacagttctggaggctggaagtccaggattggggtggcatatggttgggttctggtgaaggacctcttccaggttgtggactaccagcttctcatatcttcacgtggcagaatgtgaaattttcagatggctagagagctctctggtgtttctttataaggcactaccaccattcattagaggttcaccttcatgacttaattacctcccg

SEQ ID NO: 130328 - DNA, 1079 bp, Homo sapiens
catatgttctttggaaatttgttatgaattaaatatcaggtactttttgatatcaatatgaactagttttggatgttatacaatattttttatccataaaaaattattttacctaaatataactcacatggttgaactacataactcttagtcaccacagcaaaggctgtttcaaaatataaaggctgctagaaatggccaaacgctttctaggaataactcagtctaattgtaggcaaatacagggctatccctttattttaagttgtaaacttataaatctaatgactaatcggttataatatactttcacaacttccaatatctttaactgtgactctattccagaggctttcacagattcaacttctgtctttgcactgacagctctcatatagcctgaggtctacatttctcccattaactctaggaccatttaattcaaatatctagtagatatctctacccagatgtactatggcacctcatgcataatagtcaactaattgccatcacatttagcctgttcctgcttctgtattctctatcttaggtaattttagcattttcctagtctttcaattctgaaagcctagaatcatctttgatggccttcatctcatccatcaccaaattctatagtttaatatatcatcttaacacctgtattatccatctattctatagacttctactactagtcttagttcaagtagttgtcagatctcaccgggaccacttctgcagctgtcagtgggccctgactaaccttcctgcctcccctgtgcatctggcctttttaatgatgcttgagttatctgtcccgattcaaatctgttaccatttttcttctttttaaaaactctttaatgaagtatctctcccccagcacctatcaggatttggtcttgcatttgattggtttgctaacagaagtagccaaagaaggatcaaattctagccaaatattgcttcaaaaatatgtgtaaataaatggacaatgtttaaataattgtagttaacaaataaggaaaatgtaaattgattacaataaaaattagttttttaatatcaattta

SEQ ID NO: 130329 - DNA, 1150 bp, Homo sapiens
tacggccatggctcacggtaagatcatggctcatggcagccttgacttccaggctcaaacaatcctcctgcctcagcctcccaagtagagtctgtttttattgctattcaactttttggtcctcaaatatgatgaaattacccaaaccagataagacagttggagaccacatagtagatcctcaactacttcaactctcaaaagaaatggcatagacaaagggtaaagagtaacattatgtgcactcttaatggaacaagcttctagtgaaatctcttgaaacaaactgcaggaagccatgcattataattattattatgagaattttaattccaaaacctctgtgctttatattgccatagtctgtctggggctaattattcaatgacaacaatggcaacagaaaacactcttaacaggcaaggcaaattatgttttaaaattgagaaagtacgtgtaatatacaaaaagactgaattttccagcaaccctcattggaaagaatgcacaaaatgccatccggtgaataaataggttgatttaaatttgaggagcacttaactactgaaaattgaggtgaagaagacagctaatgctcatagcaagtaaaacaacctcatgtattaaaacaaaaggtggacctttggaatatttatgataatggtaaaagtatccctttcactctagcatttaattattttattatattctcctttaagctcatttcaagttatatgttatataatttttcctctatcatctactcctcccgaagtataccttttggacccctgtaagatgacagagaaaataaaaagtatgatttcatacaatctatacaaatctgattacaaggtcagaatctggtgaataattagcaattgatcatccaaatgtccatcagcagaggtttggataaagaaaatgtggtatggccgggcttgtaattacagcttgtaattctgacacttaaggaggctgaggcaggaagattgcttgagcccaggagttcaagaccagtctgtacaaaagagtaagagccgtctgctaaaaacaaattttaaaaaattagctgggcatggtggggcaccctgtagtcctagctactcagaacgctgaggtaggaggatcgcttgaacctaggaatttg

SEQ ID NO: 130330 - DNA, 1003 bp, Homo sapiens
aaagtgaaaacacagtatttaaacagaattttccaacagcctgcatatagtgaggacttctcaagcttctgaatccttttccattgaattgtgcaatggcacatgtatgagcaaagtcaagcctcctggctcccaggtaggcacagcccagttcttagctcctaggaagcttcagggcttaaagctccactctacttggactgtactatcaggcccccaaaatggggggagccgacagggaaggactgatttccatttcaaactgcattctggtactttgtactccagcaccattggccgatcaatatttaatgcttggagattctgactctgcgggagtcatgtcaggggaccttgggagccaatctgcttgagcttctgagtgataattattcatgggctcctgcctcttgctctttctctagcacggtcccactctgcagactcagtgccttattcagtcttctctctcgctctctccgctgctgtagccggaccctttgccttcgccactgctcagcgtctgcacatccctacaatggctaaaacagcaatgggtaaggcactgcgcctcgttctccgtcggctctacctggagcccacctctcacctcctctcttgagctctagaagcattcagagatattttataaagaaaaagatgttaatggtaacacaggaccaggaaggacagggcagttctgggggaggtgggagggcagagaagaggtctatggaaatctaaagcgaagaatttcttttaaaaggtagaagcgggtaagttgccctcctatgggtagagaatttattctgtttccatatttaaaattaggactcaatcgtgaggggaggaagctaccttaactgtttgccttaaatgggcttaagggacattttggaaagtgctttataacgaccttttttttttttatttcttctctagtttaagaagaaaataggaaaggggtaaagggaaggtgggagaaaggaaaaagaaaattgca

SEQ ID NO: 130331 - DNA, 1506 bp, Homo sapiens
tttgaaagatgggtggagacggggggaggggatggagagaactgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgaccccgccctccccacgctggcctcattgttctgcttttaagagagatgggaaaagtgggttaacatttttcttttcggaagcaaattacatagagtgtttagacatagacacagataaagggttctttgaagacctttgatcgtttgcgggaaaagcttctagaacctagacatgtgtatgtataataatagagatgacatgaaatcgtatataaagcaaaagaggtcaaagtcttaagttaagccacgcgaaatttccgttttgtgggtcagacagtgccaaatatcggcaatttcataagctcagagagacaagacagtggagacacaggatgaccggaaaagattctggattcagggccttcatccgcaattggtcttgtgccttgagtgcccacggttctggcgctcagtggccccggggtgaaaaggcagggtggggcctggggtcctgtggcagctggaagcacgtgtcccccgggacttggttgcaggatgcggagacagggaaagctgccgaaaggactccatctgcgcggctccgccctgccctaccctccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccccttcccagggattcagggagggctgtctcttctcgcccacccacggtccgcggagctcggggctttttttcccccagcccaagccccccgcccaccctctgttctctatgattttcca

SEQ ID NO: 130332 - DNA, 1141 bp, Homo sapiens
aagttatttagcagccgaatattttaatgcttaaaaataaaggaataaattaaagaaaatcattgtttacttcttcatcgattgaaatgtgccccctgttcagagcacatctgaatatcagagtctccacctgcagagaacatgcagcttagcgagtaaaacaggcaggtatgtgatactgaggaggtgtaccaaaaactgactgctgttatttttcccatcttctaagtctgtctttcttttccatttaaagatacctttttaaatctaatccaatgtgatttcaatctagttttatcagatttcaacaattattgagcatctccttgtagtggttttctgtttattagaaaatcgatgttaattttaacgaagtaagaagaaatatataagtataaactaattttgggtatcatcaaaagtggattttttaaatatgcattgatagaattattttttgattacattttatgtaattctaatccagctataaaatatttaatagtgtcatattactgtgttcctcaaactttgatgtgcatatgaattacctttgattttcattaaaatgcaaattctgattcaatacatctggcttgaggcagacattctgtcttccgaacaagctcccagatgatgctgattctgaccactaaacacatcagttttagggatattaacttgtaatatacaggtatccctcctggtaagctctggtattatgtcttaacatttttaaatctatggtaatctttacaaaatattttacttccgaactcatatacctggggattttattactctgggaattatgtgttctgccccatcactctctcttaattggatttttaaaattatattcatattgcaggactcggcagaagaccttcgagagaaaggtagaaaataagaatttggctctctgtgtgagcatgtgtgcgtgtgtgcgagagagagagacagacagcctgcctaagaagaaatgaatgtgaatgcggcttgtggcacagttgacaaggatgataaatcaataatgcaagcttactatcatttatgaatagcaatactgaagaaattaaaacaaaagattgctgtctcaatatatcttatatttattatttaccaaattattctaagagta

SEQ ID NO: 130333 - DNA, 1024 bp, Homo sapiens
gagttacgtcctctgtggagctctgcaacaaggcgtcaagaggtcagagtctaagtccccatcagctctgcccttctccaccagtgctgctggtgctgcatggaaggaagagcccagaagggattctgagtttcagtctttactcttgctgacgcaccttggtcaggtcaattttcctgtttgttcctctaattcagcatctgtaaaatagccatgtgaactgccttgtccatatcagagggtctttttcagactcaaggaaaaaaacgtgaaagtgattagtgtctgtcaagtagtatataaatgcaagaagttgagtttttaaattgtcattagatataaatacccatgtgcatgcatttagaatgagtaaagagggaacaaggagcgcaatcaaaaactgcgtcatttgctttttgaaaaatactttctatgtaatgaaaagtgaaataaaatgttaattgagtccctctgacaacagcatcagacgttttgcagttcttgtgattagaacccacctggccagcccttcttcctcctaaagaagagccttcttcttcttaaatgaaggttggctcagaagaagcaattaactcattcaacgttttgttacagtcaatccacatccaacttttccccaactcaatctgctttaagggaaggatggtaagtggtggcccaagatggcaaccatcaagcttagagaatctctagaagcaggggtgtccccagcaagtagacactgaaaatatgagagggctgataagccagagataaaactcagtacttactttgcttctagtccatgtctacccctttcttggcaccaccttgacactaccctctgagtccaccttcctgagatggtacaaactctgcttagacaaagcagcccatgtccaaaggtgttagggctcagtttaaagctgccttcaaaagttaaaacagaagtgtaaagttctgtgcaattaaaaataatcagcttgtcttggaactcaaacgaatgtaaaatcctatgaaaatt

SEQ ID NO: 130334 - DNA, 1021 bp, Homo sapiens
gaactccgttatgtttctcgtctaaccaaaaagggcctacagctacgataatttccaaacaaataaatctgtgctacttgattttcatgcaaagctcatatttgttcaaaaggaaaataaagcttaatttaaaatcaatttaggctatttttatctaagtatgcttaccgttattcaactccctgcagatattgtcaaatttctcaatatggtaaatatttattctgttaaaatatatccatagttacactaaagacagagaggtcttatatgttctaaacaacatagagcaaatgctcataaacagcattttattcctatctcccggaataacaacgctacttccaattgctggaatctaaattattaaaataaacccatgctgcaagctttgtatgcttaacattctcaaatgttcacttttcagatatggaagtgaagcaaatcaacaaacgtgcctctggccaggcttttgagctgatcttgaagccaccatctcctatctcagaagccccacgaactttagcttctccaaagaagaaagacctgtccctggaggagatccagaagaaactggaggctgcagaggaaagaagaaaggtaactttttccataggttttccttctctctctccctcccctgctcctccctctcacacactcgggcacacatgcacgcacacacacacacacacacacacacacacacacacacacacacatacagagagcaatgacagctgaacctgtgccatgccaacatgtataggttttcagtagacacagagccaggctagttggggtaaaaactgtaagatagatgctaattttaggctagccaaaccagagctctcagaaatccaaagagcttcagtgctctagtgccccttcccgtatattgaatccccttattataaaagcctcccttccctagaccatcaggcagaagcactgtagagaaaacacagccctggcgaactccagtggtggggaggggaagaagtgctgcttcctccctctc

SEQ ID NO: 130335 - DNA, 1090 bp, Homo sapiens
aagttacaggtttgtgaagattctacctagcaaacatattacttttaaataactattaataaattatcttaccatgattataatcaaaggaatctgtaattgctaattatttctgattattaaaagataagcagtattgcactaaattgacataattctaactcaaagtaaatatacagatagacatggctatagatgtgaaatatgatttctgttagggctttttaaatttaaaaaaacttacgagttctcctccctccccctacccttaataccttgaaggcctctttgtgggacttcagggaccccttcagggaactatgacctaggctgtatttggggggctttctgggtttatagctggaaggctgccacagaggcatcgccacttgggctcagattcactttgtgttcaatgttttggcaatgtccccacctccccattccatctgttgacactattgcagcactgaccatctggttactaggttggaggatactccctcgggctcctttgaaccagaattagtgctccagtgattagataatagaagaagcttgtcataaaaagaataagccctttccctgctttttctccattctttgattatcgctggtagtcagtgatgatcatctctatgagtctatatcaatctcatcaggtcagtttgaacctcatctcttgaaatcaaagtttccataatgcaactgacccacaagggtgaaatgacatgaatgctttaaccatccatttatcatttattcattcattcaaccaacatgtatttagcaagaggcagcagagttagcataactatacatcccagttggcccaggacaactccagctaactctcgttgttttgataccattattaattatttctctttactctcataagtgttccactttggacaatcaattacatgagcatccttagcagggcacagtgtttaagggcatctttaaaatattgtctttaagaacatgtggttaagagaatgtctgtgttcaaatcctggttccaccacttaaaagctgtgtgacctcaagcaagtgacttaatctccgtatgtcctcctttgtcaat

SEQ ID NO: 130336 - DNA, 1025 bp, Homo sapiens
tttctcacgtatttccaaaggtttctctccaccctcacaattttccattaatgtagtacttaattaaattagatagttaaattttcaaatgtgaattgctaaacaggtgtggaaataccattggctataatcaagcatataacacaaccatttgagaaggaaagtatgtggcaatattagggaagagccctttcctctcaagcaattcagcatttaggaaccatcagacagcaggacgatggagggaacagagagggttaacatggcaagttactgaagaggacttctactgaatcttgttgaattccccacttaatccagattgtatcatatcttctttcttttgtaattctaccatatcatcttagtcaatgccaagacttctgagctcataacatggtaacaaataccaaaggagctttcagtatcgtttagaaaggagagaagcaagtaacccagacaaacttgacaactgctttcccctatccaaccatgaagtacagtacttaggaaataaaagaaattgcttcactataattcatcatttcacttctaatatctagaaaatgtcaaatgaaaatattatagccatattttagtggcaatagtagcacataatatgatgcaacttaaaatgataaaaatattttcagggaataagattctgtgattctttccctaagaggtaattttgataatatgtacctgttttgtaaatgtcaatagtcttggggatacaggtggtgtttggttacatggaaaagttccttagtggtgatttctgagattttagtgcacccaatacccaagcagtgtacactgtacccaatatgtagtctttcatccctcgcccccactcccaaccttcccccacaagtctctaaagtccattatatcactcttatatctttgcatactcatagcttagctcccacttatgagaacatatgatagttagtgctcaattcctgagttacttcacttagaataatggcctccagctccacccaagttgctgcaaaaga

SEQ ID NO: 130337 - DNA, 2334 bp, Homo sapiens
atgggggttatgactggaaacgtcacttggactgcaattatgaagggccttgacaaacaggtcaagagtttaagaagcagtatagaaagtcttcgtcctggatctagccctcccagagtgtccatcaggattataaagtccttaaaatattagtcaaaaggaacgacatcattagaaatgatagagaaacaataatgtgatgttttattacctttctctggatttatactctgatcctaatattcaaaactatcttaataacatgaacttttggtcatagttttaaacaaaaacagtgttaaatatattttttaaaacacagtaagtcttgtaagatcttttctaacatgacattttgcagggcccatattttccttctgaaatgggaaaaattcataaaagtagacaccaaactgggttacttctagtcaagcgcatggtacgcaaaggaccagacaaaaagggcctgtgacatttcttcttccttttgtgttttttaggagaggcatgctgcggaggtgcgcaggaacaaggaactccaggttgaactgtctggctgaagcaagggagggtctggcacgccccaccaatagtaaatccccctgcctatattataatggatcatgcgatatcaggatggggaatgtatgacatggtttaaaaagaactcattataaaaaaaaaaaaacaaaaaaaatcaaaaattaaaaaaaatcaatgcggtctctttgcagaatgttttgcttgatgtttaaaaaataccttggatcttattttgtaaatacttacatttttgttaaaaaatacaagtattgcattatgcaagttatttcataatcttacatgtcctgtaacaggcttttgatgttgtgtctttccactcaaatgaatttgctaggtctgttctttttgaagctccccatgtctaactccattccaaaagaaaaatgaggtcagtagacagtctatggtgctagaaacccaccattgcctaatgacctagaaggctttgttgtctctgagcttgactaagaccatacctagatcacaggtattatgactccacatgaaccttcacatttgttcgctcataatctacttactgcctaaaaactacaaaaccaggctaagaaataccaccagtcatagcatttacttctgcttctcctggattatgtgctacaaatgtgctttggctttagaaagggatggatgagaagacagacctgagaccaatctgggtagaagcaaaaagttgaaccttttaaagtgctgaacacaaatccaaattcgaatggttcaagcagccgtgaaatcgctcttcataaagtgggcttaattctctagtttaagttcttttgatggaatgaattaattaatgtgtcaggtggcttatttgtggatgccatgattgatgatgttcattttaagctcttacctatagtacaagtacatgatgctactgaatatttttccacttggaaactgtgagctggttgttgcattaaaacacacatacaaacaaaatcaaaaacactgcggactttcactcaagctggtctttcttccccagtgtaaggcaatcctgcctactaacaacaccaacaacaaaacactccatctgtgaagctgacgcagttaagggggctaggcagggcatttgtgccaactaagaatcaccagatacccaccataagtacctatcgcagttttgaagtcgtttctccccaactcccaactcctgaaggttgctgcctgcatatttactcttcattagtgctattttcctgtatgtcattgtgagcaagctgtgattaataaagaattggagttctgtgaactaataaaggtttggtctgttctcttgcctcttcatgtgtctgaccctggagttcagattttaaaagggcagccactgaattagacaatctcacaagcaaagagataataaggagagtttgaaggaaaccagtgccctgctgagtcatttccctttgggaacagcaggccgcatctcttttctcttgccctctgatgggccaacactgtgggagaggtcttcaatctgctccctttaaaaacatacaggactgaacaagataccacaaaatgcagactgataattctgaggaagtgagcccttttcaaaacattgaaggttcctggcattatctcaagttctcccctgtggcccacagaacgcctcccccagcctaggccgtctgttaagatgtgatccctgacgtactgctgaattttgtactgccaataaacacactgcacacatgggcgcagcagggtcctgtcagtgacccaaatggatcttacaggacc

SEQ ID NO: 130338 - DNA, 1049 bp, Homo sapiens
tacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaaactgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtattctgtggtgtatgtcttacataccttggcctttccccctcttggctaagaaaagataaactttccttggttttcattttgcctgattggtttgtatgtttaccagtttcattattcttggacttctaaactgtgtgaattcgtgccgttgaataaggtgacttcattacaatgcagagagctttgccctgcctcctacaaggggacatagcccttttgctcttatgtcagatgatctggccctaaactggccatctgtggattaggaaagctgaaatcagactgagacttacaggggttgaaaggagcttggatgaaatattttaaaaccgtgttgactatttgacaaatatttactgagagtacctactatgtgctcatttctatgctgagagaatggaaatttatttcttttattaattttttttaaatggcaaaacaagaagacccaaatgtaggggctcgggactctgtggcctgatgagcagtg

SEQ ID NO: 130339 - DNA, 1021 bp, Homo sapiens
aaggagtgttggtcctgctttcaaatgagtaagaatgtgatgtgaccactagagatgttttttcaatgtgagcaaaatcattctgaagggaaggatgaaaatcattagtgaaagttgggtgaggtaactaaacccagtcttaaggagtttggagagaacctcggccctgatctttcagtaggtatctctgaaactgattgctagtgcatattgatagaaactagaagcaaagctgtcaccttcctctcacttccatagccagctcagcacatccaaggaatcccccatctgtagattttatgttaaatgtttgattttacttaataaatatttgtaaatgtgtgtaaaaattttgtgtttctttttcatttatttgtttgatcaaattggggctccctcaacagagaactcatttataaaactgaacctatagtccaacttctctagaaagcaatttggtctgtatatttgacagtctaaggtagctttttgacagacttgcaacagaattttccgttatgtacagatgctcttctgtggaacatttggtttggctctaaccttgtctaaacagatgcactttgccagtgtctttgaggggagggaaaatactggcaacagtaaggttcttttttgttgttgttgttgttttttaatctggtggcattccctaccaaaacttcaaccataaggtatctcaattttatttttttaccaaaaagaatgagctttaaaaccttaattttaacattcagtttttctacttttcttgattcaatagcatggtttgaaaaaaaaaaaaaagcacagcccacaatcagagagaacagggtggaatcctacctctactgtttactagctttatggctttgggaaagtttttcacttggaaaatggtgatagtaatgcttcttctaaagttgtttgtgtgagaagaaatgaaataacatgtaaagtgcaaatcacgatgtgtggcaaataggaggagcatgcccccccccacctatgtctttttaatgta

SEQ ID NO: 130340 - DNA, 1053 bp, Homo sapiens
atatatccatcttttcctttatataatactttttgtgttcagtttaagaaggctttacgtatcccaaagtgtagaatatggtcttaatatatattttagaagttttattgtttaaccatttatattcaactctaaaatccacctggaattgattttagtatatgggatgaggtagaagtcaaatttcatttttttcatatgattatccagttagcctagaacaatttatgaaaaagactgtccttcttgtactgttttgcagtgctacctttttccaaaaataaaggcctataaatggctgtttctggtatctctattctgtaccatgtctttgaaccaatatcgtattatcttaatacatccagctccaaattctggagagtttctggtagaaccctctgcctttgacagccatgtactaatgaagttaaaaactctctgtcctctgcagcaacagtgagaactgtacacgcccttgtgtcatggaatacgcaactggagtggcattgtattttttaaaaaagagagaaaacggctgcagcctgctgagctcaagcagctgctgcttgatgtcttccactgtgagagcacctttctgacaggttctcaggctcgactctgaggtcagagcaggattaggacaggaacccactttgcactgacagctgctctgttagtcagtgcactgacttcagctccatggcttctcaagaatgtttaattaattttctcactactgaaagttatctctaaaaatgttataatcttgtgctttaactggttttgttttttgcaagagattatgattttcccaaaatcagatgaaatttgtgttctttacctgctcttggatgctttacatgacacaaagttatgaaattataagtgttactatccagtcttctcattattattatctgagaatagatagtttcctttgcagaactaggtagctctcaagagaggcccagtcagcatattaaacagctggctccctgtagcagagaagctacccatgggaaataaggaactctgttgatggcgtgggactct

SEQ ID NO: 130341 - DNA, 1072 bp, Homo sapiens
caaaaggcttttcatatttgtaagaaatagcaaaccatatgccatcttgcagaagccctgattgggaaagaacgtggctcttggccagcaattaattaagccactcttttgttttggccatattgtggtggtgcataggtgtgaaatactctgtcttcactaaatagaaatattcctgtgtatccatgataattttaagaaaacctttcaattttggtgttattttcctataaagtaataggagttgtaagtgcaagtaattgaagcatgagaagaatggagaaaagttattgggataaaatgaatttggcatttgggtagctgaaaaatgattcctatcattttggtccatagaaaattgcatcaatattaacaggaagttggaagctgaacatctgtagcaggtctcttgttaaagaatagagaaagagaaaagattacttaattatgtattgtgtatactgggatatcctattgtcaaaaagggaaaataattagcctgactaatcaatttcctgcatttctcctgaattccaatttagatattcttgaattatcttcaagtagagatctctgatatcagattatatgggctcaattaggttactcagtgttcctctcatcgttcagcttcacttgcctctcattagagtagaattaactttttattcaggatatagtagttaaacagagttatgggccttgggtctaaagattgaaatcagggaaggccggcctcaacagagagcttcctttcacccattttgaccattgtcactgcttcccctcattcatcctcattgctgttgatcttagcaagaaacccagagacactattgccttgcttacaaataaggttttatgtttgatcttttcattttgtaaaagataaagcacctaaatcttaaaagggtgctttctttttttaatgaacagcagcggctctgggaatttcaaaagctctataatgttttgttcctgtggtaaaaaggattcacaacagacattgtgatctaaatacttgttttctttttcttttaatggaaaattatttccctaagattaagcataa

SEQ ID NO: 130342 - DNA, 1042 bp, Homo sapiens
aatctcaccattgatgggctgcatgagtgccctcacaacatagcaacttcccccatagtaagtgatgagagagagagagagagagagagagagagagagagagagagagagagagagcaaggaggaagtggtgatgccttttatgacctagtcacacattgtcacttctgccatattctgttggttaataaccaagtgagtcacaaagcccagcctatactcaagagaaagggaattgggctttgccttttagagggaggtgtacagagtttgtgtatgcattttacgtatttaatttctgtgtgtgaacaaagcttaacttttaatacaaaaatttagtaactataaaaacacaaaatatatgacagcaagatttaagaaaatggaaacatctttctctgctctgttttcagtgttaaaaatattttcatctctaatatattattagacactacttaaacctagattttctgtatacttccaaggtaacctttatttttttctttccaactgtgattctaggtatctaaaattcttgtctccttacttatccatacattgagtcaactgctagcagctttgagctacttcagtaaacatttatcaagtggctgctctttgctaggcctagtgctagctttggctttaaaagtccatactgcttctctttctgtctctattaattcaaatctggcaaaagttctttttttaagctgctgacactccattttcttaagtagttatttctatctcatgcaagagagccttgctaatttcagacaaatttcaaactattttttattttggttaattgaattaaactctatccagccatatagtccagaaagccaagagtcagaatagactcatttctcttcattacaaccttcctcctgcatccactcaatcagctttcctcttaattatcactgaaatctgccctttcctctgtctctaccattagggcttttctccagccatggatatcttgtaccttgtacctgaatttgccacagttactttttttttttttttttgagat

SEQ ID NO: 130343 - DNA, 1649 bp, Homo sapiens
caatccctgcttccagggagttgatctggtcagggggatagagaagtaaaccaataaatataacatcatataagttctgttcattgtattctacaggcatggagaaggaatcgatggttcaatctgcttgtgtcagaggcttcccagaggaactaacaatagaactgggttgcaaaggatgggtaggagatactaagtgccgaaagtgagagtgtttctgggtgaaggagcagcacttgaacaagttttaaatgagagagaggctgcctcttctgggaattcaagtggtttagttggcttaagtttaggaggagtgatgggagagtggggagatgaccaggagccagattttcaaggaatttacatattgtcctaaaaaattgggattttattttcaaagtagcaaagaatcattaaaatattgtaacaaggaacgtgggtcaactttgtgtttcagtgagatcattctggcagaggtgtggagcatatttcggaagaaggatgtgagagggcagttagtaaggaagctgctgaaaaaaatgatgagaatatgaattaaatctgagggtggagaaaggagacacatttagcagtttaggaggtggaagagacaggtcttggtgactgaatagttgtggttggtgagagagaaaaattttgaataatgtttcattttggacatgaatggactgggtagtgagttgggttgtgttggggaggtagagaaggggagtgtgttattgatattattgcctgctttaaaaacaaaaattaaaatgcccggatgtagatcacttttattctcttatttccattcaaggtcataatacttgcgattagtgttagtcaggaacattctctttttataatataatattgtatatatgtgtataaaatccctgtggttaaactatgctgttgctttggtcaaagagccaaattctccaaatcttttcatttcattaagttgtattttagttttgatttttcgagagttgtaaacatttctgtaaaatcttcaagtccagttttataagtaaagtccgtttactaatgtgttaatgaggattgtgtcttttaaagcattgtctctatgctggctctctatcataaaacacaggattgacagctctgaaaattgaagggtttcaaaacaagcatgattggcagctctaaggtaactggcacgtgcactgaatcttatttgtacttttgtttgacactaaggtggaataaacaagctaattttcccatctttgtttctatttcagattgtgtgatatgtagggtcagataaagagtggaatgtatgttggatgtttcaaaaactaaagttttcaaggtgtattggtggggaaaagagaaaataagaatttgaattaagtgggtcattttattgcagaggacatggaacacattaaaaaagcatgcatgtttttatataggttggtgatttaaaatcattctactagtttttctttaacagatctcttcagtcttttttaggatagaagagcatccgttatatttagctttttaataggaaaccttaaaatatgttcaaatatgatcaaattataaagtatgatcttagagatgttccaagttcatgaaactcatgtaattcagactgaatagcattggagggg

SEQ ID NO: 130344 - DNA, 1099 bp, Homo sapiens
ggtattatccacatttcccaaatgaagaaaatgagtctctgagcataaataatgtgctgcagtcatgcaactagggattaacaaagcagggattcaaatctagggctgtgtatatccaaattttcttttcaccccgctgtgcttcactctaaatcatacaatatatagtaactcaagcatcataaagacttcctaaaacagtcttacatatgaagcagtttcattccagggaccctgaaggcagtgtggcagtgaagctctgtggaggtctgttaaaaaatcataggtagtctgttatatctttggttatggtgtccattgttgctgtggtctgaatgtttgtgtccctgcagaattcatttgttggaacataatcaccagtgtgatgtagttaggaggctgggcttttgggaggtacttaggtcatgaggattctgccctcgtgagtgggattagtgaactggctagttagttaatctatgaaccagaaccaggtcttcatgacactaaatatgcttgtgccttgatcctggacttccagcctctagaactatgagaaagaagtttctgctgtttataagataccctcatttatggtgttttgttattcagatcgaacagactaggaaatagtatggtaagttggaatagtgtaacccccaataagctaataactatcaggtctaggctttgttttgtaatggatctgtatcataattgtggtaagacctctagtcacaggacctggttaatatcagtatgcctcatgttatttgggaatgatgtatttcaaaaaagtttattgtgtaaataatagaaaattggctatttatacctaatatacttaatttttaattgtttattggttcttttaataaaatgtattatatactttctttgaaccttgttagacctaaaatagttgaacctttttttgtttttgcttttgatgacccagggtcataattataaacattaatttctatattgtatcataataaaaatatacagaattattgctgcataaccatataaccctccagttctgcagttttgtgttatctctcctttactgctgttatgcccttgtctgcttttt

SEQ ID NO: 130345 - DNA, 1521 bp, Homo sapiens
tattcgaatattccagaagacagaatatctaaaatcagatgttcaatcctttcagaatactggaaaaataaaaatatatagatttaaagggcttatttcaatataatagggaaattaatttatttttagtataatttttaagtccactaaattcatatactgtaatagtaaaattatatagttttacttaaccctttgttttcttatcagttttactgacaactttaagaattataccagtgttttaaaaactatttgatatgtaaaggaatgatggaaaatgtttctggttttaacgatggtgccaacctgtttttacattatagaattctaggagaattacctctgagtaataaaaatcttttgaaatgttgtatgtctcacattttcaaagcatgtttagaggaaatgaccagttaatatataaacaatgaaatagtgaagaagtacatagaattctctggggaaagtaggtttttgttaacacctgtaacatgcttataagcagtactatacatttcttaaaagaaaagatgtatatgttctgtatgtattttgtttttgggtggtcatatgatctgattatacccaatcagactcatgacttcccaagccaaccttaggtttttcactatttggagatcgtaactctcatttttactcagaaatttcacttccatcttttaatgtgtctaagtttgcttctaaggctacacttaaatttttctcttttaatcactttaatttttataacctgattatggcccttaagttttttatctattggcattaaatatcaggaaataagagcaattaagcacattcaagtggagcctggtttgttgggatttgggaataaaactaaatagtcttgattcagtttgggttttgcctacctttttaaagctttggagattccattgttgacaactgccaggaaatgagtggtggactcagtctaggagttggcagctgaacaagttgcctggcctctggccagctacccaaattgagatggttggattctctgaagggacataaatgtacactgagaactgggtgtcactgggacacacagtatttatcccaaagaaatgaaatgttcctaacagcttcatttgtaatagccaaaaactgaaagcagcctagatgtccttcagctgttgaatggttaaacaaactgtggtacatccttaccgtggaatactacttagcagtaaaaagtaatgagtgtttgatacacaaaataatttgaatgactcaaaggaattatgctgagtgaaaaaaaaaaagccagtcccaaaaagttacatatggtgtgatttcatttatacaacatttttgaaatggcagaattatagagatggagaacaggtcagtgcttactaggagttaggaaggagggaggtaaaagggatatgtggagttacaaaaggacagcacaaggaatccttgtggtaatggacttgttctgcattttgactgtgatggccagtacagaacctttacatgtaataaaat

SEQ ID NO: 130346 - DNA, 1078 bp, Homo sapiens
atattcacaaattctagagattaggatgtggatgtctttgtagggggagggggcattattctttctaccatatatggagaagtcataaaatactagcagaatagcgatgattgacctgaagccacctaagggatggattttagatccatccttaaggtaaggccataagagttaagtgcagtaaggttggaaacatagagttcagtgctcccttccaaatatatgtataggaaaggagtttttctatttcttacctaatatttctcactcacgcttcgctcccattcataccacattctaagccccttcggaaaccccccaaaataattctcaattgctgagttaactgtggtaagagtgaaaattgtagcatcacatgtatagtaagttaagtgtttgaaactaaaaatgtactgtttatttaatgaaggaaacaaccaaggtgttttagagtccccagaattccctttcctttccttttctctttcctttcctttccaaggcagttctaattgggctgttcagtttttccaggaggaggctggggtgtttcctggcagtcccagcacatccgttagattttctcagtccagctcaggctcagcagcatctctgcaccctgcgtggttgttctccgtctaacacagtttagaaaacattattctactagatgatgggtaaatgtgtttggttgtgatgtacagttcaccaatttcttattcacaagtctttgacatcttggtttaatggaaataaaattccctggggaggaggatatcaggaggctgtgttgtagtctccgttcagcaagttcttagctttgaagcatttgaagtttacgtgaacccctttactccttcttaattgataccactgacttcagttgctccctggttcaggtcattacacacactgtggatcaagttatcttcctaaagttgggctctataatcagacttaatgaggttatttacttattgctctccttgagaatcttctaaacctccattcacactgcctgcaagattaaatatacaatggtgcatctctctactgtggcttcagaggcctactgcca

SEQ ID NO: 130347 - DNA, 2203 bp, Homo sapiens
tatgcagaatcagctagttttatgtttcataatgtctttcccttttttgaacttttttttaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaag

SEQ ID NO: 130348 - DNA, 1044 bp, Homo sapiens
aaaaaatgctttaggtcactccaagcttggcagttaacatttggcataaacaataataaaacaatcacaatttaataaataacaaatacaacattgtaggccataatcatatacagtataaggaaaaggtggtagtgttgagtaagcagttattagaatagaataccttggcctctatgcaaatatgtctagacactttgattcactcagccctgacattcagttttcaaagtaggagacaggttctacagtatcattttacagtttccaacacattgaaaacaagtagaaaatgatgagttgatttttattaatgcattacatcctcaagagttatcaccaacccctcagtataaaaaattttcaagttatattagtcatataacttggtgtgcttattttaaatagtgctaaatggattaagtgaagacaacaatggttcccctaatgtgattgatattgtcatttttaccagcttctagatctaaactttcaggcttttgaactgaacattgatgacagtgttcatagttcaacctactgaacatacagtgtgcttgattcagaatgttattttgtagaaattaaaattttaacctggtgaaaaataagttgatataagtggtataataaacaatacactgaaatggttactgtcacaaacggtgctaaataatgatataggaggttccactctcaagtcacctagaagtttgattacatattgttacttacaaaactataataaattggatgcacagctgtttacttcagtctggtgtcttcaaccaaaatatgtaccttataccaaaacaatgcttattccaaaatattttttgtagctagtagttctttccttggaggtaaagaaaatacacccaaacttttaattaccaggattcagaatatttaagagaacaattttagttaagaatcaaatatacagagattcaaagaggggaaaaaaaggaaatattatagaagacaaaggtcaaactggcattccagatctggagcaattttgtaaagcaggaaaacaactat

SEQ ID NO: 130349 - DNA, 1412 bp, Homo sapiens
gcctagacaattaaatggccaatgaaactaaagtgaggtaagggttctgatgtgaaaagctgagggtgtgatgaggacaagtggcagaaagttcacctggcttggtggaagggaaggtcagagaagacctcttagaggactcagtaatgtccattgaggattttaggttgaagggaatgtttgaagtttgagggcccttttgaggaccaccaagaacttcactgtgctgtaggatattgagcaggaggtgaagctagagagatgtgtaggccacattgcagagtttgaacttggggcaatgggaagccattgaagggttttaaacaacccaagtggtgcattcttctgtaaatgttagagagatcagtggctgccctgcacatcaaaggggagaacgattggagacaggcagattagatggaaggacggagttgtactccaagccaaagatgatggagagtgaattaagttagtgcaatgggaccaagtctagagctatttagaagtgagaagtgacacggaaaaaaaaaaagattgattggatgtagaacaagttggataagaatccaggacaaccccaggtgtcaggctggggcagctaggtaggtgctattgccatataaagtgttaaaaaagaatagagaaggggctagttgtcgggggaaggagttcagttttagacatgttgaactgcaaggagatttgatactataattaaggaatgtgttttaataaatttaataaacaatgaacacacattattcgcatttcccaaacaatttggatggtagatcaaaaagaatgagagtgaaaataaggggtctgtgaccactcaattaagattgagctaagagcaaggtcaagttcaaacccactataagcttcttgcatccatggtcactgactgttttcttactgttagctgtcctgttggacagtgtaacagtgagagagcatatacagattagcattgaaaaggataaagtgacatgtgtaagggttttgaaaaagtattatacaaatgcaaggcagatatattgaaataaatgcttattggcaaaatttcaggccagataggttggagtagtgcttcacaaactataatgtgcacatgaacaactcagggattttgttcaagtgttgatttcaattctgtagctggagttgggtggggtagaaaggatatctgagatcctgcatttctaataagctcccaggtaatgttgagtctgtaggtccttgaaccacactttaagtattaaagggttagaaagcttatactgtaactgagaaaaaaacatatatttctttcccatgttgtattcaatatttcttgaatgagtgtagctaaatgagcaattcgatgcaatacaaaatgttatgcaagtgtagagacagacagttcactaggt

SEQ ID NO: 130350 - DNA, 1019 bp, Homo sapiens
catacaaacgttagtacataccttttctgtttgtatgcagacatatgaatgttttttcagaagaggagttacactgtacacacacagtcctacagcttattcattcagccctcactagcagggtgctttgtgagccataaatgcagggacctgttctttttggtcactgatacttctcaaaggcttagaacagttcttggcacattgctcaatatgcatctgatgagtaacaatatatataagagtcattcttctatgtcatttcaagagacctgctttatttttcttagtgccaagtcatatatttgaaagcaaactgtagttgcaggaagtcaaggattactaaaattcagttctcaatattgttaggactgttatagcctttccttgaaatctgccccaagtgttaatttttgaaatggcaaattggaaaaccaggaatcttatgtgtttttgacattggacatgaggagaaacttccaggtcattcactatatactctcctgaatatatttagattctataaattgtaatgaagtctgctttaaaatatgactaggcaccattcagattaaaaagtgtaatttaaaaacatacaatatgttggctgggcgcagtggcttacacctgtaattccagcactttgtgaggccaaggcaggcagatcacttgagtccaggaatttgagaccagcctgggaaacatggcaaaaccctgtctctaccaaaaacgatagaaaaattagctgatgtgttggcatacacctgtagtcccacctactcgggaggctgaggtaggaagatcgcttgagcccgggaggcagagtgagcagcgattatgccactgcactccagcctgggtgacagagccagaccctgtctcaaaaaaaaaaaaaaaaaaaaaaaaaaaggatagcgtattaaacagataccccaagtatcctaaggaagctgtaaaattacatgctggggatataattttgttaaattacatttatatttaattaaacatgaggtcca

SEQ ID NO: 130351 - DNA, 1753 bp, Homo sapiens
accatgacaagttggttggggaagtgacagaattgctattttacccggcttcgttacctctccttacacacgtacttgaccatatctatattacttatgtctgagactggccctgttcatggaatcaaatgcatactcttaaaatattagatcagaaattgagaatcttacattataaatacttgtatgtacctgcacatatatggtacagattatatctgttcttttgccgattgagaataatgttgaagaggaatcaattatattttcaaactagttggattttttttcagtatttgtatttactatttgtttttcttttctctccatagaaactccccaacttttaaatcatttgaagaaaaggtcgaaaacttaaaggcaagtagagagatgaacagggtctttttgatacattgcctggtgtcttaattaactttgctgtgcgaaaatcattgacattaatatttctttctaaaaatatctaaagaatgtaaataactttactccttatgttactagtggacatttaaggtgttatgtacttaatatctttttagtgtatgctgtagtgtggcagcatgccacatgctgaaaggaaatgtacaatttacaaagaaatggcactttagaaatttgtgctgctttttgctttattcatttcaagtacctttgtaggtggacaaaatttaatataactttcttgtcaacaattaacaagaatataggaagcacaagaaagaaaacaaaaaattggtcctaccactcagacagtgatagatgtatgtgctattatgctgttacgctttaaaaaagaagtagccatacatcataatcattttcctgtatcagtaagtattctctttcaatattatgtgcaatggctgcttgtatattactttttttttttttgagatggagtctcactctgttgcccaggctggagtgcagtggcgtgatcttggctcactgcaacctccacttcctgggttcaagcgattctcctgcctcagcctcccgagtagctgggactacaggcgcgtgccaccacacccggctaattttttgtatttttagtagagatggggtttcactgtgtcagccagaatggtctccatctcctgacctcgtgatccgcccgcctcggcctcccaaagtgctgggattacaggtgtgagccaccatgcctggcctgtattaccttataatggatattatttgttcagtcctcaattgttggacattttttttattataatgatgccatgatgatcgtttatgattcactgtttttattttttgatttctttgattttagtggaggtgaacatttccccataataatgagctttattgatttgtaaattatattatctttgagattatattcaaagctataaaatcatcaactcttaggatcacaggcaacctcaaaagttgtctagttcccatctattcctcgaccctctctacggagtttgtataaaacccatattttcattacttcctaactctgataattataggggatatattttaaggattaaaactagtatcttaaatgtttttatatcagtcagtttaaaaactaatattcagtttagtctttcagaactttgagtcacgaaatgcatctttaaaagcagggtacatttattgaaataaaacactctacagtgatctggatctttttttaatttatttttttattatacttttaagttctgggatacatgtgcagaatgtgcaggct

SEQ ID NO: 130352 - DNA, 1663 bp, Homo sapiens
ttattatactcttataccctaggtattgaccaccattgtaggatagagagaatactgagttacatgcatcttttcctgttatgtaagacatcaagtacagaggtgtttaaatatttcattgataatcctgattacacagattgccagcatatttgacatatatcacaatcattctccatgttatcagatattaatgcaaaattagatttgaggacctacattgaagacacgttatcatttgtaccaaatgagtctttaagaaaaggaaatcataagcgcacaaaatatttaaatataactgagaattaataccttgaacctatacactttacccaaaggaaagtttatttaccaaagtcgtgccagtggtcaaactattataagcatagtaacaatattagcagaatacaatcattttacgagcctaggaatgaaggcactctcatctcatgaggtggtctttatgggagatggctaagagtaggtaaccttgaacctgagtggtcagtgaactgcattgtccttgagtgggcagttgcctccttgtcttactaagagcccttccctggccttgcttgtgtgtgtatgtgtgtatgtgtgtgtgtgcatgcttcatttttgaggggaggcgataaacactgaattagacccaagttctattcttgattctgctgtgacctacggtaactcatttaacacctatatgccttacagctccgggtgaaagcactttagttttcaaagtgctgtaaaaatgcaaggtggtattgttagctctagtaactcctgggaattaattggctcctgaataaaagtaaattatgttggaataactttgatcccctccacctcaaaaagtaggtaattcttcatggcgccaagagaataaagctcctggggagctaagttttgtcagcttttaataatgttgaagcaccactatactaaccttatttctatctctttttaatgctgcctcttagtatacgttccattcagcattcaattagcatgcctgctatgaggtaaagtatatttttatgaaatgtagttggtcttatgctttatttttctttatttagatgtttaacttgaactgttctgaattagggaactagaattccccttgaaacaagctgtgtgtttaacactctatcagttttcagctacacttcctctgatgttgggatgggtgcaagagatccgttaaatgttttgattttgtttttaaaaaaattatttctattttattttgtaaaacctttgtttcctgtctgaaatctgttcacaaagtgagcactacttgttaacaaaccttcttttgtcccgccacctctgtctgcattcgctttagttacattctccttttcttcatccttcccattttcacttcccccatcccactgtgacatttggagccaactatgatttaattctactatctgctttcattagcacttgcaagtgatattacctcacctaacctctctagagagttagaggatttttaacaatctgtgcttggcttaaacttaagtgtccatcaaaatcacttggagtgcttgtgaaaccgctgcttgctgggccccacctctagagcctctgatcctgtagagttggggtgggacctgaaaattggcattgcttatgacttcctgatagc

SEQ ID NO: 130353 - DNA, 2912 bp, Homo sapiens
cactttgtccattttgtttaaaaaatataattaagattatgctgtaccattttcagtcttgtttttaataaatattaagtttttatgaatatttaattgcccatcagtatgtaggggttaaagtaaggtttttgattaaaatttggaaatgaaagaaatgagattatcttttgaaagttaaactttgtaattcttgcaaatcacaggttaggtaaaggcatttaaaaaaataatttcaaggccaagaagtcctgattgtgttctgatttaatgtgttgacacatataaagaaaacctacatcttttagattatgtgagtcacagaggcaaatattggccacgttccctcaagaactacccaaggaaagggagcttaggctgtagatttgagtgttacaattccagcaataagtccttttctcccatggaggtggatacagtaggctccttttgctaagtgctatgaagtaggtggttagtccttaatcccactcactgtttgttctaggtccattttacctggcaaacttatgccggtgattttactccttaatgtaattatggatatagaaggagaaaatgcagcagttttgccaacctgaatgtgttagactcagcaacagtttttattttacatagtcagttgataaatcagcacttgggatttagatatttgccttatgccttgattgaggggagggagatgtataaggaaatagagaagagagagagagagctgctcttgatgtcctgagaatgaggtgtggtggtagcaaggccaaggaggacgtggtcatgagtgctgtcctgggaggccctctggggcagcctgcttttccctcaggtgatatgcttatatttcccctctgtttgcatatgttctatgcctatgtgaaagtattgactcatgcctttagcattttgagggaaactttaaaagaaccttctcattgcagtcagtgccagggttaaacataaaattttagtgttattaaaagcatactataatattcagtagacacatttgtctcatatttttggtatatttaagaggaagtgctaattaattttgcctttatttccaaagaaaatttctcctttttaaatgtgtgtttcttcatgtgcccctgtagatatttatttggtttgggctcattaaagtcctgctagacaattcccttttgctgaaaacttccaccacttaatgggaaaagaaatgatctctttcctcgtgtcagaaaaagaatatcttttgattagaatttgaaacactttaatgaacttttctctgtttcatgcccatattcccaattttagttatcaaaattgtttattcatttattcattcattctttcactcaaaagtatttattgagtgctaactatgtgccaggcattgctgtagactataggggtggagctaaaaaccaaaataatgctgaaatttgaaagcttcaatgtgaaatttgaaagcttcaacgtgatatgcttatatttcccctcctgtttgcatattttctatgcatatgtgaaagtataatatacagtagatgctaattcatgtttcaattaaagcatgtgttataataataattaacatttataagcccagcgagacaatagtacctcagaagcagatgctattgtttttgatattacagatgaggaaactgagccatagagagattaagtgacttccccaaggttgcacagcaggtataagtggctgatggtcaggactggaaccgagcacacctagtcctggagcctgcactgtcctcctgggcctccccagagcagtggtggtttaagacagtgcccctctaggcactgtccagcactttgaacaatagctgctgtgatcaccaacatcaaaagattgtgtgagggcaaagtggaataatagtacatcaatagctgtgaaaagcatacgtggtatatagtaagcagtccaacatgttagccattaactttcccttctcctcctcccgctgctgctacttccttccttatcctccctctaccccctcctctcttattattattgagcatgaaagcatcagataactgttagaaacaaggaatattttttaaaaatcaattcagctgttttaaaaaaatgactttttcaaagtaagagtaaatgcagtgtgagattgaaaagtacttagtgagaatcagattatcctgattttttttttcagtgttttgaggagcccatgtttgcattcctagtttgattacagattaatgtatttgggggttacaaataagatgcaacatttttaacaaaatgtgccttatagatggtaaccgattcttacaacctatctattagagatgattctggtcccgtagcaacatgactttttacttttgaaggtttccatattacatttaagcttgaatgaaactgaaaatgatgagcaagttgaagctttgtgtaacttgccatagagaagccagaaatgaaagaacagccaccctatagttagattacaactagttaccaacaaaattgaatttcatctaactatggattatggggaggatccagcaaccagatagaattgaagctgatgtgtgctccttttcttcctactataaaatagctaccataaaagcagagagaccttgactttgactctgttaactgattttattctgtttaatgggtatatttatcttcaagtgtgatataatgcatacagaaaagtgctcaacaccaaattcatttcagtgatttttttcacaaaataaacagtctagtcacttccttgcctttccttatatattaccactgaaacatatttagtaggtacatgctaggtaaagtggtatagagcccaaccgatccactgctggaggaagtgatattgtacatgggttcttagggacagtgactagaatta

SEQ ID NO: 130354 - DNA, 4654 bp, Homo sapiens
tcgggagagtggatgttagagtgctttattaagtattatctgtgtagaaatttgagtcctaaacctacatgagatagctgagtaaggaagtatagggagagaggagaaggccaaaaacagcttaagatgggattataaagagctcccatggaggaggaaagagaactctacaggagagatcagcaagtaaccagtttactcaacaacattatacattgtttttagagagaaagataaatgattcaaaaaaatgtttaatgactggaattttggatgtagttctgtggtaataatcttaacttactgaatgacttttgctatattcttaccccaaaccccttcctcataggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgtatgtttccttgatcatacactttccttgggagtgtaaaggacactgttgtgccttttgtctggagaggggaagaaaaagaggataaggatgcttcagcagcttttctttggacgacacggcaccctttttttctgattttcaagtgtgcctgcctttttttgtaacttcaatttttccagaccacttattctaaggaatagaaagaaagctagccagttggagaaataaaattcaaatcccataagtgttatgtattgacttgccacaaatatgtacattttgtcctttagtactcagaataacccagtaagaatgggtggcaagataaccctggataaggaaacaggctcagacaaattaagttttcatgtcacaaacctctcaaaatgtggagtgggaattcaaactcaggtctggagccagtctttattattattattaatgtatttttttaaccttgttgtgtaggtatcaaaagattctcaggtcgtagtctcagatatatgctcttggcagaggtcaatcccttaggctttttgtctttttgaccacacatgctatgatatagcattatcataatgcagttttgtttcccggcacaaggaggagcaagcttctagcagcagaaaccgaactgctctgtcttctgtattgagagccatctgcagagctggtgagcacagaagttgttttacaatttaactatcagaagtgaggccaactgcatttaacatgacagtacttgagtccccagtcttttggtccattttctacccatctaagttggcagtgggaaaacatacaggaaactattttttcaacagtattaccatgaaccatgtttttttattggtatttgatcttgacagggtaagtaaaaatgcctgagcattctttcccataatgtgggaattgttttggtaggtacgatattattttgttttttgttgttgttgttgtcatcatttttttgtttttgcttttctcttctctaatctccaggtagctgggaaggaggtggtaaattatagctttgcgtgatagcagataccacactagaataattttaagcattgcatattttacatactttgttgaaagtccatcatgtccgtatttggtagctctctaaagacatgcaaaaatttttagaaagtatgcccataaaatgtatttggataataaaatacaaatgggtcctacttacgccagctactaattgcttctggcccttttttaggaaatcaagttgacaaaggcatctgaggaatttgatttcatttttgttttgtttggattatgtgagaaaagaacaataggtatgagttctttcaggcctttgcttattttcatcttggtttgatgattatttttagcccttaccttgacttctttggccctgcctttataggactctgtctttctggctggactagggcactgcagaagattgtgcctgagcttagggttgagcatacgaagatgtggtgatgccgctctgctggttatgaaggattttagaagttctgaaaaatgttttctctttttgagagttctccagcaggtggtgaccactgcacttgaaacaattgatattagaaaagatgagctgacccttcttttgctctgtgtgtttataatttaatatagttacaagaagacatctgaaaccttatcccaggctggacagaaggcctcagctgctttttcgtctgttggctcagtcatcaccaaaaagctggaagatgtaaagtatgtcctcatttttccttgctcattaagtagctgacgcaaattaaaatgttattgttgttgcatctgtttcctgaccttggctctagttgatgctagctactcctgttagagtgagggagggcactccttcaaaccagtacctggaaggctcatctaaggtcttctaggcctagcattctaacatcaaatgatcatctgatgatcatttaaggttgttgaaaaattctggttgtgaacttctttgtctttttagttcttcatgatcatgcagggtaagtatgtctttggttgcaaatttgtgattgtgggcagagcctggtgtgttactaaggatgactacaggagcactgaagtgcacgcttcgattcagatttggcttcacgttctatatgtgacattttatatcatggtgtgattacaacatgctcatttgtgcactgttttattctaactggtaagctgtaactatgttcatgcttaggccaaaatcttgattttgagttgttgctttttttttttttcatttagattagtctgcagagttttccttgccatttttataaaaccacttcacagtgcttttgtgcccccccttcactcatgtggattaggatagtgatgaaaatgacaaatgtggtttaagtcagctgtgcttctgttggcatgcaagatttgtgtttaaaaaaaaatgctcagattgcatggcttcgtgttttgcatttgtggggaaagtgtatatcttacaaccagaatttcttggttgaatagatttggtcaatttatgtgttatactttacaccaaaagaacaaattcctcgctcattatatttagactgtcattgtctaagcataatgtaataaatatagctttcttgaactcttttgacaattatgtatgtatctattaggtgttcattttctctatgctgactgaattgtgtagcagtttagagcccagggaaaacattatatgtttaaaacttaggttatttaattgttttagatttatcagaacttctttcttttttaatgcttactctggcttcttacagattgcaagccttttcacattcctttaggtaaggagagtttgaaccatcactgcagtccagcagttgtataagaaaagtgtgctgagattagattaccatgctacgttggatgatcgtgtttgtccagtacataattttcttgcgtttagagtatctttttctctagtgcattcctaatttcaagggagggtttcttgtataccatgggtagttgataaattaaaagaagtatttgacactgtggttcaagggatatggaaatgattttgacatttcttttttacttttttctttggtaaaaagaagcagctttaccatggcatgcaaaattcctcccttttaatgtctgactttgtttgttttgatgcttttgtttctttggtacttttgtaaggatgttggaattcttcacctgggtttcattacacaattgtaacagactgcatatgtactgcctcctgatgttagtcttccatcttctattggttactctacctttttttttgttgttgtggtaaaatatacataaggtaaaatctgccactactctgcactttttaatacttgttttactagcttatagtttttatgattttattctttctttacacttgttatattctttatgtacacaaggcaacttcatggtttgaaaaagggaaaagaatattaagctaaaaaaagcacattaaaaagatgttagctcaaaccatgccttatagaaagagactttgtgatgttgaggaaacctttctctttcccaggcagactctttgattatctgattagttgttggaggaaactaaggtggaggaaagtctttagagtataagcaggaaggatgatatagtagtcttcatctctgttcctatggatgcagattattttcttaagcaatcactcatggtagtctagctgcttgcctttttaagtaagcaaacaggtacttaaagctcctatcttggtgacacttacccctggaagtcagagtaaattatagggatatataaactctaaatgttgaactatttaaagctaaaattatgcttaaaaaatcaagtaaccaatgataggtgattgtgtatcgttggcattcagttaaaaagtgctataagtaactgaatacagagccagtcacatcacccattctgctaacatttagagtgtctactgtggacaggttccatgggcataaccataaagaacgcatggcttttattagaatgaagcttaaaatcttagagtggagtaggggaagagtggggacttgggataagttaagaatggaagagccttatcagtactggttataaaatgttcgatgtgatgcaaacatcagtgtaaga

SEQ ID NO: 130355 - DNA, 1021 bp, Homo sapiens
tgaagagatatgcaaactcctgccctgggttactgggaaggagctaaaatctttcatctaatttatactgatttacttttgcagcaatttaaagtctcagcaagatctcattttgggcccttcactcttctgccataactatattgtgactgagactatgaacagaagctaagagaatgctatattttctaaattcatattttggcagagtctacttggtagtttccggtggttagctcagattttcttttgtcctttgctgagaaagccaggtcatttgaatatccagagatgagatgtgtggatctactctaattggctttattctggctaggacagtggaggagcttaaatagggattttacttagattttgcactttaaaaaatggtttaaatccccaaccaggtctgctgagaacagacccagtccctgaggaaggagaagatgttgctgccacgatcagtgccacagagaccctctcggaagaggagcaggaagagctaagaagagaacttgcaaaggtaaagaaccattccttttgcaactttatttttgcacttaaaatgtactgtcatttgtgattctaaagtacatggtgatatgtttatagttagttccaggggagagaaagcatatgtgtttacttctccagcaggtcttgagtaggggagaggagatagaagagggtgacatcggttcgtttttatatgagaaaaaagtatatatgggtaaaatagatgtgaaaagtagagtgtgaagcaggaaatgaatgagaggagtagtagtgaatgtcttctaagggacttcactgacatctgatacacttgctcttcagtgcatcagtgactttgttctacccttggctgtgttgcagagatggccactttccaacttccttccgcctttccttccttccagctccctccttccctcccctcccttcccttccctaccctgccttccctcccctctctcccttccttccttcccctctctttcttccttcccctccctccctc

SEQ ID NO: 130356 - DNA, 1059 bp, Homo sapiens
cctttagaagcagttattccttcatacttaccagtatgagattgctttgaaggccaggagcaccatcagggaggcccttcctttattggcacaaggcagcagaaagccagaagcagcttagccatcctcccggctgggtccctcatctcatagccaatgctgggaactggttaaatgaccttctctgtaatttgccaaataagcaatcaggtttttccagaagttaattttttccttattaatgaagaacaggtcacattttgttcattttaagctgaaaaaatgggtaacctagaaaaaaacatggtaaaggtgacagcatgaaacttagttttaagtattttaggtttgtgtatttgccgacagtagggatgtgtgaagcagcattcctctcttggttgcacctggtagccatctttccccaaaagtggctgggatttccaggaacaggaaaatgttgaatataacagagaaggggtagagctggtctgtagaagttgggggcaggaggcagcagcttgatgtctgctgggggattctgattgccaggaaactttctccagtgctgaccttgccttgcccaagtggcccccctcagacctctgtaataaaggggcctgggctccccctttgcccagcccccttctaacttataaattttatgtataatttaataggggccacacagaatggggaagctagagcttgataatggactgaaactcaagtgacttgcgggggagggagggaacctttgagaagctggggctgtggttttgtgacttcaggtggaccttgatcggtgtgcaagcatccagattcccaggaagattgacactgcttgcttcttttagttcccttctacccttcttgtctcttggtttcacctcctttcattttccaagttatggtcatggctgccttgggatgttttctgtcaaaaccagggcagttgtagggttgggtgtacctctaggcagattctgaaagattatcttcacaattcctgttagctgttcgaaggaacctggggttgtgagatttaaaaaattattaaaa

SEQ ID NO: 130357 - DNA, 1083 bp, Homo sapiens
tttctccattatactgttactacacttgatctcagccaaaaggccaagaagtgatctccactcaatgtttttccttctggcagctagttaatctgtggagaggcactttaaacatcatttaaatatcatcttcttcctcaaaatttctcccgagctttagcatccagcgatgatttttgtctgaatctttacaaagatggtcagggtggcattcttctgtagttcttccttctctctatttattactttcttggactcttggattcctgtttttttcagtggtttataatccctgactgtccctaatttttttggcggcctgattgtcccatattggctagttggagccccttccagccagctgctgtatcaccatgacacgtctgcattccccaagtatctgcggcctgcctctcctggtggacagccacattgtctccctttgacgtgccctccaagtaaatattgtgtttcatagcttttaaatcagactgtcctttatatgtctttcaagtttgtggagaatttacactgacatatttgagtgatgagttaacaggcagacagaaacttaattttctttatagtcatttgtacctactaccatttccgtttgcaatgacatgagtcgtctccggttattaccctgcagtacatacgcactttactggctgcacctagttgacttctgaactgcccttgggctccctctgctggcatagtggtgcgtgagcacttttctggggtcatggaatggatttctctttctgcccattttctttcttttggtttgtggttttctctctcataaattattacacaaacatggaccatacaatacaaccttctttcaaacctgatttgtttgctaactgtatcagtacctttccatataaaattcataaatatttttatataattatgtcagtgtttccatatttttctattacctgaatgttctttttagcatttaaataatccatttttagtaggcatttgtattgcttttttccatttcaggtagcatctaaagtgaatgtcccttgcatgtatactattcatatgtgacttaataagtagagc

SEQ ID NO: 130358 - DNA, 1136 bp, Homo sapiens
atatatatatatatatatatatatatatatatatatatatatatatataaaattttcttttgtctagaacttagtcacatggccacatctaactgcaaaggagcctgggaggtgtagtctagctacctgcgtaagaataagaacaaattggcttggcgatttgttagcattcctggccatattaagtaagattattaaatcatacacattgttaacttgatctttcagagatgacatgacagtaattgtatggtttcatagatctggctgtgtttcaggagagcatttttccatcccatgctctctttccatctaaacgttaattatcttatccttttaacactgagagagcttcctggaataaataaaattatatgcctattttgataaatacctgtttgatagcgatgttttataaaactctgagaaaagtcaacaaggagccttcacagtgattaatacagcagttattatggtcagatgttaaaaaaaatctcatgtcttcagtcttgtgccaaaaggcaaagaaagttttgaagctttccacacactgatttggtttcaagataatgggctactattgagtttacatgtagcattggtcttctgctattgtctttataaaggaaagtatgtgaaatttggaattggaaatgtcatttcttaaccagagtagcaggttcagatggtgaagctatcacttttggcacaggactcttgtttcttaataaaatttaatgaaaaattgacaagatttgtgcagtgtatattttttttaatggttgacccactgaatgcatctaattagcttattacagtttaaaagcaagtttaactgcctaaatgtatgacttggtattttgatcttgtttgttaggtctcagcttgctgatgatagaagtttgtggtccaatattaattttaaataagtgcctactgttctctagaaactcccattcccttaaggaaaagtgtttcatatgagcctctcattgccaggaatagctgtgtaagcattgtggaagttttttccacattaaaatgtagtccaccagttcatttattccttttagggttgtgacagtcgcttgtgtttatgcacccctgtagagctgtctttaaactcattcagcaaa

SEQ ID NO: 130359 - DNA, 1055 bp, Homo sapiens
ccttcacgcccctagtttcccttattattaacaccttaaattcatatggtacatttgttacatttggttaatgctgagacattattattaactaaagtctgtagtttttattagtgttgtccagttcaatggattttgacagatgcataatatgtagccaccattgcagtatcatacagaatactttcactgccctaaaaatcaccagcaccccaacctagtcattcctgcttgcctccccctcagcccttggtaaccattgatctttttactgtctccataattttgtcttttccagaatgtcacatagttgagatcttacagtattttggcttttcagattggcttttgtcaataatatgcatttaaagtttctttgtgttttttcacagcttgctagttcatttctttttagtgctgaataatattccactgtctggatgtaccacagtttattatccattcacctactgaatgacatcttggtggtttcttgtttttggtgatcatgaataaagccactatgaccattcactacagggttttgtgtggtcataagttttcagctcatttgggtaaatacctgggagtgcaattgaaggatctgtgatatattcttggtcccagcatctctcctcctgctgacaattaccctccttattgtgacaacctaaccaggcctgcctctcccagggcttcctcttcttcacttagagcattttctgaacaagtctggacacaaaggtcttgcttatattttcaggaaagagtatttaaaatacttcttaatcatggttccaacttatttcaactcttataattaagtgatcattttttttttaaattatggtagaatatgtgtatataagatataatttgtgattttaaccatttttaagtatacagttcagttgtattcatcatattcacatcattgtgtaaccatcaccactatctgtttccaaaactcttacctggggatatgatcattttaaaagaggaatttgaagaaatacatctgaagctatatttggcaatatgtttccatcagtaac

SEQ ID NO: 130360 - DNA, 2462 bp, Homo sapiens
acctcagcctcccaaagtgctggcattacaggcgtgagcccccgcgcccagccacatttatatctcacagtttctgcaggtcagaaatctggggctggccaagaaagtggttctggctctgggtcttccatgaggtcgcagtagagttgttggctggggcatcagtcatctcagggctggaggatctgcttccaagcttacttgggtggtcattgacagcaggtgccagttcctcaccccagggacctctccataaggctgttcacaacgtggcttccctcagagcaaatgatgcaagagaaagagaacccaagagctgtattattctgttggtcacacagaccaaccctggtgccacgtggaaggggcctacccagaggtgtgaatgccagtgatattgggggtcatagagatgacccactgggtaatgagtaaggaaaggtacagggcgtctgtagctggaatttaggggattaggagtgatgtctgggaggtgaggctgatgtgtcgtgagttgcatggagtatgaatgtgatgtggaattaaccttcaaacagcttagtctagtagtggagttacattttgtatgtaactgtggaaagtgacacatgcacagagccacagatgatccacgtgttgctaacactgggtggtgtggttcatccatgcctcataatgtcatgattgatactctttctacacacacacacacacacacacacacacacacacgagttgtattgcccctgaaaatgctcctcttggtctgttcttcctgccggtatgacagaacttcctgagattgttgagtttagggttaaatcaaatctgaggtgacccactcgttagtttggtagtgtttccccatcgttttcctgttgctaagtggtgcaggagtagaagctggtgcaatagtttcctagagtgcggtgcagctaacccttttacgtacatcatattgtttagaatttgttaccaccttcaaccaattcatataaaaatagattacatgtgggagttgtatttgtttgtgtgtggtgtgcatccaagtcagtgttaattttaagtgagtgtcctgcactctgggtgtttttcgtagctacaaggaagccttaaccgttgttacttacaatggattacttttcaaaagttgtttaatctctttcaggtcattaatggcttggagactaataagcaaaaccattaaatactactttatgtctgaaaaaagagttaatgttcctggaaaaagcgagctgttttctttagttaacaaggtggagctggtgttcccagtggttccggttctaataagacttgatgagttggaaatgatgttattctggagacaactgtggagtaattagaattttacctcattttaattaaaagattctaactctaacctaccttcccaggcatttgggaaaggcacaggtaggtctccttgccagtgaggctccactactcacttgtggggttgacatcaggagaacccaggacttgggccttagtgaggtctcacgttctcaccactaaacaaagagaaagcatttatgcaggcatcgaaccagcgtctgtgtgtcacagctggactggtgctgaaaaaatcaccagggccttagcataaaacaaaggctgctttattatgttgagagcataaataggcttcttttcttttttcagtcagatatgaaattagagttgcttactgctaacatggagcctgctggattgagctgttttgctcacttctgccagataatcagaagagccgggtggggtcccctagctgggtgactgggagtcaggcatccatcccccgaacatcaggctccccatttgtaaatgtcttgtattcctgtcaagatggttaggaggattgaaaaacgccgttgtattttatttgattttgataatacacttaacatgagatctaacctcttaacaaatttttaagtgtataatgcagtattgttagctatagtgttcaagtgcattgggaggcgctatccaaatgcaaccccttccccgccctcacccccaccccccgtttattgctacttgttattttcatggttgtgctgaatttttccccaaggcaaatctttacctctgcccttgaagttgcatatgccccagagtgggtaattattaactgtattaatctggaccatatactgtacagtctttggataacctggacagtttataattttaaatgttttaaaagtttgcaagtctgaaactctgaaaaaattttttttttcataaaaatactagcctaggctgctgatggatgtgggtttctttttggggtatgaaaattagattgcggtgatgtttgcataactctgtgaatatactaaaaaccagtgaaccatactctttataaaaaaatagtggattttatagtatgcgaattatttctcaagctgctattagaaacaaaacactgtcct

SEQ ID NO: 130361 - DNA, 1171 bp, Homo sapiens
aagcttgttaaaacaagacctcacaccctcagagggcttgttaaaacagactgctgaccccacccacagagttctggttcagtaggtctgcggtgaggcctgagaatttgcatttttagcaagttcacaggtgatgctgatactgctggttcagggaccacatttgggaatgctatatagcatgggatttttttgtgtgtgccttttagaaaatcaaatgctgtcatgcttgtgtttctgtatttttcatcagctccatgtcatggagcactttctgtgctagtacatattgatcacttcattatttttaactgctacatagtgtacccacatataaatgtgccttaattctattaatggatacttgattctttccagtattttttgttaactattataaataaatcctgcattgaacatctttgtttattcctcctttatgcagctatgtttgtctagggtaatatggagaagtgaaattgatgaacatgtgcactttttgttctatttttgttttaatagataatgggaccatcactctatgatgctcaccacattaatgcccggccttaggtagtttgttttattctctgcctaagctgaggctaacctggagttgctaggaaaatcataaatgtgcttactagaccctttataaactgaacctgaaatgggctttgggctgctagccagtttttctaagtctttttgtagactaactaaaagcagtgatagtcaactgtttttttcccctaccagcacacctggtaaataagaattgcccttagcaacaatggctcacttaggtgaacttccaggggctatacatccaagtatatttttttgcacgacttcagtgctagacttttccaatctggatgttcttacctcatgttagattccgtgtatgtatagccaaatacagcattctttgtcccctctgccttctaaaccagtttgtcctgtttctgttctgcacagtgatgtgtgttaggtgagttgggctgtaggcagggcaagtgggtgttacgtcctagcattaccctttttaattttttggaattcataaattaaaattgggtgggggagagctcacactgagttgtctactccttgttttgccaagttattaaaatcaactaacaaaaagccaccatgtttttatagatat

SEQ ID NO: 130362 - DNA, 1205 bp, Homo sapiens
acacacacacacacacacacacacacttagccaggaatggtggtgcacttgtaatctcagttacttgggaggctgaggcaggaggatcacttgagcccgggaggttgaagcttcagtgagctgtgattgtgccactgttttccagccggggtgacaaaatgagaccttgtctcaaaaaaaaaaaatttagaagtggaaaatttgtaagttttaataaaataccacttactttttagctctggtttggaacctgacttacagcaatagtagggagattaataaggttacctcttaaggcagtctctcaaatgaaaattgagtatagttatcttatttttagatttatagatgtctctaaaccttattttaaagtgagttcctgactactcttgtggcgtttattttatctttacaagcattggcagtaatggttgatttcacttctgattatgaagttagtaggaaataaagtacagggggtgtggggggtgtgtgtgtgtgtgtgcgtgtgtgtgtgtatgtatgtgtgtgtgcacattttccaggccccactgtcttgaagaggcttgattagggattagaatggtagtggctagagggcctcactaaggtttgttccataggtctcagagctcccttttttgtcgcctttgccctgctgccctgctcaacaacccctgcaaatgtaaggatgatggtgggggctgggagctggggtggccgctgccacatgtagtgctaaagaatcaacaaaacaggacagcaaaagactatgcaaatagtttagctttctcaaacaaggtcttcattgttcattctttttcatcctttggtagctagctgtccttcctactagtgttgactgtttgtcatgtactctctccaccggagtcaccagtaagaccagctgaactctgttgagagttttggagtaaaattctgattggacgtggttttttgtgctttttgtgatcggcagtgtttcagtagctcttagttcccggaacctcattctcctatcccgtcagcgaggtctcccttatttttgctgagatgcatggttaaccatttccccaggctcctccctagcacctgcagtatcttaaaaatggtacttttaacttccaggagcaatacatgaacacaagagtatagataaagataggcaagagtgtagataaagagagttgtgcagagacttcatc

SEQ ID NO: 130363 - DNA, 1056 bp, Homo sapiens
agtgggtaatttataaaagaaagaggcttaattgactcatagttccacatggctggggaggcctcacaatcatggtggaaggcgaatgagaagcaaagtcatgtcttacatggcaacaggcaaggagagcgtgtgcaggggaacgggcctttataaaacctttataaaaccatcagatctcatgagacttactatcacaagaacagcattggaaaaatccgcccccatgatttaattacctcccactgggtccctcccacaacacacgggaattatgggagctgcaattcaagatgaaattcgggtggggacacagccaaactatatcacctatgtagtggcaaatctttttttttgtttggttttgttttaataattggatatttcttttatatgaggctgtaacaacactttttgcttcatcttctctgtgtaaataacttaagctttttaatggatacagctaaaaatttggccttgttaaaggaggaaaaaaataggctgaatagtgggaagtgagcagaactgtgtttgcttttaggttaaaaaaagaaatgatttttctctgtacaacagagaaacatggcccagaaagtggaatggcatacagctgtttctttgtagttcttcagtcttcaagcatgggcttttgcttgtatcaaaatataagtgggttatgatgacctcctagaatccaagagaataaagcttgaaattggagtaactgatgttccccaaaccccagagtgagaatgtgcttttatttagcattttctcttcagcaaaatctgaagagtgcttgttacagagagcaaaacttttacttgatcttttgtcagaaagttaaagaattaaaaaaaggctgttttagatattggctttaaaactgttgttttatgttgttatgtcaagggtgatgccacacactgttgacatcaaatccaccaaaatctcacttaaaaacaatttagggccaggtgtggtggctcttgcgtgtaatcccagcattttgggaggctgaggcaggaggattgcttgatcccaggagtttaagac

SEQ ID NO: 130364 - DNA, 1054 bp, Homo sapiens
ctttctgctgttgaagagtttgaaattcttagttcttttcaaccagttctatgtggaaagaaaggtattttatttgacagtgatactaacattgaaggagtgtttcctagggcctggctcccgccaagcatctatgggcagcaaatgccctgtttgtccctcacatcagccctgggcagatgtattttcccttttcctgttttactgatgagggagcttaaaatttagggagattaaggacctccccaagatcatagagtttatcaccaatattttactgactctccataatatagagagctcttatcttaaatgaattggttacagatgtaaatttgccaaaatggaggtgatttatttaataataccaagtctcaaatgttggaggttttaactttgaattattgacttaacctctagtagaatgttatgatgccagtgtagccaaaaaagaaaagagaaaaagtcttgcttttgttgattttaaaagtgcctgggacctaggaggggagagggcaatgatgagatgtggaaagtgctggaagggaagcattctgcttacccctgtccagccttcttgagggatcattgctccctttgaggaaatagtttttccttccaaggcaatatactctgcttattccaagggaagccaatggacagctcaccgtgcgggccccgtgtcttggaagcacctgtggtgccattaacttccttcagttcctggagcattgcagtcaaagcagctgtacttaatgtagttcgtattttcctgcacttgaagtaattctttatcattttttgcataagttatacataaccttagtggagaaacctgtgaaagcatagaagtaagacatttctttgtaataaaatcctagtaacctcagcactctcctcccacatttgttagtgcctaagagtcttcttttatttaatatacatataaattcagggtcaaatatgctatcagaaacaattctaatgaaggtaaaaactaattttattcacaaatgtttttgtgtaccctctctttctcccctccccagcacac

SEQ ID NO: 130365 - DNA, 1045 bp, Homo sapiens
tgtttgcatctccctcacccccattatccaccactctggcagtggtagataatgctgaaagatttgggttccatggatgggggtggggggtggagttgaggagaattgggttggggttgaagaggagtggggtggggaggaggagaatgggagggctggtacaatggattgcaggcctgtgggaatgggggaatggtaaagggaaggcaaccggaaagggaaactgctctttggagaagtcatgggtgttttaaagggaaatttggattaagtgatgggaatttgcttggctattcccaagcaaatattcccaagcaaatagactatagatattaaatttgaatgtcgtttttagttcctcagtagagaggatgagtagtttggcatttgtgtgtgtttgtaaaatgagagcagaaactagaggcatgggagaataactggatttgctatgcctgtggatgccactggttttagttaagatgcttttaatgcaaaatgtattttaatagtgatatcgtagagtttgaccttcaagaagctcaagtctgtaagcaataattcactttaatgtgtaagagccttgcagagaataagaacatattaaatatttgcagaatgaaagtattatactttccctgggtggtatgatagccagagaagcagtttagtctagaggtgacatttgggtgaaattgtagtaatgctgtgattttagaattttaaccagtgatttctaagggccaacctgaagcttgttttcatcgtggagtgccttggctatgggactgatttgtgcagcttctagatttgttaactattctcgctcgggtttttttgagaaatgattttcattccagaacagcagttcctcgacctgagagtcggtcagtgcttttcttcaggtcattgttgagggggaaacctatcggccaagcctgcctctcctggtgactttatagtgctgtgactttatagtgactttacactgctgattgtgtcagggattcaatgaaaatcctgactgatggtaaagagggcatggcag

SEQ ID NO: 130366 - DNA, 1097 bp, Homo sapiens
ctacattttctaatcagtttatagggctaggaacatctcatactttttaaagaaatgttttctttccaaataattgaaacaaaattggaatcggaagtaacagagcttcagctttgcattacaattaagttttccagctggggttttactgggtcatttttagtaatacaactactgtggttaccagcaacaacatttattgttttctgtatgtcaggttctgtctaaatgcttttcatgttttatttttgaaaaatttcagaacataccctatgagcagatgctaacagtatccctacgttacaaatgaaacagggcatgaagggacagagtaataactttttcaggggcacacagcttggcgcagacaggtctgggattttgatctgtgatgtctggctagagagtacgtgtccttacccagcctatacctatactacataaaagttgcagacaatcttccttttccttgcaaaggtgttgttcaaaagcacagtacagctgtggtaggagccatggaaaggagcaccaagcagtgtatctataccagagtctggccagtgtgtctgatcttatgcatcagaattgattgtaaattagttcagaatactgaacctgaagtcatatcgaggttcaaaatttggcttcatcattttctggttgtgagacattggataagtcactaaacttctctaaggctgatatctcacatatgcatgaaaattaggtacaaatctgttactagtactggtgctcaatagatactgatttttgaaactgaatattagatacttctgtaaaatgctaactcagtggttcccagtttaaacgaaacattttatttctttagagacaagtgtgatattggacatagtgctcaataagtacttcataaacacattttcgatgcggttctattgaagttagttatttacttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgcc

SEQ ID NO: 130367 - DNA, 1222 bp, Homo sapiens
gaacatcaaatgatttaaaatacgttaaattgcatcatgcctttcaagagtttccaagcattaagctcagcgcagcacatttactgtgtgtggtatttcctactttgatagagcagtgttgctaactagagcatacattgtgtagaaaaccctcctgactaccttttatggagctgaataaatatgtatacttgagtgctctcatgttagtcataacctttagtttagcactgttatatagaagtgacagtcacgtagcccactacacattatactagtttgaatttaaacaaagcaaaacaactttataattttaaggggaagaggaatggttcctgaggccaaaaaactagagaggaaaggcttcaaaaaaagaataacacaataatatgtcactatcattttaacattgtaattgtgccttagaaataaataacagaaatgtggggtatcatttatttaaaaataaagcaaatgtagagaataatggataataattttgagggtctactcccaagtctctgggtgtgacccaccccatccaggctgttaatttatttggtcaacagtttcgtgatttccatatggtgctgatgtctttgttagctcttcttcacttcctgcatttatttttatgtggcaggctgcctagtccctaggggaatagctgagtggtaggaggggttgtgatcttttagcaagatttcaaaacagaataatgtatgcatgtaataaaaacaaatacgctcactcacagtgcaaaaccaaaaagaacacccaaatccctggaacttctgtgctactaagtcttttgttgtaggctaagattattttccttttggggttaattatttctgccttaattattgactgttgtgaaatctctcttctgagacattcccaaattttatttaaactagtgggtaccagctgtactgaaaccataattttagccatgtatttttattagaaaaatgtttccaggggattaaggaattttaatatttagtggaagttttaaaaaagaatgtaaaaatgccttttggaacctaagaatagttgtctattttagaaaaatcagaaatattgatggagaaaaaagaaaattacccataatcctgtgcgagaatgagaaatcatagttagcatattaatttatacctgttcatgtatctatgctttaaacaaatcacaattttattattattttttttaacagtgt

SEQ ID NO: 130368 - DNA, 1173 bp, Homo sapiens
ggttcaagtgattctcctgcctcagcctcccaagtagctgggattacaggtgtgcgccaccacagcccggctaattttgtatttttagtagagacagaggtttctccatgttgaccaggctggtctccaagtcctgacctcaggtgatccacccgcctcagcctcccaaagtgctgggattacaggtgtgagccactgggccaggcctgtactttactttcatttacttgtaagatagactctttggagtctttcagctctttcctcgctccccttcagattaatttcagacttaacacaagtgcttacaaacattacatacaatatgctttatatgtgttacctatgtgtatatatatattatacattacctgtataacgtatatatacacatacatattattatctaaattttaagcttcttgaggttagaaacatttcatctttggttgtcctgagtgggataacatgatgacttgtacatagtagacatgcaaatgtttgagttagaaagcttgtcacatgtcttgtatatattgttagccggcttaggggccaccatgtaagtcagcattatgtctgtctggctttcaatgggggcgacgcaggacgggggagacatgacgacaaacgtgcccatgtgtatttgtatactaatctgttacacactgtcgtttgacataatgatgtttttagaataactatgtttggtacttgtcaaagtaaattaaacggctgtgttttacttacgtgagtggagtaactagttttagtagtgtttgtgttctagcttgggtggtaagaatcaacagtcattggtagcactgcagtattccaacttcttgtgtagtttttataggactagtttaagtgtctaattctaagacatatttttttcaaatctttatcttgtaagatgagtcttttcgtgtctataattttcccatatgttctttgggtgaggtggaggactctgctccgaatgaaagaagaggcactgccttgggagggtcagttcatttactccaaagctttgctgtgttagaacaacgtggccaaggctgggtgcggtggctcacacctgtaatcccagcactttgggaagctgaggcaggcagatcacttgaggccaggagtttgacccctgtccaacaaggtggaaccctgtctcta

SEQ ID NO: 130369 - DNA, 1035 bp, Homo sapiens
gcggagcgcacaggtcgaccgggtcaggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtgagggcgcggacccagcgggcttgggctcgggcttggactcgggcttggactcgggctttggctcggcgcggggctgagcgcggcccggcggctcgagcaggtgccgagcctcctgggccggcgccgcaagttgcatctcccggatccggatctggcatcctggggccctggaaggagcggctctggcgggggcagatgggactgcatgtgtgagtgtgagtgtgcgtgtgtgggggagagggagagaaggttctgggaggtggcgaaggggctagcgtcaggggctggcggccgtgatgcgctttgggtggaaagccgcgtgaagggagcacggcgcagccagctcctgtaagtgactggaaccaggaacagaggacagtgagtcgctctcgtccctccaggtgggaaacccctctctccctcataaattaagactttctgccttcttctaagttcaggtggttaggatttttggtggcgtatgacccatggggggtttgggaggcagatatttatcatactagaaacccccagattgtggagtggtgtctgtgggtttgagggaagagagcttttcgtaggaagggtgaaatcccacaacacaaaaccttcagtctaatttaccatagcgttgggtgcacttgcttctgaaaacagctcaagtgaaattacccccaaatagagcaatagtaggccatggttttcagatttaaatagtttcatcctagagatctctgctgatcataagcctgtgactgtacgcagatgtgtgtggcacgcttttaa

SEQ ID NO: 130370 - DNA, 1030 bp, Homo sapiens
ctacagcattattcaagagaagttttcatggaaatttatgaacatctattgaggatcattagtctagcttggtaagatcagaaaaaaattcctgaaactggagaggagaggatgaccacaggaaaaaagtgggagtgttctaggagaagtgaagagtacagagaccataaaaatcacagagacataaacacatgagtgcaaagtgaaatcatcttggaattaacatttggggagtgacagatgatattggataaacggggccaaatgatggagaaaaagtaagtggtgggaacccattgaaagattttaagcaaagaagtgacatgattagactgctttttagatagaaaggttcccgccatcatataagccagagaacagaattgaagactagagagacaggggtatcagttacgatgttattgcaatagaacaggaagagatgaaagcttaaagtccagcaggcatttagagaatagtctggattggagatatttagatatatatttgggaattatcagtttataagaggttaagtaaaatcagagtaagtaaagtgaactatggagaccatgcaacatgagaagagatagagaacttagaattttgtgatggccaggtgcagtggctcatgcctgtagtcctagcactttgggaggctgaggcaggcagatcacttgagcccaggagttcgagaccagcctggccaacatggtgaaacctcatctctactaaaaatacaaaaattagccaggcatggtggcacatgcctgtaatcccagatacttggaaggctgaggtaagagaattgcttaaacctgggaggcggaggttgcagggagttgagattgcgtcactgcactctagcctgggcaacagagcaagactctgtctcaaaaaaaaagaaaaagaaaaagaaaaagaattccatgagacagcatcatttgaggagcaggtacaagaaggggatcctgaggagatctcacatctgataatcctcattttcaaaagttcctttttatatatccat

SEQ ID NO: 130371 - DNA, 1111 bp, Homo sapiens
aaaaaaaacctcaaaaccattttcctgggtgaagacatcgttccagttgagaggtgcgggaagcttaggcgtgggggtttagaaagcctgggaacaagttttataaaagttctgtatgtgttgtggggggaaggggatggaatgacaattgtcgtggcgctggattttcttttttatgactcatttcttatcagattgaatcaaaaagaaagtgaggttgaaggttttaacctaaaaggctgactttgcggtaaaaaaattttattagctgtgattttagagaagctggtctatgctcacagacgtttagtgtgctggtcgaagtcaaatcgggcaactctttgaagaatggattaaacagtttacctttaaggctacccctttcaggaaaacgtccagccgaaaaaattctttatatgaaatcaaaataatgtcaagtatgagagcagtatgtaaatgtagagaatgctatttggaattccttgctcttgtgaataattttactaaattaatctctgttgaactttcttactacggcttggttttggtaaattattgtagtttttacttgtttacttttactcagatttttgtgctgagatttctttttgtactgttccttttcagaaagatttttaaatgcagtttccaataagtactttaagcttagcattagaaatgtttaatgtgtagttatttgtatcaagtagtggatttggattggtagggaatttatttaccaaacaccgtgaaagtgcttacaaaacaagtaagctgtattttagttcttagtccttgttttaacatttccagtctaaagatagtaagccttactattttgataatctgtgttcaagccaaacagatgttgatcagtcctcctttttgactttaaggcaacctgtggtggtggatggaattcattctttcgtattggttagccagtcgttgattttataaagttagctcttagtattctgtttattggaatgattctgccgttcagcacacttaccctggggttaattaggcgcaccagtaaccccacagacacagcacccatgtttctcagaagttagggctttaactttaaagcacagggtgatccccc

SEQ ID NO: 130372 - DNA, 1044 bp, Homo sapiens
gtggtttcttttttttttttttttgaagggcatatttaatagctgctgcaaacatatggaatagtgctttaatcagtggtgaacaagaaattgctgttgttggttataaaaacaagggacattaatgttcttgttcttgtaccatagtaatgagaaaaaaaaatagtggttgaatggtgtttaatttgtacagtttgtgtcaaagtagaatgggcagatattttggtggataggcttttgtcttagttataaaaattaggacatttggtatgataaaggcagagaatcttaacaattggcactggcccagaaaattcagggtgcagtgaccatagcgtgttatgactgctacagtaggcatagccacctcctgaagtgttttcaactgcttgatatacggactttaggcagttcttgacttgtacatgctaattcactgcttccacaaacagttcatagatatatgctgccagatatttagtgttgaaaacttttgcttcttccaaatattcatacaatattcatgcttttactataatatatagtagattgaacactgaaccaaatgagcttgggttcaggtacagcttgtgtaacaaagcttttagtgttgggcctgtatcaaagcaagattcttcccccttatttgtaatttctatagagagcataggcaaattaataaaatttactcagtctcaaaagggaaaccaagtaaacagaatgatgcttttgtggaaagttacactgtccaagtaattgttacaggtgtttttagtatcattctttacattttcacacaagtcctaaattgttcattcctctttgctacatgatacgaaatttcacaacatactggttttttttttcttttaaccaaatatttgcagtaatccaatacaacatactggtttaatacaagagcttaggttaaataagtctcattattaccttatttcctttctccagttccccaaaaacaaaaataagggtattactcatgaatggacttgttttgattcctctatccgtgacttaacagttttt

SEQ ID NO: 130373 - DNA, 1657 bp, Homo sapiens
gtttgattttaatgtttgccaagacttaaaatttacctttttattaatggtagatagggtgatatgcctagcataaaatataacttggatattttaagttcaatcgggggagactgttgcttttctatagagataaagcaaacatttaattcctataagagaaagtttcttttcttaagaaaataattgctctttttaattttaattttaagaaattctcaattcatgttcttagcttatatttgaaacatataacatgatgaatgttatttttaaaatgaaaccctgctgatcttcagtcagatgtgtttgatttttttcttttttaataatagcagtgggttgcaccaccactgttcactccatttcttgattactcacaaattaatatatttgattatcgctttttaaaaacttgataattgttttccttggtttgggagtttttaaaaaagtcaataaagtttaatattaatgttttttatccaattacaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccaggtaaatattatctatacaaggatacttccttgttcatcctaattctagttggatataatcttgaagtatatttttaattgaattattttagttataaagtaatactaaagttgtttacaaaagaagggggaacgtcattcaaatgcataacatatttggtatattttctttgtcttttttcaacacatatatatgtgggtttatcaaaagatgtattaatagccaggtattgcatatattgtcaaggaacgtggactctgctgcatgtacggg

SEQ ID NO: 130374 - DNA, 1002 bp, Homo sapiens
gttcttctgttattttttgtttatttatttttttgagtcggagtctcactctatagcccaggctggagtctcactgcaaactccgcctcccaggttcaaacgattctcctgcctcagcctcctgagtagctgggactgcaggtgcgtgccaccacacccagctaattttgtatttttagtagagatggggtttcaccatgttgtccaggctggtatggaacccctgacctcaggtgatctgcttgcctcggcctcccaaagtgctgggattacagacatgagccaccacacctggcctagagcaggtactgttctgttctcaccatagaagctattttgtttgtccactgtcacctgattttcattcacctttgcattcattgcaaagcctctgaggcctttctcttcaatatatttctctccaaaagttccgtaggaatcttagagaatcacatttacagtgggaatttttttaaaacgagaagaccattgttaagtctttagtttaatctggctgtgcatatctttatttgaagaagctcagtgggtttgaggtttcctatgcatgcctgaggcttgtccaccactgtcatacattatttaatgcttgtttttttcacttcaaagcactgtaactgttcagtgtctgatttatacgatggtggtcatctgaggatggagtattttctgttaaaggaatcactgtttttagttgccagagggcaaaatgccatagtaatcctgtgaaatgttcctctggctttttagatttgggttagctttcagtgataggaattttgtgtatgtatgtgtgtgtgtgtgtgtgaaatttttactgtgtgaaaaatcaagtgtgtatatataacgaatactatatatctttttccttgtactttatatcaagttttaacaataaaatccctgagacaatttagttaaatgaagtattaagggtagatagactccttagctagcactttgttttgtcttaatgtagaagac

SEQ ID NO: 130375 - DNA, 1053 bp, Homo sapiens
agagacagagtctccctgtgtcaccaaggctggagtgcagttgcatgattttggctcactgaaacctccgcctcccagattcaagcgttctcctgcctcagcttcccaggtagctgggactactggcgtgcaccactgcacccagctaatttttgtattttgtatttttagtagagggtttcactatatgttggccaggctggtctcaaaaactcctgaccacaagtgatctgcccactttggcctcccaaagtgctgggaatacaggcgtgagccactgcgctctgcctggaatagtataatttaaacctaacctaattcctctaatctacctgataacccttcaaatgttagacgtttaaagagtcctgtttttgtaggctatgtgctcttctgcccatcttgtgatgaatacacacaatttactctttccaggcaagttctgaccaatatagaacatagcctgtgtttaccaacgttaaggccttcccaaggtcattcagctagtaagagtagaaagaggcaggttgcatatttaggactatgctgcatgaaaaccttgaaattaactactaaagtagtagattcctatcttttttaaaaaattagttccttttaactttaaaatatttttatgatccccttcatcattagttatgctttaatttccatttattgagaaaacagttgtccatgaaataaatgcttttaaataaatttgaagttctatagcaaacatctgaaaagtcttagtgaattgttcaatctgcaaacaatgcttggcatgtttggatttggcgggggtctcttctagttactgtgtcttccctcaggtcttcagcacagagtttgtaagatacagttctaataacgctgtcttgtataatgttgaagcttttgtttgggtgccttttaaagattgagataagaaggtgtacccatagctgcagggtttttattcagatggtatttttttatcttgaaattaacatatttgttgtttgactcactacagagtcatatttgttgtttgacttcacttcagatcatttc

SEQ ID NO: 130376 - DNA, 3990 bp, Homo sapiens
cattgtagctatgtagccaaatacagacgaacactaaaaaggcacttgctcattcacacaggagtgagatcatttagctgtgatatttgtggaaaactgtttactcgaagagaacatgtaaaaagacattccctggtaagtaactttaaatacagctgatctttgagataaactatatttatgtcagtgaagtttaaagggatttaaacagttaattgtgaatttaaggaagattgtctcctaaattgctttaaacagtttgactttatgaactgatagtgagctttttacagagaaactggtgtattcactcactattaaatgtgtggtttaatttgagtggttcaaatgcattctattatatataatatccttatattggattttttccccctccaattaggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagcttgttatgcaatataagtgaaatatcaggtttttacccgtgtcccttttatcatgaaaattaacacaaaatgtgcattctcttttgtttcatacttagcgggatattgattgttttgaaattatgatcaatacttaatttatttttttctgtccttgaagtcactacaccttgatacagtctttctagtagtcaccatgattcaacagtctcaaaaatcttacaaataaaattctgagaagctttattattctataaattcttcagggtacaaagggtgacatattgaggtgaaattgtcagatttacttagcctggtgacatgaattagctgattgtggaactctcagcagcatttcacgtattgttaacatgtatggcatttattagcatattgtatattatataagattgagggatgtcatattttcagctttcttttaaataaaaattgagtatattttcctattttatatcaggtaactaaattatgctagttatgtggaaaaaattgcaaagatgctttgacagatataatccctttggtgctccatctgatcaaagttgaaaagttgatgttttttaagagacaagctttatcattgtctctgatttcagtagaataatggtttattgttagacaatgatgtttctgcttggataaatcaaagataaattacagttacatggttagatgcatcttttgtcatctatattgtagtttctacataactgtaaacctgacagataagaatagtttcggtttgatttttgtttaaaacagatgagtacttcttaatgttctagacaaatgagtaaaatgtatttctggtagaaattagttgggcaaagatactatgaatgaaaaagtattttaaacgtaaaatgttctttgtgaatatgtaagtatagtataaagatttctttcatcccatttatccccttcctttaaataaactagtttacaattggtagatctgtctatatataaatatatattaaagaacaaagatatatatctaaaaatcacctaaatctgctttattagactacagttcacttattgcatagaaactggacttggctttacattcttaatgtacttttacttttcctcaagatatgaacttactctcttgaagctgaattttcttttactacttaaatcatttatgtatatctggtaaattatgaccaaatttttgttagattgcatacagtaaattgaaatacacacttggtacactacgggattgttgtgcttttgtttggttttagttggaaataaggtttgatgtagatggcttgttactgttaatttaaaatattctataattgtccattactttatgttgtgttgtgacagatttggctatatttttagtcaattgaaatatgatactttaaaagtttgtttttaggtaatccaaaggaaaagtgtttatactcttgaatatattagcctcagcctatataaaaatttctttgaagtaaacattttaccggaaacagaattgacagatttttctacttgctgactgcctaacttattttgtttcatgatctcgagggactgccttttcccatctagatcttttaaaaaaatagttttagtactaaggtatactactggacatttctatttttttaagtgtattctttttctgacttacagtaaaatttcaggaagttgatagatactaagaacttatgattggtctcagaggtaacaatgaaatactcataattttgtctgtggaactctggcagaattatgttacacatttggcgaagttgtctcttgtaatttatattttaaatgaaaaagtattttagagcttttaatgaaggggaagagtataaactttctttcatattcactctgtagttacagaccgtctcataaatcaagattgtgcattattagagttctcagagacagatacttccatatggacccctgttcatttttcttatttactagatattttgctaaatttagcacactagcaattaagagtttaaaaaagaagaaacgttataggaaagggaaactgaacagtaatgagtagctttgaaattggggaaaacacactagctgggttaggtacagctatcctaatggagaagagtgagctaaatgcgttaattcatgtaaagtgcttagaacactggtacataataggtgcataacacatcttaaagttgtttaataatagataagaaccaagaggaaaaagaaataagaaaagatgggggaaaggaaggagaaaatagga

SEQ ID NO: 130377 - DNA, 1192 bp, Homo sapiens
ctgtgacagagctcgaatttgaccacgtctgattctgaagcccatactctttcagggaggctctattgctgcctcattaaacaactcttgtagaatttcagctcttaatggagtctatggattatatttttcctataagacagctgtgtttagaattttgagtgtctttcctccccccaataaatttccttactactctttcttcataaagcagttgttttgtcactttgactatattaagacacatcagtgtagcacatgctcttaactggctgtggcattttaattttataaaagaatggtttttatctgaagaactagatagaaaccccagtttttgtgccgttcagtcacccagatccttaaacttaactatggtacataatatccacacttagaactaacaggtgtttagtcactttaggacttaaaatggaaagtttttttttttttcctgctgtatctctgctttcaactgaagttaaagaattctagatagtttaaaatgtgttagggataagcacacttcaaaagatgttttctagccctaaattttatgacattgggtacttaaatttggagtacactagctattgagaacaatattttgggttgaggagagatggttgaggccattatttagtgggagcattggcattttgaacactgtaaacaaaagaacacttccgcctgctgtttgtaaaagctctttgggaagatcttttacgaagaccaactttttaaaatgtaaattacctacctaatataagtgtcctaagacatgtatgtaaacttccggaactgttttgtctgtgtatttagaaaatacacaagaatctttattcaaacctaaaaatataaacttgtgagcactaaactgcttctggctttgtgaattttattgactgacatttaattcagatttctttgcaagtgtactaatttagactaattggggtaaggggaacaccttaatgaactttgacttatgtataattcagatatctttgtacttaaggcttacaagtttgaattatggaatactataagggttttttgtttatttgtatgtttttatatgaaagtacataaatgacagactacctccaagtaatcctgctttaattaatagcagtgatttgtaatcagtgtatcttttaagattctctacaggttttagaaaatattaaaa

SEQ ID NO: 130378 - DNA, 1046 bp, Homo sapiens
gtcaccatcccctactgtatagaccagttttaatgataaagctatcctctgactttccaccgctcttaacttcatgtcagaaccggcagtggttttaggccaatccccatctctgcagctggtaggaagttattccaagtgcccacagatttattcctttatttatcatgtccccagacaggaggctgctgaaccatgattctgagctcacgtgtgtcagaaggatgccaaaaatggtgttcatatgaagcagaacctcttagactttcctgtaactcaactttaggaagaaaactgcatttcagggtttggtggcggtgcattttacagtctttttgttttaaggtgtgataatactccaatgattgtgtgaaatatcatctctcttaaaacaatcatgtattatataatgtctgtctgtgaaacaaattattttttaattcattaaaattaacacaaaatatacccacgtaaacctaatgaactgccattttgttctggagggacaatataagctaaaaattaaacttcacaggctcatttattgttacacatgaatggagcctgggcatagtgactcatgcctataatcctagtgctttggcagcccaaggcaggaggttcacttgagcctaggtgttcaagaccaggctacacaacacagggagaccccatctctacagaagaaaattagccaggcatagtagcacacacctgtagtcctagctactcaggaggctgagacaagaaggttgtttcagcccgggagtttgagtctgcagtgagccaggatcctagatgcagagtgagatcctgtctctaaaataataaaaaaaaatttaaaaattacttgagcactcaccaagcactttgctgggcctggagatatcttgatgaatacagtgccatctcctccttggaactgcttataggttaatacttagatgttcttagtaatgtactaatgccaagattagtccatttcctccttacacagttactcagccatgcttgagtttgcctgctgctccctacttcataatttc

SEQ ID NO: 130379 - DNA, 1034 bp, Homo sapiens
agaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcacttta

SEQ ID NO: 130380 - DNA, 1083 bp, Homo sapiens
agcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaa

SEQ ID NO: 130381 - DNA, 1049 bp, Homo sapiens
ttaaaatcaacattacccacctccaaggccaacccagagtagtcttgaacctgagtcagcctcagtattgcttgcaaggaagagggaaggggctcattaaaggcctggctcaaaccttagtcttccagactgactagggacgtaagaagacccagggacccaccatgttctcaaaccatctattcagtccaggcctttcagcatagacataaagagcccacccgttactcagtcatgttgccaagtgcaaactgatttatccccagatgaatccctttactgtagcagatccctaatccctaaatttcagccaatttggtagttaattataggagtttattagctaaatgtatgttctgagtaaaagttttgactctttggggaaaatttattttgctgctagcatacaacatttgctatgtatataaacttaagtcaatgccagaaattttaaaaccagctcaaatttataatctgtaatgatcaaatcaaaacatactgtaaactcagagttggaaacgcctggtaatatggttaagtcatgtttaaatatgaatgcaatttaaatgacattggcaatgcctgagatttctttcattgtgaatgattaaaaggcagtccaatatatgaatggatttcatcttacctttctcccgttaatttactaggtgtaacatcttgagtgtaaagtcattcacaggcagttgggttgtggagctagaaggagcctcaaaaaaaaactttttggccagactcctacatcatgaacagggtttttgatgaataatatttattattatgtttctaaagtaatacagtgttggagaatgaaacagtttagtcctttcctcttctgatggaaaagaatcatagcgccgttgccatgacaataacaggatgtagaaagacccatgaagaaagaaagaagaaagctatggttccgaaagcaggtaaccacagattttgaaaggaggcagagatggtgattaaactgtagtccttgttttttaaaatgttctttcatgttaggcaccaccacatagttaata

SEQ ID NO: 130382 - DNA, 1009 bp, Homo sapiens
gcaaagaggaacacaagaatggtggagaccaggttgaactgcagaacacatgccctctttgaaggggtgcccacactcagctctagacaatcagaaccatgcagaaatcaggcccagggctgctagatcttctgacgtggaagtatgatattacctgacacgtaagtgttgacaactaactcaaactcttggccaacactgtgcagaccaaagagaagctgtacacagacaggtgcagcctgcagcccccagtttcaactattgggaaaagtggatttcacattccacagttgtcaggtcaggttcatccatcagccccacaaactcacatgtcggcactatctgggcaactaaaataaaagaggggaaagagatcatttctccccagatatcattctcatggcagacttgaatatagatacgctgagttatccagctctctcactctgcctccttttggcatgcccaggctgtgccccgtaaagtgttgaatcactgttatcctaattttcttagtgttttctaccgtggccactgtgatgaggggctggcaaagagcagcctcgtgccttccgagaaggctgccaggagcctctgaagcttgaagcgagcacacattgcctccttgtgccaaagcccttggccagcctccccacactccttccctctccatccggcctcatgagtcttcgttaccaagtaaaattaccactgcttcacctctgatacagcagaagccttgcttcagaactggtaggcatttaggctatttcagagtgtccactaacctcaaaaggaggtttttccacatacaaaaccctagcatctttgaggggaaagcaaaatgagaataaattatgtcatgaaaaaaattagaagttgcttccttcatttagatggactaagttattttaaactctatcttacatcagagtcctgatggtgttgggatagtcactgaccctttcacgtatgtaataagatacgtctcgttcacacactatttcat

SEQ ID NO: 130383 - DNA, 2729 bp, Homo sapiens
gaggactgggcagactgctcccacagcaggctggcagtggaactggagccctggccaccgcagggagctcagaggccaatctacgcaaaaggcatgcaaaacaatggattctggtcccaaaatatttctaagtaaggcatgatgtagccttttgattttttttttatcctttgacaccccagccttcagaaaaggtttttcatctctctccaaagaagtcatttcatagtgactgacaggacattctccagagagcgacaaagcagagtggccagcaggcagtggtgttaagccttgggccttcccagcagatgtgtgctgcattggtgggtgggaggcagtgtgacagcctggagaaaacacacaggtagcaagggagtcaggggggaggtacaagagggctgtggacacctggctcttgctcatcttcttggtgctgatcagctggtggtcaccatccctaagtacctcccagggagctgccattttctcctctgggagcagctgcctgaagcaaggagagaatgacctgaagggaagtacctccggccaagagtgcagggctgctgtgcctagcctgagcgggccatctctagcagatatggacttctctccaccacactagctgaaaagttttctcccttggttggcaaaagccagtgtcaggaaaaaagctgtgggtttctgaccaagaatgtgtgcgcttagctgcaaagtgcctgtcagcagctccaggcaccaacaaggtgcccttttattagacaattcctgcccgaacataaccatattgcagatgaaaattttcaatagagaatgacacaattcttgacctttctaaaaacttttcaaagagatagtcacatgtgtatatgttgcaaaagatttttgaaactgaaatgtcctccattaaatctcaagagcactcgagttttaagtctgctgtttctggtgtcacactaagacacacttttgaaagcagccctgggttctgaattagttggcactgctgaatccatgttcccccttcatcagactccaaagtgcagcattcacttgcaaaggttgagagaaaagtggccagaattgtacatataacagagaataccttgagaatagtagcaaaatactgtaaataatattcatttcctcagggaaaaataaagggcatgcaaaaataggtctggagactcctgaaactaggaagaattttgttatcactaaagtcttttatagtcagaacaatttttttttcaaatgaacatggtatcatttcaagacaaatttatgtgaactgggcagtactgacatttgtgaggcataggggagtgccctgggaaaacggtttggagctgacctgtagcctaaggctaacatttgaaccacaggtgcaatgcctgggggtgggggagggggacggggtgggggtggtattcctagactcacgtaaggctttttctgaatgtaattgtgaatacaaagccttgctggtcctttttatcattacccaatggatgactgtttattagctatcagcagaattccgtaggcgaaagcaagccgtgaacgatgtacattttgctttaatagcatgttagcgaacaaacttccatggacttttgtggacaaggtgctgctttttctcatgaccctgtagaattgctatcgaccacatcttctgtagcactgacctgtgtgaactcagggaagaatttgtgcatacaaatgagtggaaacagagcaggattcatgaatatgaatgagaatgtgaatcattttggagaatgccctgggcacacgggtcaactggaaatttcatttctctaagaaagtagccctaccagcggcacggactgttcctgttcctcatacctgtggggattcctccatattggaactgtttcatgtatcttttttgcattgtaactagccaaacctgaagtcagtaaataaaatgagattagcactttttttaggtaccagttgtatcactgagtaatgcacaccaatagagcaagaaagtataaaatgtatttaagaccaactggtttgcttattatgactgactttgaaaaagcccatatccaatgatatacatgctttaaaaggtatatctatcgtaggaccaggaaccaaaatgggaattttacttctggtcctgttttgtaaatagttcctttttttgaagacaatctcatgttttataacttttgttgtgggtctgagaatcacaatggtaatatgtcttggcaaaacataacctttaaatacaaaaacaattataacttaattttccaaataaaacaagaaatacactgattaggcttctacagttctaagagacatgacactttggtaataagcgtcagtactctacttctcaagttaactggaaatattttacaagatgcagtgttttgtaatcacaaagaacgcagacattttgtgagaaatgaccttggttttatacattgtagcttattttttaaaatatagtattttaccaggcaggaagtattaatattataagtaattcttgctcaccaaacaaagggctatgtctcttttaagcaaatgttttgatgcatatctttttaattaaccctctgcagcaagggtagaaatacagatcagatggaatgggtattataggagaatcaagatagcaacagctactccttttaccattactagtgtgttttcaaagtatggaaaaagatgcctgaagagtc

SEQ ID NO: 130384 - DNA, 2850 bp, Homo sapiens
tagcaaattttaacagttgagtgtagtggctgtgaaaacaaccagcacatattagagtctgaacctagagagaagtcgctgtctcccaggctggagtgcagcgcgatcttggctcactgcaaactccacctcccgggttcaagtgattctcctgcctcagcctcctgagtagctgggattacaggtacatgcctggctaatttttgtgtgttttaagtagagacagagtttcaccatgttgacaggctggtctcaaactcctgacctctggtgatccgcccacctcagcctcccaaagtgctgggattacaggcatgagccaccatggccagccttttttttttttttttcctccctcactcttgcaagggatttttgagctctccatagaatgcccattgaattcctcccactaaactaaccttcctcgtctgtcttacaggaagcccaggggagagggcaaaaagtgtcggaaggtgtacgggatggagaaccgagacatgtggtgtaccgcctgccgctggaagaaggcctgccagaggttcctcgactgagagacccccaggcagaggggctcagggccctgagccgctcctgccctggcctgccactgcaggtgttggaaagagcttttcctactgaataaaacacagttgaagccaggaaaagccctttcaggaaccttggaggaataacagcaaaaacacagaaaaattgtttaagtcaccacctatgacaaaagaaagttgctcttactgagaacccagcttggagcagctataactagttttttttccttcaaaagaaaagtcaactttttttgctgtatgtctagacttaaaactgtggacttctgtagcaattgaaccaacaaagcccattttacctagaaaggaggcatattttgataagctttctgaattatgccattttcaagatttttttgacacttaaaaaacaagctacaggttattcagtagcatttgtacaaagatcaatacttacttttgttgtgaataatcttttccgtatcttccatttgacttcttggagcagtatatgtcaggatgtgttgcaagacagcgcagcactctgggcatcttttctatggctttttgtttgtttttcttttaagaatggccccacactgaaccatggtagagctattagtttgtagggccccagatggcataaactcgagaagggattgtccacggaaatcaccagcagacttcagcccgaagctgagttcaggaagtccagctgtcactgttgggaaacatctaggagtcttccttggatccataagaagctcttcccctaaaggcagcacagctaactctactctctacctgccacaactcagtcaagaattggcacctgtagccatctgggtaagcctcgatgcttctttcagggatgtgacacaaatggcaactcggagctatttgttactgcttgtctgtcaagattgtagccaggttaatgggtcattttccttctctccagactccaccactgactgatttcagaagaggtagagaactccaaactgtcccagcaggtttgctttagacaacagagcacagcccacatggccctacctgttcagaaagtcatgttagatcaacaaaccacttccattctgagtgcacttttataggttttatgctttagcatgtccgggagatgagttaattaacaatataaacattatgtgagtaaatggaaggtccaaactttaagtttttcttataaaaatattggagctattcatttaagaatttgctcaaaagggaacataacgccaaaaggaaaatgcatgtaggtataggaatttctcagtttagtagggccagggcttgcactatgttccatttattgggcttcgtaacttacttgcttgtttgtttgggggatagtggtgtggggagaggggagtcgtcaagccctataaataagctcattctctatctacccgactctcaattgccctgctaaagagttatttctcctatacctatgcaaagtaggaagagcaccttataggaggcactgtatagggacaggggacatgggatcagccataggaatgttaaatgaaattgcacagaggaaagtttaatatatgtctagagattatacatacacttttttaagcgtaaaaagaagacatctagtaatgacagatattctttttatatacaagcaaaagaaagtataaggaggttctacagtgcaacatccacaatctgtgcattcacatattatgggacttttattttttaaactctcatataaattttttaaaattactccttggaagagatcctggtttttttcttcatttatttttttctttaaaaacatttattttaagagaagagaaaaagagcttcatctaattttgcatcttgattaccaatcagtactagtcacagcaccagcaatactgtatgttttagactgacaaggtcagccaggaaatggcatttttttaaacgcagaaatgtgtttgtttcctctactctaacacgtcctttctcctcctggtgtcctgtcaccccccatgcagcaccactgatgcgagatgatgctctggcctggtccaggaagccctgagccatgggcagattgcccagtggccttgggcggccagagcttgtcacctgtttaaacaagttcaccatgtgtttaaatgacagggtacagtcctggaccagaggtttttctcttcagcaaagctccctggcccttgatcgttggactgttactaatagaaaaagattcaagtcatgaagtataaaatccatcccccatcccagaactttgaaacacaaggagggagag

SEQ ID NO: 130385 - DNA, 1103 bp, Homo sapiens
atatacgatatataaaacattccgtatatatgatatataaaacataccatagctgggttaagtaggtattccactaaaatcctatgtgagctttttttttttttttttcttgaaacagggtctcagtccatgacccaggcttagagtgcagtggtgccatcacggctcactgcagcctcaacctccctgggctcatcttccccacttcagcctcctgagtagctgggactacagaagcacaccatcacacctggctaatttttgtatttttagtagatacgggggtttcccatgttgcccaggctggtcttgaactcctgagctcaagcaatctgcccacctcagcctcccaaagtgctgggattacaggcttgagccactgcgcccagctgagagcttctaatttattctttcaccagagaattcccaattgtgctgattgtgtaacctgtttcagcaaagactttagactgattttagcagtcaagcttgccattcctatttaaagataaagtaagggtggggtggaattttcaaaggtttttgttttaccctagaaagacaagaaggctacaactaagaatgttctttttgttgctaaactctctggccatgctctaaaaaaaacaagcaggtgctgctgtcctcctcctcctccttctcctggtgggctagctctcataacagcccacccacacagatgcaggactgttgtacacccacggacagcatgccagcagctgtccctgaatgctccaggagtgccaggcaagccacgtagaatttaaaaacgtgaattcttaccctctaaattggtgtaatagggttttcagaccaaagctctaaaagttgtaagttataatgaatttgtattagtgatggcttcaattgtgtccaaactgaagaacagagaaatattcatgtgataaaatgcttttcaaaaaaaaaatacctttatccttgtactctaaaataaataccctgaggttgtcaaccctgtttagagttcacttttctcccacatctttgagacgtggtattgaagagggatacttttgtacacttcctagaaagtgagaaaaacccctttctgaaaaatccca

SEQ ID NO: 130386 - DNA, 1050 bp, Homo sapiens
ttcagaggttgaatgggggggtacaagtgcagttttgttacatggctgtgttgcacagtgataaagcctgggcttttagtgtaaccagcatccaaatagtgaacgtggtaccccttaagtcatttctcatccctcacctccctcccaccctccccgtttcgaagtctctaatgtctattatttcactttctgtgtccatgtatacacattatttagcttccacttaatatctgtttctttaggggtttcttgtctgcctgtaagttcccactataagttccatcagggcggagtctatattttattcactgtgttatcaggagaccctggaacagtgcctgaacatattagattctcaataaatcgttgttgaataattgattgaatgagtgaatgaattaatgaattgctttaagacatcaaggaagggttccctggaagtggacagttgaactgagtgctgcaggataaggaagagtttgcaaggcaaacaagagggaggaaaagcattccagacagaggggaaatgcatgtgcaagatttcaaggcaagaaaacagattggcttagtatgattgttttactctcttttgcattaggcgcgttggagactctgactacagtgatggagaagaggacttttactacactgagatcaagctcaacacagactcagtggcagacgggctgagcagcctggccccggtctcaccttcccagtccctggcttcacctcctactttccccatcccagattcaagccgaacagaaactccttgtgccaaaacggagactaagttgatgacgccgttgagccgctcagctcccaccaccctctacctcgtgcacactgaccatgcttaccaggtgacttgcaggggactgtgagagcaatcactttgaccttgaccaaaaccaggggccatctggcctatgagtaaaagacaactcagtggaaaaacagcatcacacacggcagcccggtagctttgatttttctccctttaaagcctaagatctcacacagatagggtcctatggtctagtctca

SEQ ID NO: 130387 - DNA, 1055 bp, Homo sapiens
ggatgcataatcataataatcctgtaatagctgctgttggttgaatggttattcctgtcagcattctgctaactgattcacttccatgatgtcatttaatcctcataataatgctgtgaaacaggtactgttattattcctattttataaataagagcactgagaactcaagaaataagcccaaaatcagtgctctcaatcatggcactggactgttttagaaaatattgccgcagcctgggcaacatggcaaaaccctgtctttaccaaaaatacaaaaaattagctaggcatggtggcatgtacctatggtcccaactacttgggaggctaacgtgggaggatctcttgagcccaggaggcggaggctgcagtgatccaagattgtgccgctgcactccagcctgggtgacagagtgggacccatctctgaaaaaaaaggaaaagaaaatactgtgacccttgttgaagaggtggaattttgtactggtggaggggatggtttctggagccagagtccctggattcgtatttcaactttgccagtagctggttcattgactggacactttttatggagctttctatgcgtctgtaaaatggagattaatattagtatctgtcttttaggattaaaggagataaacacttaagacagcacctggcacatagtaagtgctcagtgaatgttatccactgtttagacagccagaatggccctgtgactaccttcatgaacatgatctgaaatattccagcagagcccatttctcttgaaggatatgaggaaataactgaggtcaccaagatactcacaaacctagggatgcctacaatagtgtgctgagttatagtcaagaggctggggatgctgctacttttctaatgaaggaaaaaaatatgttgggatgacataaagaaaatgttgttagaaaatagtttccattctaatatcactctctcccctttacagaattccatgaaggtgatgttcaaatgcctctggaaaaactgtgggaaggtgctgagcactgcagcaggtatccagaaacaca

SEQ ID NO: 130388 - DNA, 1069 bp, Homo sapiens
agctcctcctgggcctgttgcgggtgttaaataaagtacacgtggaagctgctagcacaggaccaggcacagagtggttcccaatcaatggtggcctccctctgttccctttgctttacatgaagaagaccattctgttagacttgaggtctttgctgacgttggtgttctgcagaagtgctttccactggtgtgaattttcagctgttatccatgagatggtggacattccagctttgcaaacatctgttagctctgcgaggagaagctagggtagaagcacagatgggaccattcagatttggctgccgcaactctgccagaagctttgcttggtttggctttcttgggcaggcttggacccatgcagcaatctgggcgttgtttatttagctattttttcatgttctcctcctcccatggcttgcttttctttagtgtaacagcaactagtctgtttgtagacaaaggatttgtttcaactggatatagttaggggactttgaaaagtactgaactaccatttaaagagcctcatgctttgctgcaagaatgtctttggcctatgtagagacaaatcactttacaaaggtgtagacagggttaggggaaatcagtagggggtggtgcaggactccaggggctaacaaccttggaaggccattattaaccctaacccgtagagccttaagaggctctacaagggaggaatttctacaatccagaaggttaccagaactctggaaatatagctgttggagaggttacccaacagatagggtaacttttggaggagagatgtagccactgcccacctgtggccaggcagaaggagagagccaggaggaatcaataccttcctgctttccaatctctcctgcctcccagctgcctgccggtgcctctcattagccaaatccaaccagagatctatgaaccagaagccctgttaatgcagcctcctgggaccctgagcatggtgcagaaaaggcatggtgtagacctgacaggtcaaatacgacaggtcatcaagtcccttaatagatatgtaacttttcacatcaaagaa

SEQ ID NO: 130389 - DNA, 1014 bp, Homo sapiens
agaaagttcagaaagaaatggagagcagagataggaactccaggctgtctgccggagagcttacttcccacatgaagtatccgtcacccataaggaacctgcagccaaggtaggtgagagtgtgagaagggaaatgaaaggcttctctatcctagctctggaggtcagccagccaactttgtcaagcccaggtctagcagaatttttcctctgggatttcaagacagactggcagaacttccaagctcagagaaaaaccaggttgtgtgagccaggactcttgactttggggaggtgcaatttccgtcatgaccacaaggtgatgcagtgaccctaaatacagccattcggggagttcgtgggagaaaatgaattctatggaaggccaaagagttaaccatcaattccacaagaccccaagaaagtcaagaagcgctgatcagaaatgatttgtgtgccctttccatgccagatccctgattctgtcagattctggattctgtgcattccaaaattgtcatgccagctttaggacttacatgacttaagcaagtcacttggcctcttcagcatcagtttcctcatctgtaaaataaggaaaatggtggcaccatattgatgtggctgttgtcaggaatatacgagaggccctgtaaagagcaataaatgttagctgctaatactttgcctttcctcctcccccctcccccaccgccgtttggcaactgcctgaatggggaatttgagaagcataggtgtggagagaagggggtgcttgcctccaccctccaccctgacccacactgaccgtgccaatgccacagtggctcaggataactccagatccctcagccaccctgtgctcaattgggtgtgcattagcccccctgcaatgcactgggtgagtgcagcaaggacagtagcagaaattgggggcataaaaggaaatctgactcaggactctgcatttcagaacattggcagcatctcagaggcaatttctaaatttcagcc

SEQ ID NO: 130390 - DNA, 3174 bp, Homo sapiens
actgcaacctccgcctcccaagttcaagtgatcctcctgcctcagctcccccagtagctgggattacaggcacgcaccaccatgtccagctaatttttgtatttttagtagagacggggtttcgccatataggccaggctggcagaagacattctaactgggcagaaatctctccacattagcaaacatttcataatgctttccaccacaaatgggaaggtaatagccaatagcaatcttagagtaattattgccaataaattcttatcctatcccagctttgccagagagaatggaggttgtttacagcccagggactgcatgcactgaagaaataggtccaacctcttcctggtggcctgggcccatgagggatacttaccagtcatgtagcaagtcactttgcttcctgctgcctcagggtcctcatctataaaactgggataataatccttattctgaaggacagatgttgtgagaatgcttgagactgtgcgaataagctttgtaaaatgtaaaacactcacaaaatgtaaggcattactatttgttgtaataagcagaatggaaaggggctttagataactatccagaaattatttctcttagattcttaagtgttagactaacttcctataaatgtattctaagaataacagtcctataagaaccccccaccccccaactttttttctgaaacaggatctcgctctttcacccaggctagagtgcagtgacccagtcatagctcactgcagcctcaaacccctgggctcaagtaatcctccctcctcagcctccagagtagctgggactataggtgcatgccaccacgccgggctaatcatttcattttttctgtacagacagggtctcactatgtaacccaggctggcctcgaattcctggcctcaagcgatcctcctacctcagcctctcaaaatgctaggataagagaagtgagccactgccctcagctaagaaatccctttttaaaaaaatgttgaaatcggaggggttggggtgagagggaactctgtgaccaaaccattcaggagaatactgcaaatgatatttctttcttagaaatactgtagtcgataaacccagagctccccaaacttagtgaacaagaaaatcttttttttcatataatccccactatgatcccaaggaatttgtgttgcacaatacaaaaacacatcagaaaactcttagaaaaacctattatcatgaggttaaaataattaaatgtttataaactacaatgtggcttttgggagggggcgtataaatagaacaaaaacttacatacccagctgttgcagatgattgagagggctggggtggtttcactggtgtagaaccaaggctcccatttccccactgaaccatgcccgggcacgcaggggtcctggcactgactgtgtttgtgtgcatgcagagagcctcagcggatcctggaaggagggcggctgcgtgccttccagcaccagcagcagcggctactggagctggagcgcccccagcgaccagtccaacccgtccacgccgtcgccgccgctctcggctgacagcttcaagcccttccgcagccccgcgcagccagacgacggcatcgacgaggcggaggccagcaacctgctcttcgacgagcccattcccaggaaaagaaaggttggtggtcagccacgcggtcttctgcattcagtttcctgaaggtgctttctgtcccctctgaagggccggtgtgagcttaaccttggacctacaccccctttctgtggaaagaagcagcttacgttcctctttaatgttcttgaagtttgaatagaaattgttatggtgataatttaaaaatgacaaatactggtaagtttcctgaaggtatatacacacgtatcccatccatcctctggttataaattgctgacctgggacttaccagtatttgtaagttagaaaattggacctcaggcttgcttcggtatgaactcgctctcttcgtgggacttatttttttcatatgtaaaatataattaatatatttttctcttttctcaatcagccctgaagggttattgggaagaatattttgtatctcatttttatgcagtcatctgtgaaatatacataaaagctgagatataaacaaacttccattcttacatcctagagattatatattaactaaataaaaagtgaaaaagggccaggcacagtggctcacacctgtagtcccactgctttgggagacagaggcaggaagattgcttgagaccaggagttggagaccagcctgtgcaacatagcaagaccctgtctctacaaaaaaaaattaaataaaaaaaaaattagctcagtgtagtggcatgcacctgtagtctcatctactcaggaggctgaggtgggaggatcgctttagtccaagagttcaagactgcagtgagctatgatctggccactgcactccagtctgggcaacagagtgagaccctgctgctttaaacaaaacaaaaaggagtagaagaaaaaaaagacatctaattaattgatttagcaaattaattgattacacatttgtttaatcctcccagcagtcctatatggtaagttttgcatttccatcttgttatgaggaaactgaggatcagagagattgattgtacatttaactggcccctgtcaggcaggttagaaagggacagagccaccattcaaacccagatctgcctgagcctcaagttcatattcttttcattctctttaggtacatttcagttatgttcactcataatttttcgaaaacatttccatttcacagaataaaggaaaactaccactatactaccactaaatctgaagacatttggcattatttttaaaatcaccacataaatgtaaaactgttgttatatgtattggtttttaaatgttgtattggtagcttcattatgaatggctgttcacaaacaaaaatccaatacaaagccctgaggactgcagtgcaaacttttttcctcccccaattcatttcaaagaggaaaacaaagagatggcattgatccaacaatgccttccctccctgcatctctcagcatcattccacatgtgtaacagtggaggtgatatgggcactctctctgagtgtgtacatgtgaaaaaggctgacat

SEQ ID NO: 130391 - DNA, 1048 bp, Homo sapiens
taataaagtaattcagtgctcatttatggtttaaaaactaactactcaactaataaccccaaattgtctgctgtctctcatttagtctgtaagaaaaagcaaattcttaaataggggaagcaatttattataatgaaggctttttttttttttaggaaaaaaagattttctctagaattattgcacatcaatgagtttttggaaactgttgtgatcattttctgtgcctaaaaaggatcattctatcaggaagtgagtctgcaaagagggtgagagtccagcagtgcctgtctccattcttgacaaacagaggtttaatataaggaggctctgtcccctaagaatattataaatcagacctgactttttttctgagaaaaatcatttctatatcacttatagtccttctgactaaatagtctttctaaaggaaatgtcattcacaaatcagtaagcaaattcacttttggcattgacatgaagccatgtaaccacactgtaataatagttggttttcaaaataaattcagtgcctcatacttaacatgattatacatctagcaccattagctttattttattttacaaatgcatactacagtatatttgtaagccacccgggcctgccaagggagtttttcacactaagtaaaatcatcaagccttatattatgctcttcttgaactcctgttgtactaaatggagctttcttatttacaataggcaaatctagtctggtgagcgtatcagtctctgtgtagactgcagggagtgagatgctagtttggttttgttgatgctggcaaagcatgagactgcataaatgaccatttcattctaaaagaacctagctgtaatgagatgggtagtttctcctatttcaacttaaagcttcactcctctaacttaactttttgcttgacatagttgaggaatatggtagaaatccataaataggtaaaggtagttatgaaatctccccatgaatgataatctaccatttgtcttcactccattactaattacacagacattaacagtattttt

SEQ ID NO: 130392 - DNA, 1084 bp, Homo sapiens
atgcttatttgtccacaaaaccttcattatgaacttactccaaggctgggcacagtggctcatgcctgtaatcccagcactttgggaggctgaggcaggaggatcacttgagtccaggagtttgagaccagcctgggcaacatagtgagaccccgtctctacagaaacttaaaaaattagccgggcatggtggcgtttgcctgtagtcccaaccactcaggaggctgaggcagaaggatcatttgagccctgcaggtggaagctacagtgagccatgttcacaccactgcactccagtctgggtgacagagcaagaccctgcctcaacaaacaaaaacaaaacttaccctaagcaagggtttgtgctagaagttgggaataaaaagatgcaagactaagccctgatcttcgcatggggaggaggaggaagcacaggcagtctaacaacagcacagcagtcagtgcccctggcccttggcaggtggaaggcggcttccaggagcaggatggagctgagtactaagggtaagtagaagcaggcaagcacagaaagagaagaaagcttgttccaagcagagggcacagcttattcacaggtatggagaggagaaagtgagtcttcttatggagaattttcacgagttggaagagttgccccgcagaggacttgtgggaaaatgggtagagagtcgggagaccagagcagagagggccaggtgtttcctgcattggagttaagtctcatgtgagggcaatggggagcctcccaagagtgaatttctgtgtccccgcggctgttaccaagcctttgccctccactctcaggtaaagccctgctgcttgaaggcttcttccacctcccgcttccttaactctgctgacatcctgctcatttgccctttatggaaggcttgagccacctggccacaacttttctctcctcaatgctgccatcatcccggatgacatcagcctcgccatttccgatccagcgactttcacctctgccctgcctctgccctctactcccacggccataccttggactcggccatctctcagaatttttctacatagaaaatct

SEQ ID NO: 130393 - DNA, 1092 bp, Homo sapiens
acgtgtcatgaatgctcaataaatattagctattaggagaaagaagatgcagtttttttaaaaagatgacaattttttttctctttaaaactaaatctggaacttaagcagcttaaaaggggattgattcagtagtctgtcactcatcggtttgtcccgctcttcacagtgtaagacagtggaggtatcagccctgtcccaggtgtatccagaagtggctgaaatctgcaggcaggtcccagacaggctgaaggtgaaataaaccaaaatttaaagttacaatgaaaaactctgaataactctcagcctaaagcatctcagcaaattagcccacttgacttgagtctttcatttctctgtccaagtagagcagctgctcctgaagggcaaggccattacccagagcccaggccccactgcctttgtggcacacaagctaggatggctccacagctgctctctgaggggagacacatccccccttgctcctggggagcccaatatgggtggctctgttaggaatgatgtgagtcttctctctttgaaaaaacaaaaaggtaaaatagctacaactgtcacttctagcccatgtttcagtctgttgccaacataatgatgatactatttcaggtaagagaagcagcagaaataagaagtctggtctttttaaaatctgttttttctattaaaaaaaaaactagggaaaaaaatcaccttatttttcttgcattgtaaaataagaaaatgctggatttgttttctcctaattgccctcatgaaataactgctatcaccatgaaaatgtagctggaagttctttacattattggggcttaagtggatttgaggctccaagcaataacatacttaaccccatcagtaagcctggaatgactcaaaatggacacagacgtaagagtgagaggtgcaactttgattagttttcttcttgagaataatcgtgacatttaccaggcggatcgttaacctgcagacttcccaaatgacacagggtacttcaaccccattagcctgggccatgccgcccctgcacatacgacaggctctgctggatgaggtgctccccaggac

SEQ ID NO: 130394 - DNA, 1106 bp, Homo sapiens
tcagaatcatcactgccactgggactgttgtcagtgtccattttccctatgactgcttagctagagcctctgatgtctgtcactagaaggctagaacatacagagctgttgaaacaattatggctggaagtacagtaggaaccaccataggatggtgtcaggaaacgctatgttagcctaggcctgagattcatgtgcctatttgcaatgccacagcataccccaagctcacccaggtgggcctcctgctaccaagctggcctccagcttttggtattcctgtctcccggaagaattagccctatgcgaaactgcagctcacatgcctggtaccctctctacttgcctaattcttaccaacctccctccccagtatactggataaaaatgttgtcttattcaacctaagaaagctgattgcaagcaaatataaaataaaaacagaaaaccgctgtcttagtctgctcaggctactataacaaaatatcagacttgtggcataaacaacatttatttctcacagttctagaggcagggaagtccaagatcaaggtcctggcagattcagtttttggttgaaggtcctcttcctggcttgcacatagctaccttttgctgtgtcctcacacggtagagagaggaggctctggtgtctcttcttcttataagacacaaatgctatcctgggggctctaccttcatgacctcatcgaaacctaactacctcccaaagacttcatctccaaatactatcatgtcgaggggtagggcttcaacatatgaatattgtggagatagaatcactgtcgtaacacatacatactgtagtgccagctgcctgggtggaaatccaaaccccaccacttacttcactttacctctctgtggctgtttcctcatccctaaaaaaatgaagagagtaatattgacctcatagacttaagaggagtaactgagttaatgaatatacaggctgaacagtggctgacaaatagggaatgctgcatgatgtttactattatgatttatttaaagaggttgattataccctgggtttgacctggtaggactgtaacctaaacaggttaataagggtaactcttggg

SEQ ID NO: 130395 - DNA, 1049 bp, Homo sapiens
acaggaaaaagtagcagcagtgttagcatgccctgtgtaacgtatcaagttaaagtaatcattttaggattgcagtgtattcttctagaacccaaaacaacccatccctgtagtgcatgcctgaggggtgctgaagaggatattctactcgatgtcagcatcagatacaaggagggtcaatttcagagtgaagcactttgctgaaatcaatcttaaacaatgacatttagacacagccagcttctaagatgacagcgaagaaataattgctataaaaagaaatgtgtagattaaggggattcccctgaatgacctgtggctgaagaagctcaccatttgaagttatcttgctcattagtttacttctgcattatctctcttctccctgcttcctccatacggcaggtgccttgtcttattcatgaatacttagttcaagttgcctgatacgaattttatcaaatattttatgactgataagaaaaactgaagatgtagatgatacaaacgtggaaaagacatcagactccacatcctaaagttcccaacttagtggaatgaccagctgaactgaaaaggtgacatttaagaggaataaagatgaaatctataattcgagccgcagttaccacctgcacaagggcaagatggggagacttggtttaacagcaacacctatgaaacacttaggggatttaggtggcaataaactcagtaacacgtcaacagtatgaaaaacaaatatccaacatcattactagaagtgagtttcccattacagtcaactgattgtgaacaagggtgacaaaacaattcaagaattgtctttttaacgtcatttaattttttaaatgatgccgaggcgagtgaatcacctgagatcaggagttggagaccagcctgaccaaaatggtgaaacctcatctctactgaaaatataaaaaattagccgggcatggtggtgggtgcctgtaatcccagctactcaggaggctgaggcaggagaatcccttgaacctcggaggtgaacattgcggtgagccgaggtc

SEQ ID NO: 130396 - DNA, 1202 bp, Homo sapiens
acacatttgtatgcaagttcagctctgtaaatatgtgagagagaaggagacagttctagatgggaattagctgatgaatggcctcgaatggcatgctaagaggtttagctttcattcagtaagtaatatagagtcatcaaagatttagtttataaagggagcagtgtcatgatgagagctacatttcaacaagatcactaggaggcagtttgaagaattgattaaagtaaaaaaggagaaaaaaactagtggtagaccagctagccaactggtaataatcccaacaagaggacagaacctaggaaaggggacttaaaaagcagggaatgcattggcaagaacttgcagaaacagaagcaaaagaacctagagttcagattggcaaagaggaagagggaggcagcaaaggtttttgtgcacattctctctcgaatctcacaacgccctaggaagcaggtattactatttccatttgtagttgagaaaattgagttacggaataagtagaaaaacagaacttcaacccagttttgcagtctgcagagtctctgtttgccccattttatccttctaaaatataagcttcaggaatgcagctcgctgcatcctcagtgcctggcatgaacttgcacatagtaggaaccagtgaatatttacagaagaaattataaaatgagtaagtggtactgcatgtgtgaatggtggtgtggcagagcaaccagagagttgaacatctcacagtggtacataacagccctgctgttgatgcaatgaccatgaagtgatgggtggactacagttggatttaagacatttcacacatgtattttctacttaaatctttccctgccaaggttttacattagctaaaagtgtcagagaggctttaaatactggagctatttaaagagtatagagtgcctttgcaacttaaaaatggaagtgtgataaagtttaagcagtgttttaattggcctttcttagctttccctgaggcagataaaccaaacctacagaggaagctgacagtgaatagcagcaagtaacaaatcttgctgagcagcacttaggtattgtttctgacagcatatgccctccatgtagaatttaatataaagctccttcagtaggttaaaactgatgaatagtataatcccagtctgaatagattcttgagttcttgttttcagattttaggaaca

SEQ ID NO: 130397 - DNA, 1009 bp, Homo sapiens
gtttattttaaacctcagtaaattgttcattatccaattgaaaccaacaaaaatgtatagatggccaggagcagtggctcacacctgtaatcccagcattttgggaggatcatttaagcccaggagtttgagagcagcctgggcaacatggcaaaaccccatctctacaaaaaaattaaaaaatttaaaaaattagctggtcatggtggcacgtacctgtagtcccaactactagggaggctgaggtggagaattgatcgagcctgggaggtagaggctgcagtgcaagccatgatcatgccactgcactccagcctggacaacagagtgagaccctgtctcaaaaaaaaagaaaaaaaatgtagagtgctcactctgtgcaagaaatggactaagtcactgaagaacacaaagatgaggacaacgggttattgccaaccagaactttacatgtggggaagaggaatagatgtgtactgtacttggaaaactaaaatacaaaactgtacaaaaattgtatcagctgttggcataataatgctgagtagcaagccacccccgacttaatggattaaaacctcagttacgtacttatttattaattagcaggttgtttgggggtgggttgatctagactggacttggcaggtctgggcttcaaactgcagtttgggtttaggttcactcctcatgactctcatctgccttggatcagcaagccagcccaggcgtgttcttctcataacaatggcagaagtgcaagaggggcaaacagaaacatgtgatgctccatgaagcctagattcagaacaggcacaccatcctgtctgtccaattttacgggctgaagcaagtccctagccaaccccaacaacaactggtgaggaagaatactctacctctagagggagaaactacaatgttagctgataaaggggatggagacagggaggagtgagaaacagagaagaatgatttagccttccacagtaagataataaaagttcaa

SEQ ID NO: 130398 - DNA, 1976 bp, Homo sapiens
cccgaaggcgaactcttgcaaaatataaccaggcatcagaaggcacaaaaaaagcaaactgtgcgttttggttattttgtattatttttaaaaacgaaaaaaaaaaacaaaaacaaaaaccagttgcagaactgctgttgtcactgagaagagacttctgttgtttcttttgcatctccttctttgtctgagagcagaatctttcccctcttccacttaaaacaacaacttgatctatgactgaaccgatgctgggtctgagccgatcgtaagtctggccctgagccacatggctatagcaagggagaaatgtgtgcgatttcccacattcttttcattataatatgtattgtgagtatctttatttaatctcttgctattctacctggcagtataggttgtggttaaagtcaggcaacctaagtttgtattccaacacagatatatgtactatcattatgatggaattgtgttgctgctccaggcctcagtttctccatctgtaaaatggggataataatcaatcctagatcaaaagattattgcaaacattaaatgactattacatggtaatctttaagaacagtgcctggtccatagaatgtactcaataaatgagtgatcattaataatatacagatgcataactgctttattaaccattataggaaactgtgtgtgtctgtgtgtgtgtgtgtgtgtgtgtgcatgtgtgtgtgtatttttaacatgaattggaagatgtaaaggcattagatgatgtactttcaaggaaattattctctcatgaaaaaggcctgttttgtttttacctgttgttacggaaatttttaaacatacactgaaataggatcaatattgaactccctgtatgtccatcatcccagttcagtaattatcaacattttggcaactttgtttcatctactgtctccaccctttttttcaaggtggagtattttaagagcaaatcccagacattatatcattgcacccataatcttttgagtatgtacctccaacagaaaaggatgttatttttaacttaaccacagttattctgacacctcacaacattaaaatagttcttcattattaatatccaatgtccagttcatcttcaaatctcccctgtagctgaaaagtgtctttttacaccttcaaaaaatcatagaaaatattcctcattgcttaaattttttaaaaaaggaatttctaaatatgtcgtaaattcttgcttttacagagctgaatttcaaactgattaaaaaacacatgtgttgatatttatgcagtaagaaaaaaattgcaaatttatttttatcattgttaatctgaataatttgttttaaagtaagaggttctgtactggttaaagtaactaataaatatgtattaattttataattattaattttatatctgtaagtcagatggccaatattttgatatgctctgtatctaaacatacgacttaaaatcttatttaaatcaacacggtatataaacaagaccataatttattgactctttccctattgtagacattaattagcttgtttcatcttagatttaatgtgtgttactcactacctacattagacatttgtttagaaaaatatttaatgttcactatttcctttttaaaagaaatttcttttacttttaagctgttcctgcttaaatgtatatatttaatttttagaaaatacatctctctccatttaagggcaagctctgtatggctccagatgtgtttagaattcatataagcattgttaacagtaagcccccagggagacatgagctaggtccacaaaaacttatatgtacagtctatttttcatgaaggatattgtctctgtttcattgctgactctaagtttgcaggatgacatcatcatcttggacaaatcaaggtcattcagaagcctctctgctggggccctcattacttttccagcatcgtctcccat

SEQ ID NO: 130399 - DNA, 1533 bp, Homo sapiens
atgtgtacagaaggaaggggagaaggaagtaacctgcaggatggtttgaaaagaataaaacagtagaaggatgaacaaatctgagacataatagagaaaattaagaaacttgattaattggaagcatactctccttttaagggatatgtcctaggctgaaggccagctccaaatggcagacagccataaatagatagtgacgatagtgaaaacacaatcaacaaataacctactttgaacatttgaatctaaaatttgtaaattaggaatataattttataatcttatagctcaagtggaatacatgctaaaacttataaaggtgttgtggtaaaatgctcatctttctattgttgataaactcaaactgtatttcaacaggaaataaggttttatctgcaaatatacatatacttaaaatattccttttaaagtgacagcatcacatctggcaatttgtttccttcctttctaatgaaaattatctgaatttttaagttccagtttatcttgttcagtattatactgaacagttagacatctaattcttgttatggatagtcatagtacttcaaatataagacttccttatatatttgaaacatttcttcctttcatcttttaggtaactaaccattaggtaggcatcctgatataatggtaatattaaacaatccagaaaacgtggaaatattcccagggtcctgtggacctttccatatgactgattgagtatccttacaacatggctactggttttccacagaactggagtctgtgtccttctctgaagactaaagagaagcaatggccagcttgtctagtgatctggtcctgcaggaaactgcttgacagtctctgtagaaacgatttgtttctatcaatagtggtttctcacattttgctatgaccagttgacttgtcataaatgagtagattggcagtttttcgaaacaccatctggagaatactggtttgtatcatatgggagtggttttgaataagttatactatcagatccatagcaaaaaaaatgcatatcgtcttttgttttctgaggtgactataattctagattagctaataaaacaatacaaagatttccacttttttgtagggttcaaagtttaaaccatccttccctctgagaacaataaaagctggacaaaatatactaaaaggaattgctcagagacatgggaagtctaaaattatgggaaaatatggaaaatgagtaagaaatagagaggtgaatctgccatgtagggccacttttccactcagatatcttatggtcctggaagaggtaaccgagaagctgagaaatgtagcagggcttttgacagccctgtaggataagggaataaaatttgaaatccagaaaccaaccaaagctgggagtgaagctagtaaatgccccacactttggattgagacatggctggctactgccaggaataagagtgaagtagattggcccactcagagtctgaagctcaacttcaaatcagttttaatccttgaaattgaatc

SEQ ID NO: 130400 - DNA, 1741 bp, Homo sapiens
tcagtttcccaaagtgattaaagtgattgttccattttacaatcttcacaacaatcatgagaaagtctgagttgtgagaaagtccgagctgtcccaggaaattaaatctactttcccttgacagaaatatatttaatcagttaagagtagttgagacgattttgatgttttccttatctttccaaagggcctgcttgttcctgttttgtacacactgtctttagagtctgcttggttctgagctcgtgtttgacttcattttgaagtacaaagtttttgcagctgtaatctgatatgtggaatttggtcatgctcatgtgcatttactggtattttaagatatgaaagttcttccaaaattatagaaagaggaattgcagaggaatatttttaatagacacattcatatatagtaatccccttgtgatatgcatgttttctagcaaagttgattgtacattttatagagtattctattatttacaagtttaaggtatatcacttacttaaaactttggttgaggtaggtggcaagtctattaagatactgggcattatccatacataatggtatttctcctgaagatgtcatttccccctcatagttaaatttcccctcagagcatttttctagtcctggaacttagctgcataattgccacagccctaccaaccaaaactgcagaatttctccctgtgcttgggaattccgtgaaatttctctatcttgactatctataaagcttaatatagccaacgataacattgcagaagtagggactgccatcaaaaatacaatgtgacatggctttaaaattccataggagcccaaaaagaagtaaaactatttagctcctgaattatgaatttggaaatttgaaatgtttatatcaaatatattgagacactgatacctatatttacagcgaaactaaggaaaaagaatgctgcaggaggttgtaggaatagaagaaatgggtgtcctcttaaagcacacagtttttattctaaacttaaacattttaaaagttgatcattcaaattgtaaatgtttttcttaattattgaccacagattttttaaagtacagtttttaatgcatacaagtgtcatttctgtttgttttgtattactttcattttctcatagcaatttactactacaagggaataagtaaaaatttaggtacttatgagctttgaggatcagtaaaaaataaagatatatctgtttgtcttctagtttaaaccacataattagctacttgaatgtttaatattggttagttcatgtgtgtctcctcattacttctggcctccccaatggtaaaagggatggtccattagttaagcacattattttgagcaaagatcacccgttccctggctctgtgcataaataaaagcgtatttgtgccagttgagtgcccttgtgaattgtgatgaagatgtcatgcactaatttgcagccagattagattatgacaaacttagcagggatgacacgattttttgaatggatatttgaaatttttcatgatttgaaagtccctgagccctttattttcatgaatgattatactctgcaacaagggagactatatttaatgatgtgattagcagtttgtgacatatttcattttgtgttctcatgtaattgagttattttcaaatagtaccttggggagatgaattaactattttagtgccctaggatttagtttaatgaagtacttctctca

SEQ ID NO: 130401 - DNA, 1363 bp, Homo sapiens
tcaagaccaacctggtcaacatagtgagaccccatctctacgaataaaagagtaaataaagggctcctgatctactagggaggtgaaggctgttggtcatttgcaggtagttaaaattatatagtagttaggaagtagatggggccattccgttgtgggcacaggggctgaactcacatcacacctcactcattagtagatgactgtagatatcaaattgctttaaaccagtttctgcttcttcactgctgaatccccagcaccaggaaaaatgattggaaccattagttgctaaataagtatttgttaaatgaaccagggtttgaatggaatttctgcgtttctcctactccccagaaaaaagggcctgaccatgtctctcagaggcggcctagaagctggagaacatgtctcagaactagtaacttccttcttctctcccttcctcgttttttaacttccttccaaattttggtgtctttccgactctaagccaagttcccctcaccaatctttctgtttctagaactttttcctattcttttccttgggttcgtcccacccaagaataagttgctttcactcttgctatttgctacagcaatgcccattcccctaccatttccactagtctaaaatatggattttacacagtggtttaaaaaaagaacgacgttgctaatacgttggtttgggcctagggggatcttctgagatccttccgggcagaggaagaactcttaaagtcatatttgaaggcactgatgctggagctgagaggactggatgatggccttaactcagatgccatggcaccaggtagctgcctcctactgttggtcagtttctcccttcaaggaacaaaaacttccccattctcacttcaccagacacatttcttctgtttacatgaggctctcaagcatacttaggctggagaagagggttccattagactttgcatggtgcccacttttattagatataccaatgattttgttctggttatatacttgccattattttgggaatgggcatttctacatcacaatctcttttcttctgacaatccaggaaacatctctgacatctgactataaaacagatgtttctgaagatggagtatagccttcacataaagccttgccgtttgtaggagaattgctgtatctaacaactgttgcaacttcccaagaggaaaatgaagtgctttaaacattttttcatggtggctcacacctgtaatcctggcactttgggaggccgaggtgggcagatcacgaggtcaggagatcaggaccatcctggccaacaaggtgaaaccctgtctctactaaaatacaaaaaattagccaggtgtggt

SEQ ID NO: 130402 - DNA, 2382 bp, Homo sapiens
ccagagatttagagacactgggaatcactgtttctcagtagtcatgtctgttttcctcagctggaccattctgttctgttttttgggttttttgtttgtttgtttgtttttgagatggagtctcactcagtcacccaggctggagtgcagtggcacgatctcggctcactgctatctccacctcccaggctcaagcaattctcctgcctcaacctcctgagtagctgggattacaggcacccaccaccacacgtggctaatttagtagagacagggtttcaccctgttggccaggctggtcttgaactcctgacctcatgatctgcccgtcttggcctcccaaagtgctgggattacaggtgtgagctactgtgccaggccctgttttttctttttaagtgttttatttgctttgggtttcaatagatcctggatatatcctggaagttgagtgcatgcaaatcttaagccatggtgggaagggacactgtggaaggagtgacacaattgagtgccttcttggtactagacctatgatgaacttttaccctattatcttctgctaattgttgttaattttttactaatttactatattggtcagagtagtctaggtctgccatggtgacaagcagccccaaatctcagtagacttaaacagcaaagtctcttaaacagtcgaagtctttaatatatttctggcttatgcttcatgcccatccacaggattcaggtaaatgtagcgaagaagagaacacagagaactgagcaccagcgttagagaagcaacacatgtcacttctgctcactttccactgacccaggcagatcatggggtcatgcctaactgcaggggagcagggcttacaatctaccctaggcctggaaggaggaggccttgtgaacagtctttaagacctgagcaatgagaatggttttttgtttggcagcaagtcagtttctttttgcatttatccatttatgaaatcctaaactggaataggtattatatggaactattctgggctttcagaagtgttcatatttcatgtcaagtggagttaatttgcatacatacatatcatttcgtaattttaagaaattttgtggagggttttcaaaagaaatttaatacttgttttaattttctgttataattttagcaggggaaaatggctgcaaagctgcagatatttttgttctttccttttctatatttgttggactagttagaggtgactgcacataccagtgcggaggaaatacttatccaaaccactaaatggctgtcctgcttggtgttgcatttatgggagatactggctgtcccgttagtattctacatttctgagcagtcagcaccatgacaagatattaaactgaaagaaatgttaaaaatagttcagaaaatacaattgtaaggaaaaaaaaacagaagaaagtcaggaaaggccctttaggtttgggagtagacaggagagacgtttgttttgctcatttctgatagacagtggcattccacagttcgaagccaagtgagtaagactggcagctgcttgcttagggtgtacacactaaggtctctgcctgcatcacttcgcctggaagtgaagagccctgaaattcccagacgctagatgttcatgtagcaaaacagcaaatgctagagagcatctctcatggggtctgcctttgagggtcggagaggcctagctatttggcactgcatattttttccatcaaccctgtagctgactttgggctctaacttttctcaggggttactgcatgtttgtggaagctgacagccccagcatggatgatattactttaaacatttttaaaacattctgtccttttcagataaatttgcttcattgcttccttctttataaaatgtccccttagagagtaggacacattttactcgttagaattggaaggggaaaaaagcattccattctttagagccacatccagtgttcactgcttttgaagaaggagtgatgtttgacacagaaatgcatcaatggggaaggccacatttaacttttgttgtttgggctcagcactggaaccaaaccagtttttcttgtcccccctccttttttttttttgtccaagtggcagaaagcccagaaatataagtttgcattgccaagagatggctctaaatatagtgctggtgggcaggaagattgtttcctcatgaatgcaactggtgtgtgctgtatattccttgccctcctccagcaggaaggaagagtttggctttgctgcactgcaagcctcaggcgctcctggctggaggagtttagaaacaggagcctgggcaggtttgctttgcactctcatctccagccaagacgtgcagatcaaaca

SEQ ID NO: 130403 - DNA, 2942 bp, Homo sapiens
cagagcatgaactttggagtcagaaaaacctgggatcacatgcttcctttgccacttacttgctatataacctttggcaagttactcaaattctgtaaggctcagtttctttctctgtaaaatggggataatactaccatattttattacatctaaggcactatgtattttaagatacagcattattttctgtgtaattcataaagaaaaataatgctgccaattaaactgtgatataacttgattgattataaaatgcacctgatttcaaacatattaaaatatgaaaaaagtgtatgctttagaattgataaaatgcaaggatgcctaccttatgtggttttgataaagtttaaatgagatagcacacgtaagacagtatatgtagctttcatctagtaagagcctaataagtattagctattttattattagcgattatggtcctcttcttgcaaactcttaaaatgagtcagtatattttgctttcttttctaatatttgaaactgagttatagaacagatctacaaaaccattgttggtttttttcaaagaaggagggaggtattaacaaaatggctgtctcagaccagatgatatataatgacctgtagttctgtgcaaaatgcttaataagggtgacacttgacaaaggcctttttgtggaaagtgtgcttcccacacttcatcagtctcttaagtgaaggtagaataaaggcccaaattatgcttagtaattcaacaggttgagagccagcttttaatgcacctctgctccgcttgccggttcctgtgataactgataatttggtgactagctgagcctttgctccacagtgaactgaaggaagccctttatacttgagactggaaatacttccgatgacagtgaagatgtatttgaagcaatgtgatattgatacaaattgctccaaaggcacagctataatacaacaccatagtaggccaaagtctggacaatgagtgtatctgttaaattggccataggtataagaaagaaagcccagtgcccttcaattacagtcatgtgtcacttaactatggggataggcattctgagaaatgcgtcattaggcaattttgtcattgtgcaagcatcatagaatacttaacacaaaccttgatggtagaggctactatacacctaggctatatggtctagcctgttgctcccaggctacaaacttgtacagcgtgttattgtacggaatactgcaggcaattgtaacacaatggtatttgtgtatttaaatctatctaaacattaaaaaggtacggtaaaaatataaaggattaaaaatggtatacctgtgtagggcatttaccatgagtggagcttgcaggaccgggggctgtgctgggtgagtcagtgagtgagtggtgagtgaagtgaagggctaggaccttattgtacactactggagactctataaacactgtacacttaggctacaccaaatttattttttaaaatttcttcagcaatatattaaccttagcttactgtgacttttttagtttataaacatttaaggtttttttttttaactttttgactcttttaataacacttagcttaaaacacagatacattatatagctacacaaaatattttctttacgtccttattctataagcttccatttttaaaatttttaattttttacattttaaacctttttgctgaaaactaagacataaatacacacattagcctgggcctatacaaggtcaggattatcaatatcactgtcttccacctccacatcttgttctactggaaggtgttcaggggcaataacatgcatggagctgtcatctcctatgataacaatgccttcttctgaaatacctctaaaggacctgcctcaggctgttttatggttaacttttatttttacctaagtagaaggactgtactctgaaacaacaataaaaagtacagtatggtaagtactagtcaataggaatttttcagctctattataatcttacaagaccaccatggtacatgactgcatatggaaggacagctggccactcatgtgtctccttggccaccttgagagacttcataatacttgcccctttgcacactcttcttgctgcctaattgcccgtgtgcctagctggactgtaagctcgcagagggcagtgactgtgtgtcctgctcgccattttttctgcagttaactagcactcagaaggttaaatcatcacttggtgaatgcatgaacactgtttaacctcaggtaaagaagtgaattacatatgatgatgccagactttatcaaaattcaaataataatcattttttatgcagtgcatattcaccaaaattatgcattgtggtctaccattaataagacatgttctttaggttgttaaaccaagtgagtttctgaaaaataggtattgtgacaactagaagtgcatatacagaaattgttccaaacaacctgttcctcagttttacaccatattatggggcagtatatgaacctcttcattttcaaacacataaacacagtgggtcccttaagcttatagtctcaactacctagtctgtaaaatggaaatgataacaatacctcctcatggggttgatgtgaagataagatgaaattgtatcttttaaataataatatccctggtacataatcagtaatgaatgagtagtaaataacaatatcattgtttccattgtagtggaaacttgtgtgttcacagatctgggtgccaggaaactttggttttcttagagggagtgagatactgctcttggatatgtctgtcttgatatctaaaagacttgggtttctggtgcagcgacatgtgttctttgatgggctctgatgatactatagctcttcagctacatttttttttttttgagacgaggtctccctctgttacaca

SEQ ID NO: 130404 - DNA, 1050 bp, Homo sapiens
aacctcagggaagcctgtttagtttcttctaaaactcaaggcgattagtaggcccagatattcttaaaatgtgtactgcaagcaaaggaacctctgcgaaaagtgggttgatgaccttagttatagagggtttcaaggagaaggtaattttaatagcagcaaaaaagctgagtagagcgaagtgaatttctttgtaaaggtgcttataagagaacacctggggtattgattaacatattaacaactgcctctttggagtattggattgtagctgcttagtatcaataagtttacaaaaactagccaaagcattatatagttcagggttattgcttacaccaatttcagacattaagcatgagtgaatgtttttctttctgcttttctgtttctatattttcttcaacatgcactattttatgattaaaattatatgtgagtagaaaacgaggcagtgttattgattatatagtaaattttgaattattcttatttgtttagcaactattatgcagtctagaagtgaagaggttaaactaaaccagagtgtagaggagggaacatggagttccttatattttacataattttaacactggtggccatgtgtttctcggtgtccttagaattgagaatgaacaatgaatactttaatgggtgaaatcaaataaactgttattataagatatttattaattaaccaagttaattacaagtctttgaaagatgacagatttgtgaggcatctttagaacaaaggtcaaattctttaagcctccattaattcctgggacctcaacgtaatgttatatatgatagcactcactggaatgggtgtagaaggtcaaattttaggaaattctggcatggacttttattgtggaaagtagcttaacctctgtatggtgtggtttccttatttaaaactaagagtcacgcgccgggttcagtggctcacgcctataatcccagcactttgggaggctgaggtgggcagatcacctgaggtcaggagttcaagacgagcctggccagtgtgttgaaaccccc

SEQ ID NO: 130405 - DNA, 1172 bp, Homo sapiens
gtgatttttgttttttaattcctaagatgataggatggttaataaaaatagctgagtaggagatttccacttttggaagctcgagtagacatagttttttctatttcttcccctaagtcaaactaaaaactctggacattatgtattaaaaaatataaagatgaaaggtagagagaagaaaacagactggctagaaacccccgggccacagcagcagcatagcagtaagtttcatgggttttcatttcgcttcgtgtatcccagacttggagctgaagaagctggcaaataggaaatgtcaacagcatagacaaagctccaatggagcctgctctttcttagtcaaaagaccaagacaggaacatcctagcgagacggaaaacttttagacaatcctctagccgaacaccacagaaggaaatgtggacccaccctcacccatgccagcaaaggcctcgtggggaacccagacatctaccctatgaagccctaaggaggtgtgctaatactcctgctggagtggtttcagaaaatgccaagaaaggagcttagatttttatcccccctgggcagtaattacccctttcccttcatggtgtgagcagagactgtgtggggaatcagaactcacctccacacacagtaacgcagtgctgcacacctcagctgtcagcagacctgagtagaaaacctagacttctgtccccatcttgcagtaacaaggcagcaccccactctttcctttgccagaggcatggcaaagaaagccagttagaaaaagaagatttaggctggttgtagtggctcacacctgtaatcccagcactttgggagggcaagacaggaggattgcttgagcccaggaattcaggatcagcctgaccaacataaagagaccccatctctaccaaaacaaacaaacaaacaaatagccaggcatggtgacatgtgcctgtagtcccagctactggagaggctgagatgggaggatcacttgagcctgggagatcgagagatcgaggctgcagtcagctatgattgcaccacggcactccagcttggcagtcggcgcaacagagtgagaccctgtatccaaaaaaaaaaaaaagaagatttaaataacattcagaatctcatcacataatacaaaaatgtccagttttatttaattc

SEQ ID NO: 130406 - DNA, 1802 bp, Homo sapiens
ggcccatagaccaaatctggttcaccacctgtttttagtacatcactaaatggttgggggaaaatcaaaagaagaataatatttcatgacgtgaaaattatatgaaattcaaatttcagtatgcataaataaaatattgaacacagtcatgcttatttgtttatgtattgtcattggctgcttttgcaaatagtagcagaattgagtagctgtgacagagactatatgacccacaaagcctaaaatatttacagatatggccctttacagaaaatgtttgcccactcttgtgttaatgggatggtttagaaactgtggatttttgagccccacctcagaccagataaatcagaatgtctacagatgggggtccaagaatgtacattttaagcaagctcttgaaattcacccctaggcgaacagtgagacaagactaatgatcatgagctaaggatatgggaaaggaaaagattctgccctactttttctgccgaacttattgtgttttaatccaacgctgtaattttgctacagactgtataaattatgtggatcagtttctaagcacttctctccaattcagctctcttccaaacttttctattttgtggaaagaaggttgtattagtttcttagggctgctgtaacagattatgaactgtgggttgacctgaccaacagaagtttgttctttcacagttctggaggccagaagtccaaaatccagcaggggtgtgctccctcttgggggtctagggaaagaacccattctttgcctttttcagcttgtggtggctgtcagcgctcttgacttgttagtacctcactgcagtctctgccccagtgatcgcattgccccttgctcttctctgtgtcttatttttcatctgcctcaaatcttcctctgattttctcttataaggacatttgtcatgggacctggggctcacacggctaatccaaatgatctcatctcaagatccttaatataattatatcagcaaagctacaaagacctcttttccaaataaggccacattcacaggttttgggggttaggacagggacatctttttgaggccaccatccaactcaatacacatgccgctgttctcctcttcccccaacagccagtcagtttccaagtcttgaagattccatccgcttctcaagtcctacttgcaccattctgatctctttctgccataggaatctcttagaaatttctgacggtttcctactcttcgaaaagttcagaacatacttctaagcctgacatttagggctctctgcagtaatgttgccagcgtattttccatttctttctctttcttcttccctccatgtaccttgccctccagccacactgtgccacttgccgttgccctcactgctcctcccttctctctgaaccctctcacactgttccttcttcctggaacactggttgttcctccatccttatcaccatgacccctacccctgtatcacctaacacccagatatctttcaaagtccatctgaggtcctacctccccatgagagctttgctgctccttcccactagggatgaatctctgagccttcggcacctcacatggtatattattattattataatattaatattattattatatttagctattttgactgcaaatgtaggaaaattaacaaaataaaggaaattaagaaaagtaattctaaagtttagtaaagtgacagcaaacaagatcaacttttaaaaaagacggttatcctgtagagagtgactctagtttataaccagtaagaaaatataa

SEQ ID NO: 130407 - DNA, 1290 bp, Homo sapiens
tccatttatagccctgacccattatgctttgattttgtagtttaactttcaaaccatgccatttctgtggtttccaagtacagtgcccttgaacaacacagttttcaacagctcagatccactaatatgtggatttttttcaataagtgcagtcggcactccatatgggcgggttccatgtccacaaccaaacaccaatcaaaaatacagtattcacgggatgcaaaacccacatagagggacgacaggaggattttgtgaggattttggtatccttgagggtgggaagcatcctggtgccattcacctgcgaataccaagcagcgactgtacttcctcaaaagcactgctgacaacccaagatccctcagatgtccttaatgaaacccttttttcaggctctttcttaccctggtcgtcctcctcttctggttacactcccattactaaataccattcctactattgtatattaacgttccttttaaaacctagtgcctagaatagcagaaggactctacatatcatgtgattatttcagagtacagtggactcttgtattcatctggacatcgtaattgtattaatgcagccaaaattatattaagtacttcagcagccccatctccctagctcttgttgagactctagttaaaaacatccctgaggccttttatcctctgaactgctgcatcacgcagctgcttgtaaagccgtctctcctccaacttgtgcttttataattgaatctctttaaatgtaaatgcagacaattacatttgtcctagttaaatttcatcttgttatttcgagcccagagctccagcttgttgagatcttattgaatcttggttctgtcatggatttctgttatgcatacttgcttgtgtctgcaacccaggtagagaggcttgaaaataaatatatcccagctgcgctaactcaaagcaagaggtactgagagaagacagcagtgatgattgctcggggatggggaaggcaactgcccattctctaagcagtaatttcctaatatttttggtggcagttcacagttcaacattatgagatatagcaaaagccatttattgctaattacatttaactgatgtctatgaaggactattcctatacattagagtgaatttgagactatctccatcattctccagccattcttcagtgggagaaaaacggtggaattaaactagtggaaacaaggctttctcatctagtcccaatccagtcgataagctgtgtttgccaatcactgctccagcacaatggccc

SEQ ID NO: 130408 - DNA, 1593 bp, Homo sapiens
aatagtttgtaagactataggtgcatgtttaaaatgcagttaccctccacaggatgttgggttgtgtttattaaaagcttagcataggaagcgctttgatctcctaactcttgtagggttttgtgttattgcttttctgagtaagaactcctggattgctggtgacatgtcggtgacatgattagacctttaaggtgagtgtgtgtgcacgcacatgtagatgtgcaaatgtacatatacacacgtgtgctctcatatgcataatttttgaagaaagaggtaaagagaaaaaatctggcagcatttctaaaaaaggtgttctgaattgcctgatttccttggatggtatcccagatgcttcctatcagatgaagtagcacatagagtacagcagatgtaaaatagtgcacaaaatcttttctcttcatgaggttattgcagtggttcaaatatttgccataatcttagcaattaaagtgtatactatccacctctgcttcaatcacacttattcaataaaaacaagcctcttctgtgctttagtatattttactaccatatttaacaactaacacggacttactaaaaatgtattctttttgtataataatcaggagtcttatttattcatttcttgataataaatcctgatcttctgggctatcagcacatgggcttagtatataagactgtttattttaaaacagctcttattacaggttcagactttttgctttaaatctgggctatcggtgagtccagtctctgacccagagcaggagtttccatcacaacatccaggacaagccattggtgattgtctgactgagcacacctatttatgatacagagttcatgacttttcaagaccagcacatttctctttatgataaagttttgatttgtacacagttttcctcatattaacttcagattttcttccatgtaagttacgtggatggttctgattgtgccctagggagcaattgcagactgtctcttctacatggcagtcactcaaatatttgaatacaattattatgtcctttctaaatatcttctttttcaaaccaaacatccttgtggaagtttgaagaaagagaggaatggtaggtagcagtgtagcagaaaattgttcaagtaaaaatcagtcggcctcagacagacacagaagctggatctctttagggttgtccagatagctgactgtagctcagcacttaagcaactcacatgaagagggactgtaagtgtagatgccttatttacttatttaagacagggtcctgctttattacccagggaggagtgcagcagcatgatctcagttcactacaaccgcggcctcccaggcataagtgatcctcccacttcagcctcccgagtagctggaactacaggtgtatgtcaccatgcctgactaatgtttgtgggtttttttatagagacagagtttccccgtgttgcccaggctggtctcaaactcctgggcttgagcaatccacctgcctcagcctcccaaagtgctgggattacaggtgtgtgccaccacacctggcctagatgccatgtttatacatatttatagatacg

SEQ ID NO: 130409 - DNA, 3242 bp, Homo sapiens
aacataatgtaaaagcgtattttcaatgttccagtcagtcctggatatatttggctgatagtttaaagaaataaaatcttcctacagggttcagttattaaaatagaaccaaccacccactcattttattacattctgtggaatgtttttggatgacagtctaagtatcttaattagtctccagctgatttataacgccttgttttatgtttcacatttaatatctcaaaattacaagttacagtgccatttttattccgtgccattaaaacagggtgaacaatattttttaaacagaaaaaggcaggttccattcagaaacccaaaggtcattcatttgcattgtctcttcatttttaggtgctggtgcttcttgtctgtcccactgagtctctgtgttgttattcatctaagctctgtgtgtgcgcttgtgtgagggcattgggatgggagattcccctacagctggattctgcatccaggaaataaaatctgtcgctcatctcatggtttgaacacacacttgctcaatttagggtttatcctatgcacttctgtctctgtgcaatgcttcatgtaccatacatttatactgtggccatttgtttttgttttcataaacatgtacatgaaaaagttcctcagaattctactcatggcatcatagaaaccagacagggaaaataatcctagagtttctctccaaacctaagcctcaagtttagttgcaattttgtcattttacacatttaccatcaatggttcacttattcagaatggctaatttcacatccacttgttttgttcccaggcacagctttgtgtgtgtccaaacagaaacaaaatctgtaattaactgcatttgtttgcaaagatcttggcagttttactgtttgatctccttcatctagaagctttagttatgttgcatagcttttttcctgagaataagttagacatattggaaaattaaagtaactttttggtttctttcaatgtgatatcttgctgcccaaaagagctgatttgtctcatgaagagtatttttatattgggtcgttgtcttttatgtgagctgtttcctggaaagatttttgaaatgttgagctacaagattaacagcagtttctttggtgattaacctgagctattaataattgctctttttacatcattgatattaaaatcaaactgtgaatgattactatatgagtgtctctataaagccaacaaaattgaagaagctcgagtttctctcctaaagttacttgttttcttaagaaacatatctgtcaggcaaaaagtcaaaattcaccaaaataatattaagatttcctgaagtaacaaatttctcttcctctatggttatatatacatctcgtttattcatagtttcattgcctaggctctctctttttttgtagctttgttacctcttaattttgtccaactaatgtcaattttcttgttatttataacaagtataaatttcagatgtctgtacaatgatgcctgtttatatgcagcacttcttatgatgtctttgccatgttatttggaattctttcatccccctatttgtactggataccattcaatacatttagcaagtaggaagacatcatttaacctcttccactaatgagaaggtggccattgcattgtcttagataagcagttgctttcttcttgccaaataaaaaataacttctcagttttcattgtggtacatagagagtggtcaataaaattaatgaaacctccttaatttattgtagcattcaatattattggtgattttttgttattttcttatgcaattaattgtttttattataatgaaatatacagttattttaaataatttgtaaatatagataaagaaaggaaatagaaagcatccataaaccagccgtttggtttatggatactactattaatactttgttattattctacccatttctttatattatgctttacataaacagcttacttttctaaataatgggcttacatggtacatgatgttttgaactttttaatataataattaatatattatgaatgtatttcatgaatatctacatctagagcataattttaatgaatgaattgtattatagcatatgtatgtgccacttttttggggtttatctctcccatctgagtcttgagcccatcatatactaaacatcttcacttggataacctacagacccatcaatacttggtgttctccagataacatgtatcatcttctccacacgcactttttctcccgtgttcccatgtcaattgctccttattgctcagtacaggaagctggacatcatctttgatccacactcccataccccaccttaaatcagtcaccacatcttaggttattcaattccaaatttctctcaaatccattgctcctcccttgtccctacatatgtgccatttttagtcagcaaatattctagtagacattttggttgttttatgtatttatagttacaaatagcactgtggttaactgaattagttatatattgctgtgtagcgaacaaattactcccaaacctattggattgaaacaacatgcatcagtttctgtgggtcaggaatctgggcatggcttagctgggtcctccgcttcaggatctcttgcaagtctgaaattaaagtgttggccagggctatctgaaggctcaactagggataaatccacttctgagcacatatgattgttgcagaattcatttccggaagagtagttggactgaggtcctcagttcttaggtggctgtcagctggaagtggctgtcagttccttgccatgtgtgcctccccatataccagcttgcttcagcaaagccagcaagaggaaacctttactcctgatgtgttaaaaggatctcatgtatttacaatgctagggagagaatctgctagcacgacaggagtcacagtcttttttgtagcctaattaaagaaatgacatcccatgccatcaacttggctacattccctttgctagaagcaggtcactaggccagcccacactcaaggggaagggattatatcatggtctgcaaaccaggagcagggatctttgggggtcatgttagagtatgcccccacattaaccatcctgtagccaagccttgtgtatattcttacatatttccaagtgttaaacctgagaagaaatattcctaattaaagggtttgcatactttttgggtgttcta

SEQ ID NO: 130410 - DNA, 1051 bp, Homo sapiens
ctgagcctgtagcagaaactctgatgttcaaatatgtttgttgcttcttcatttcccagactctgagtaatataattacatgaattcggattgtccacataaagaaaaaaacacaaaccttttcatcttctgtctacctaggctggaaatgaaatgggatatttagtccagataatagctgtaaaacataccaggcatcccattgtatatgttgtgagcagtgttgactgtgatggtcattacgtgatgccaaggtcaggttttagatctcacggagcaaaaagaattttgagcatcttgaacatcatctgctccatcccccttatttgaaagatgggaaaattggttttttaaaaaaattaagactttgggtttgaataatggacttaatacattttcaaagctgatttttcaaactttaccacattttcatttatgaggcagcacttaagattcatcatgcacgactttctgtgctgatgtgctaatagtcttccttcttgtttgagaagaagagatgctactttctgctccatcctatgaaacacaccacctgcttcaccaagctggaatgtggtatttttccactgaggagtacgcttgtttttgcaggcagaacacagcagtgctgtttgaagacactgatgatggcaaaggatcaaaggtgggaggcgatggcaggtggcagcttagggagagatcaatgcaaccagtgtggtgcattgctgtctgcagacgtacaggagccaagtgagaatcctagggtgagggaggacaattaaaaatcaaagtcaggcatattttcatgtaaatctgaccatgctaggaaataacagggcacttttaccataatcagaattatgatcaatcttggaaaatgtgatgcttaatttgataggtagaacaccaaaccatttatctttgtttcttattcctgtgccttttggacactaaaagcaaatgaacaaattttgttaaaattcatgagaaagaaaaaaagtaaaaatcctacagtgaaaaaaagatatctagttttgtatgttcattcctt

SEQ ID NO: 130411 - DNA, 2480 bp, Homo sapiens
ggaacatagctttctatggcagtgtttgttgagggttggggtggcggggaggagcatccacggtaaggagggaagcgtttcatcaactgtgggccaggcagtatttagctggactagttggaactaaatagattagttagaaatctgcagcatgattcctgtatgtcccctgaagggaaatgactcccagttgtgcataactgatgtttagtacaattataattattgtgaagatgtttaaattccatctaaatcaaaggaaggttaaatgggtattaccacagttctggtcctttaaaaacaaagcaggcttcatttccagagtttgagagagcctctttagttgttaccagatactctgacattcctcatggtagctactattagagcagttcaaacataccaagtaaacatactgtaggcttggaccacagttatcacactgaatgcatttgttcatacttttttaatattgttaaaaaaaagctcattaatacatactgcttataaactaggaagtgcaacaaatatgtcaaatatgtattttaaagacttctaagtacaaaggatttattttgttacttgcttaaactgttattgattctccttttaaatgttaaccttttttctctctcctataaatagagttctgggtggagaaatgataagggataaagctggagagtcaggcttaacttggaatacttttagaatttgatttttatctgttaggtgatggagagctgttcaggtgataccgtaagattggcatttcaaaaatgtcacctggtaccctgtgggcatgaggagctagggagtgtatacaagtgttgacactgaaagcagaaagaataattaagaggcagatgtagaaatctgaaagaagtaattgtgaaacctttggccagtacaaaagcaacagagaagagggctgtgttcaagaggccatggtgaggataaagctggtagggagcatagtaaggatgaagggtactcaggatggtgtcacaaatgctggcttgggcagctgcatggaaaaaatggttggtgatgccaataaaaaaaataagaattcaggagtaatacaaaagaaagtagatatgagtggagggaaatcagaagtttgttctaagacatcttgaatttaagatccctttaacaaagacctgcatactttgagcaaaaatcaaatgaacaataaatatatttgtaaagaatggtatgtagacttagtcaaaccatagtcgtgttgtaaataaatgtactagaagtgcttgctattttatcgtattttgttttaatatatgtaactacttctctacatcttgattttcatacactggcatttctcaaggcgagctttgcttgtacagcttaattcctaaatgatgaaaagcttttgttgctctctcctgctaagggtttgttttggctggatttggcaaacactcacttcttcaaggaagctcacgaactctgctttcttaacccccaaaatagtattcatctcataatagatttgcgtaacgttgctgcccttttctaagagtaacatcttacaaggtcatctgctatttttgcatccaatttgctatcacatatttttttaaagtgaagtgtggcttttgtctgcaggatgtgagagttttgttttgtttttgaaatgaagtctcactcacttttgttgcccaggctggagtgcagtggcacgatctcagcttacttcaacctccacttcccaggttcaagcgattctcctgcttcagcctcctgagtagctgggactgcaggtgtatgccaccacgcctggctaacttttgtgtttgtagtaggacagggtttcaccgtgttggccaagttggtctagaactcctgacctcaagtgatctgcccacgttggcctcccaaagtgctgggattacagatgtcaggcaccgcacccagctggatgcaaggttttatcaaatctttgtagaaactgtatttttgttcttcgggattgattattccaggataaccctaatcgttaatgacacttggatgtgattagactttaccaaattcatcaaaggctactgaataaaacagaaaactatcttgaacactggtgactgtgaactgtttttggaggaactgttctttctaaccacagttgataaatacattatgtggttttcaaaatatcacctcaattatttgcacatgcaatgtaattttgcaaatactaagcaggtagctagtcttaatgattgtatcaaacgatcacgttgaaagtgccagacagctgcaccacatttgtaaggagggaccatgaggagcatagaattgtagcctctgttgggcttcttaaccataatagaatgcatcacctcccattaaagctatatttaagaattgtgttctccttcatgtttatttttccggactaacaagtttctcttttgactcattcctaacaaacagtgtagtcatattttcca

SEQ ID NO: 130412 - DNA, 3445 bp, Homo sapiens
agtttcttggggttggtaggaacaatctttactgtaggagagtctgcttacccctgggatattgcttgattgatttcaagggaaaagcactactttcttttttgagcgtgatttggagtaagtgcattatagagttgggtacccaaagtattcttcaaattattcaactttcctcaggagagataactacacagaaagagagggcaagagtatgtgagagcacatgagcaagcactgtttctctttagaattaaagatttatcattaacagaaagaaaattaattcctagcttttaggatcattggagagcagtaattgggttgggggtaacaagtactaaaagtgtcgatgctaattgttgggatagcaatcactcaagggctgatctctctctgagagagatgaaaatactagtttcattgatccctatggagagttgaggaaaataggcttcaagagtttaaggacaggaaaagagagcatgtttgaaaggttcatccatgtgatagcatgtgtcagtacttcattcatttgccaaaatattttatttcatagacataccacattttgtttatccactcatcagttaatagacattcgagtttggaaaagaaggctggccagatcatgttgagctatactgattgtgtgaaggatgtttaaattccatttttatgtcactgagaaggattttgtggaagagaatatggtttcattcatctcagtggaagatcactttaggtgttatgtgtagaatggatcagaggaggacaagaatcgacaaaggaagaccaatcaggaagccaccacattagtacaggaaagaaattatggtagtttagacaagagtgacagttgagatcaagagaagtgtacagaccagaccttgaggtagaagtgaggcttcttggttgtaagaacagacagtgactctggctgatttaacaaagagtgaaattttttgaaagaccatcaaggtagctcacagagttgctgggaaggctggggaaccaggtcagaaaatggacaggagggtgaacagctagaaacatagttatgttcattcactctacagaaccagtgcttgcaactgggctttttggcttctaaagtgagagacatctgtgctaggaagttctccagacacagaagcaaattcagccatgaggcttccaaaaaattgacaaatgtctattatcattagatttcttaacttccattttgcaaatgagtaaacagattcagaaagttaagtgactcacccagaaacacatatttcaccaatgacagacctaagactgggataggtttctgatctcaagtgaatttttgttccttatcatcaccatttgtgtttattggagaccattaacttattgtcatttacaaatgtaatgctcaaaatatattgataagtcaattattacttattgtccagcctctaaaataattcaacagttaagcattgttagataacctagatcattagagcctgacatttgttattctgtttttgccagacatcatggttttgaaggtactgatgcttaaattcgttggatttcacccaaacatcaattacaatttgattatgcaaagtagtaactgtcttctaattataactctaaagctagagaaatgtattagcaaaccagttataacaaagaaaaaaggaaaatttggccagaagtattcttagacctaacagcagtttattagaatagtacagattgttagtttgtggttggaagaaaacaaaccatatggtactatttgtttttcagggttttaaaatacagtgatgtcatatttatcacttgctgaataaaatgaaatcatcttctccttatagcgtgccattctgggaattatatagtttaaaagaacttcagaaacacattgacctttgagttcaaagttaggaaatgatctgagctacaagcaaaatcctataaatacgatgggaaactgtgaactaatttggctcccattttcaatggtagtgtctacattttctcctttcttttatgtactttagacagtttatcggaaagtcgcccatgtcaaatttgtaattaagtgagataagacaaaaatggtatcttttatttttgaatctctagaagcctagcagttcctggaacaaatgtttaatgtttaaatgtgttaaaaacttttcaggtcacaaactctgtaaccagtatgagactactgaaaaaaagaaaaaaggtcactttaccattttaaaatatttctttttaaaaaatagagcattgaaattttagaacatttctttttaaaaaatagattttgaggggaatataaatgtactcactcatgttagagaaatactggtactgtataattggtggactccccttaagaactgaagcaatacccataaagtagctataaagaacatcttttccaagaaacttttatccatttatctcttcccatcatttcagtaattcagggcagcaaataactgttgtctctggtttcttgctacagtctatttgctacacatttgccaaaatgttctttctaaaactcaagtatagtcatggagatgggggatgcagacagggaaatggtaggaaccagtataattgacattatgacttaatgcagcacattgtgccatcagtacacagtcaagccccatcttgctgaggatttagattctcacatcaacacacaaatcaaatacagacaaaattgttctttttaatgtcctccgttacctgtaagaacagaactcagtttgaaagacttgggatctgaaaccacttgaaaaagaagcaattctgtctcccttcttactctggggcaaaatttcattgaatggaacggtggaatggtaggtttttgtttgttgtttttaaaaatagccctctcttcctgccaagtgcctgtagatgaatttctgtaatctaaatgcacatatgctgccacttcactctcctaatgttctataaaaatgggaaggaaggtagtaaggtaagatgagaactttttccagcagttctctttcttgtactaaccctagtaacattgatgttatctcaattttcttttcttttctttttttttgagacagagtcttgctctattgcccaggctggagtgcagtggcaccatctctgctcactgcaagctctgccttctgggttcacgccattcttctgcttcagcctcctgagtagctgggactacaggcgcccaccaccacgcctggctaatttttttgtatttttagtagagacggggtttcaccgtgttaagacagcatggtctcgatctcctgacctcatgatctgcccgcctcggcctcccaaagtgctgggattacaggcatgagccaccgcgcccggcctctcaattttcttaattatagcttaggcaagcttgttttatgacacaaatttggcccatgtagta

SEQ ID NO: 130413 - DNA, 4586 bp, Homo sapiens
gattttatacattagctctcttctattaaacatgataatcagactgaaatattgaagagtttacttgaattttcttagttgtgggggataaaacaatgatgttttacattttaaaaaattagaggtattacacttttcaaatctttgtttttgtatacctgggaggcatttttttgtgtgtttgtgatgtttcttatttgcattattacagatgcattgattgtatattattttgtgaagttattttatttctatgttgcatttttcttattaaaattatacaatctttcagatgaacaggaaggacagtgtctgtaatctctcctcaccgccatctgcagtagtcgtacaaaggtgatgttttatgtgagtaagaatttctgtgtttcatttcacaggtggggagcattaagcgggaaatgaccttcacatttcagtcagaggacttaaaacgtgactgtggtaaaaaaatgtctcatcaacacgtgttttccttggccatggaggaagatgtgaaaacagcagacaccaaaaaagccagccggatccttgaccatgaaaaagaaaacactcgctccatctgtctccttgagcaaaaaagaaaagttgtttcctccaacattgatgttcctccagcaaggtaagggaacattaaatctcacatgtgtctgccccaggaagttggtggagagcatgcataatctctgccagtgtacagactctcttcagtatatagacatatgaaaggttttctgccaagaaattttttctattgcttgtgtgaaatagagcaggtggccttactcttcataactgactttgaggctgctgtagttggaactattgtagctctagaaaagaaatgttttattcaattttaataaatgaataataaagagcaaaggaataaatgcaaaaaattaggatgaaacatcatatagaggactgagcatacattaagtaggactgtagccacttcaaagcaagtgtacacagatctttggtcagaggttggtaaactatggctgcaggccaaattcagcccctgatctgtttttctgtggcctgtaacataagaatggttttactttttttttttttccaaatagagatagggtctggttctgtcgctcaagctggagtgcagtgacgcaaaggtagctcactgcggccttgaacttctgggcacaagcagtcctcctgcctcaggctctagagtagctggctgggactacaggcatatgcagccatgcccagctaattatttttattttttgtagagatggtgtctcactgtgttacccaggcaggtctcaaactcctgagctcaagcgattctcccaccttcagcctcccaaagtcctgagattacaggcatgagttactgtgcctggcctgcctttttaacggcttaaaagaaatgaagaataggcgacacagagcacaggtggtctgtaaagtctaaaatatgtaaaagaaaaaaaaagaaaaaagttggtgatgcctggtttatatcttgataatctttgtatgatagatctactttaaaactcaaccaagagggtttatctgaaatatcaaaaagcctttgtctttctaaaaacaagtaaaaaaaaaggcctttgtcacattataattttatttaaaccacacccaatagcactgaaccaaaggacaatattctggcagaatgacagtggcagtggtggcacatacatattagaccttttactttcttgcatatcatttgtctcacctagaaaacaagctccacgtcagcagggattttagattactctgttcatgctttatccctagccctggaacagtgcttaattatgttctggggactcatgaatatttgtcagatgaaaaaaagaaagaaaatgctgtagcatgagagattgcttatttgtaatatgggtgccacattttgttgccaaaaatcatttataatggaacttagagcttatagcaattgtttgagaagtcctgcatttgtccaagtggtttctaacagttaaccaggaaaacagtacctttggaagaggaataaatgtgcctttcctgcctgttcacgttttgtaattaacgtttcatttctttctatattaaatcaaaagtatcttctctagaaaattattattttctcccattgccagatttgtcagactttctaaaattataggcctcttagttttctttaacctttaattgaaaattttcacgtattcattacttctgtttaactacttggaattatttgcttttctaatgtttttcgtataaatacatgttaagttatttaggattatttccttctactgtggcatggttgtgaaacattttatcataccctgaccctcataggcatctcaatttgtatttgttgtttggttgtctcataggaaactgacatgttaacaatttgaaatgtgaagaactgtgcttttttttttttttcctaagtctgtagggcaaaagttagacttctagtgtcagtttaataccaacttgcaattctataggacttattctacataaaatttccattagaccattgtatatgttaaaagacctggaattaatcattttaaattgccataggttgttttaagtatacctttattctttaattccacctcacttggagcacttgctggggaaaataatgaaaagaggaagaagaaagatgttttctgccttttctgactctggtatgtaggatattttccaccttttatggttcactgaatgtacttaaaagtacatgatcccacgccagtgttattgtgaggttcttaaacagtgtgggaaagttaattaggttttaaatccattaatgcacagcaaaaatcccccaatgacaagatataatttagatgtattaatctattatgggaaatactacttaaggcttcattgtttggggtatctactaatatacttgttttcattgctatagtaggaatttaatcatcataaatacagtgtgccagcagttggtgagataagttgcttttaaaaaaaatgatgatgagggaatcaagcattgtggattataatgatcaaactctcaaactctatttccatttactgctaccaagtttaataaatgtcggacttcccactgtcacctaagtatatcaatattttgttttaaagaaacttctttacctgatacagtaggaagatgtaggattttccttttgtttactaagaagaaatatatctgttgacaggtataaataatgaactttgagtaaatctagagtatagtgaaatttatcaatacaaggaaatctatatacaattggccctgtgtatccatgggttctgcacctgtgggttcaaccaaccactgactgaaaatatctggaaaaaaattgtctataccaaacatgtacagatacattttcttgtctttatttcctaaacaatacagtataacaactatttacatagtgtttacattgtattagatattataagtaatccagagctgctttaaagtataccagaggatgtgctaggttatatttaaatactatggcattttatataagagacttgagcatctgctgattttgtgtctatagggaggcctggaaccaacccccatgggtactgaggaatatctgtatccatatcttataaaatatataataaatgtttaaaaatatatatatgatattttggccaaaaagcaggataatcattttaggcccatagaatgcagagttcttcaatcatttaaaatcagttccctgtaacgtttctcactttatcttttgcttattctcattaaagctaagatttttgttgaactttactttctctggtttgtaaaatgaaactcaaagtttattttctgaggtttatataataaaagcaatacatgtatttcaatcgcttatttcatgtaactagagagatctgggaaccccttcccaccttactctctacctcactgtagtttcagatctcctgcctccattcaacaggtttttcttgagtacctgctacaaacccagtactcagtaaaaatgatgagtgaggtgccagccttcctggaggttacggtggaatgagagggacagacacatatgtagctaattttaaataacagttcctgatttgctcccttcccattaggactgggggtaaatttgtaattaaaggaaaatcttttagttttaaggaagttattaatttgaaacatctatttaaaagcccaatttttttattgatatctttttcaagatagggacaattgaaatagagaaggaagagctcagtatcaatacaaactccctgtttgtttacccaatatttgagaaccaattttaaagttgctagtttcagaaaaatataaatttaagtaagttattaatccagatgtgttaggctgggtcattggagaagcaaatgccaagacaggattaaacatgcaaacgttttagtaagagaaacacctgagagagaaatgggacaggaggggcaaggacaggagggagatgcatgtcagtttagggtgctagtctgagcgcagtgatggagagagggcaggaaagttggagggaagt

SEQ ID NO: 130414 - DNA, 1543 bp, Homo sapiens
ccttctctcttgcagcatgtggattacctaccctccttctctcccctccagcctactttccccctttaaatattgaagctctcaagatcatctttggagaaaggcacaggtcacagactgttcctgtggtgtcatgttgttttcttcaagacaagttcttaaccttggcaagataaacttctaaattgattgagacgtgtctcatgcattttggtttacagtccttaccatatggttgggaaaaatatacaagtgaatttagctgaggttaaatttagtattggactttacagaaatgaatgtttctatccaagccttttcagaaaggatttaaaaaaaaatacccaagttgtgtgtctcccttgcataatgtaaataaaaggcttgaaactttagccaagcagtcttccactaccaacttttccaataactttccatcctaagtgtgctgctgactaatcttccatgcagcacgccaagtcttgctttgttgaatattaaattgtcgacatattaaagttaaaacttgctgtagtacactatttacaatagcaaagacttggaaccaacccaaatgtccatcaatgataggctggataaagaaaatgtggcacatatacaccatggaatactatgcagccataaaaaagaatgagttcatgtcctttgcagggacatggatgaagctggaaaccatcatcctcagcaaactaacacaggaacagaaaaccaaacaccacatgttctcactcatgagtgggagttcaacagtgagaacacatggacacagggaggggaacatcacacaccggggcctgtcagggcaggtggtggcaaggggagggagagcattatgacaaatacctaatacatgcagggcttaaaacctagatgacgggcggataggtacagcaaaccaccatggcacacgtatatctatgtaacgaacctgcatgttctgcacatgtatcccagaacttaaagtaaaaaacaaaaacaaacaaacaaaaacttgctgtcgtaaacccagcattaacaacactgattcctgagatagtgtagttgtgtggtttggacatatgatgccaaaacataacgcagggcttcaactctgtcatgctgaattttacttcttactccatcattgaagctgccctcacagggttaacaagaattttggacagaaatactgtaattaagcattaatttgggtttcctttgactcacttttttttgtaactgaaagtcatggaacactagatactgaccatttgcatccccactgtacctgtagataggatttctcttttgttattatttttttgagtcagggtctcgctcggccaccccagctggagtgcagtggcacaatcacggctcactgcagccttgacttcctgggctctagtgatcctcccaccccagcctcccgagtagctgggaccacaggcatataccaccgtgcccagctagtaggatttctgacattagaatcataaggcttttgctcaagatagataggacctctgacattagaatcata

SEQ ID NO: 130415 - DNA, 1124 bp, Homo sapiens
tttagggtagggttcaggtgaggagagtgtgggaccccttggcagaaactccagtggggaaaagtcaaagatagatgttctgttctgtgtccagggtccccggctctggctgtggcagtggcagtcagggggccctgtgtggccatcatagctattagaatgggcagaccatcagtagtccagctattcttcagtagaacagctgcttggcctccttcgaaaagaaataactgggtggggctcaaattccatctgcataaaatagtcaccataaactaaatgtggaagaagtaaagttggtgtttattatcatgattgttcttgactataaatgttaaaactcattgggggagtagggggctggatttcctgtgatccatagaaaggaagaagtgtttcgggcatacctggggaccaggcagctcgatggtctgcccctaacaattcaccttggaggatggaatagtcatttcccaggattttgaaatttatgtaactttaaccatgtcttgcttctgaaaatttgccttttaatctctctacaagtctatcctgtattaacctcgtggtatttgcagaaggaagtttcaaagtcccataatttaaaaataaaataaacccaattttctccataaattttattataaaataaggcttgtattcctggaggcaaagtcctccatgcactaaagttgaatactttgataaggaaagaattgagatgctgaccattctgtgcttatattaaacctatttcttccccccaaattactatttcccccagtttactatttccttctcagtagcttaggaaagtgcttttagcctgagggattctgtgatcccacacttttgcagccctaggaacttggcatctatcctccttagacttttatgagtaggtcccaccatataacatgcatctgcacctgaaactccatttatgtaataatgctacaagagtgcccatgctgtttcagatgctcttctagctcctggagatacatcagtatccaaagcaaaaaaaaaaatgcctgttatcttcatggagcgaatattctggtggagcagcttggacaataagcataataaataattatgcagtttgtaagaaaataataagt

SEQ ID NO: 130416 - DNA, 1031 bp, Homo sapiens
ttaaagcataaataaatgctttatctcaagtcatgcttctaacagacgagcagaaccaccaggagatgtgtgtgtgtctgttgtatttatgtattcatttactctctctctctctctctcattatggctggcttagcagcccagagcccacaggcaggaagacaggcaggaaggatcaggagcaggctggaacccctcaagcatgtctttttatcttaaggtccccctacagtcatctatcaggggttaacgcaattcttcttttgagccatctcccttcttatgaaagcctcagtgttgaagcaggaagcgtttctcccttatagtcatttctatctactctcttatataccagtaagacctgtattataaagaattacgtttatgataagcagatatgcaaatttattctaatatgtattgcctaatttcttgaatacactctagctgcatttattaacatattttatttagtcatctgtgcagctagtaaaaataattggctatctgtgaattagcacaatacaagttaaaatgtgagttcattagttttcaacttgagtttttaatttcacctgctgtttactgcccaaaggaatgataaattgtattttaaatgaaatgtatttgaaggaagaaccttcagcaatcaatattcttttttacttaaaatctgcttctaatctgctctgaaactttaaagatgttgtgttagactgtggcaaccactgatgaatttgaaaagttgtgtttctagttcttattgccaaaggaattagaggcgttaggttagttagtccagttatttttattgaaagaagttgaaaccagctcatatatcttaaaaaagaaaggtaaaatgcagtgagtggggtgggaatttcaattatgaaaaaggatatcaagactttaaagcccagagacagccgaagccaggcctctgggccggaactctgcaaactcagcctggagctctgtgggaagaggcagctcccactactgctggtctgtcccaggactctcctgccctc

SEQ ID NO: 130417 - DNA, 1157 bp, Homo sapiens
gtgtgacttggtttcttccaagactgtgcatccatatgatgcgtgtgacaagaagcacaaggaagacagtgaggtcgttgccatgtgcagaagagatttggcaaacacagtggcaaaggttcctggtgctacccaggcatctgtggtggaagttctagctttcagaccctttgtggtgggaggcagtgcggggtattcttgctagctcagacttgtgatgtggttggacttctctcctggctatgtgcagttgtcttgttgatcatcccagcctgattctccaggcttctaggagattgaggaactatcaataatcctctttatgtttaagccagctagggaagtctgctgtctgcagatagaaattgggaatggtacagctactataaagctgagaaaatatgatgcttcaagggagctaattgtgtttagtactgtttaaaaatggaaattgaaaagtgtttattaaacttagtgataggctcatttgtgaccctggagaaagcatggttttttggtttggttttgttgttgttttgatggaagtggaaatcagttacaataaatagaagagtacataggaggtagggaagtaaagacagcctgggaagacgactctattgataacttgactgacggggaatagagcagaggagcaatagttgagcaggatcaggggattttctcgtattggagtgaaataatatgtatgaagcaatttttaatgaagtgtcttatacttcgtaagggcttagtaactggaactgttattattatgattgttactactattattgttgtcattttgtcctctgtatactttagagcgggggtgtccaatcttttggcttccctgggccacattggaaaaagaattgtcttgggccacacataaaatacactaacattgacgatagctgatgagctaaaataaaaacacacgcgcacacacacacacacgcacacaatttcatgttttaagaaagtttatgaatttgtgttggccacagtcaaagccatcctggacctcatgcggcccgcaggccatgggttggacaagcttgctttagagtattgtgagtatggggtagcaatctcttctgtctcctgattttacagatctttttttcagctcttgcaggctggcctcattgcca

SEQ ID NO: 130418 - DNA, 1301 bp, Homo sapiens
catggaagactgttgcttgactttaaagagtccttccccattaaacctcaaagatctcctggtcatttttaaatgaactggtaatagtatcctcaaagtagaagaattaacgtgtgtgtgtgtgtgtgtgtgtgtgtgtatgaaatctctgtatttaaaaagctgggttactcaataagtctggaatgtcttttagttcttaccctctaagataaaatatcaattatgtcttaaggttatctgcttaggaaatgaatagttgctgctggaaaccacatgtaagatttactcaagagcaactactaaaaaatatcagtgaaggtgtgcaagtcattagtcaatgaattgaatacatcagtgatatggcctgcattacttaggtggagaggcaaatctctacaaaatcaaaaaactggtttaatcaggcatgattcttgagcagcattccctcataaaaatccaagatagttgagtgattcgttcttcaaaatcttgaatgttatacacaatactcagcagcatagaaaataaagcgattctttaaagagtataaaaatatactctttatttaatattactaggaattaatagtgtcagatagtttttagtatggcagaggagataggcccatccattttactttagcaatttttattaaaatcttctgaagtatatgcttccctgtcccttgatgataataaacagtggtgaattaggaatatcagacaccaacctgtgttttaatacagggactcttgcatcgctcaagccattaacatctggatcaaatggccctagattgccgtaattttgcagatattttgtgttcttcctctgtttgggggtatttgggtgtgcctcttgtgcttcagaatcatactttattagcaagtctaaattcatggttctgcggatagcttcttactgttttactaccagtaaagtccacaatctttaagactgataatttcttcgtcattgctgaaagaccttccaaatcctcaacaattgcagaaatttacatgttgacatgtagagtatttctgtccttaacagagggatgcagaatactggagcatgctaactctttttgatctgatttaagccaggaaaatagtggaagaaaggtgagtagcacaagttggatcagcactacttttatcaaatgttgaaacttcctaaatgtagccaagactgttcttatcaccagagtcagcttccagtgtgaggaaatcaaagtgcaagtgcaggaaattatctgtattggatttggcattggcattgaacccagcccaactgac

SEQ ID NO: 130419 - DNA, 1048 bp, Homo sapiens
gcaggtagagaagggaaggtgactgggactgagctctggagcacttcaaatgcagtgctacatttctctgtctgtctctgtctcttaacagttttattgtatttaattcacataccgtataactcttaaagtgtacaattgagtgttctttagtatattcacagagttgtgcagccatcatcacaatctaattttggaacacttgtgtcacccctgaaagataccccgtacccattagcatgcaaccacagttgctttggctttccattgccaataacactttattcattcattgcatttttcaggaaaaaaaagaagtggaggaaaggagagggttaatgtgttagaaaacactgggggaagtaagggaaaggaagaatccagtacagcaaaatcaaatatccaataaatatactccagtggtggggtcatcaaagctcaagggggttgtcttctgcagttcagaaataaggggaaataaaagacaaagacaagttctcattttctttcctcactctttctttttgtaaactcaagataaagctttggtttctagcagtgaacagagttgaattacattcaatctgcatgctactagacagtcttgtggctactttgacattggtcttttgcatcagcagaagagtccctgagtgaatttgatggacattcttctttcatttctttgtcacccacttcaagtttctaagtggaagacttcctgcccccccaccacccatctctcatttctgtctactctaggatttgagagcagtaaacagacctggtccatacaaatccagcagtaaaagtgtttgacataaacacaataaggaatggacttcaatcattggggtatggattggaaatgaaagctacagagctcctaatttattcataattgtatgcaagtcttttataatttggagttgccccaagaattcagtatgtacatgcatcttgtcgttttggttaaaggtaggagaggagtcaagtttttgggacagaagatcttgtctaacataggaaataagggaaggagcataat

SEQ ID NO: 130420 - DNA, 2758 bp, Homo sapiens
actcacttgttgcatggctacatcaagttacttactgtctctacgctttcatgttatcttcaaaattgggataatatgattccatcagtggctatcgtttttttaatatggcccagagacctcctgaaattagacatgggtggcaatttattttgttttgggattcagaaaggaaacatttgtaaaactgtgctcaaggatcaaaaatcctgcagttattttgactgttacaacctccttattaatgctaccaaggcatttcagagagttgcttcctgaagtgactccattcatctgagctctgtggtgttccgtcataatatgtggtgagctttaatcttccctttcagctcaggaagctgtgagtcatttatctacttgtgcaaagaggacagagacatcctatctcttatgttcatcagtttgttcagatctatagtggttgtattggagaaacctggctgttatccaaaagggtaggttggaagaggcttaccacacacattgaatatatttcttaaagctgctatggaaataaagtgatgtcaccttctacctctaatttgcatgtggctggaatctctgaggcatgggtttgcccttcccaccctcctgtgcgttggtgtctcagacttgtaatcttgcttggtgaagaagtcattctttgtttttttgggtagatggaaatgggtggcccaaagtgtacctctaaactcatatctgcttgctcccactgttagggagatgtctagacacggagaaaagggcttggtaattaattgactttgggaaattccacttaaaagtagagatacaattttttttattttataaaatatttcaaacaaagaggaaattggaagagtaatataacacacacatgtatatgtaaaagttactgactatatatgccaagggccattttgagtttctaagagggtgaatatagattgtgatatttacatatttgttggacttttttctagagcatctttcctttgggatacattttgggaaatattggtttataatttattttcttggtgggaaagacatggataagtatcttataccttgagataaataactaaaactgcataattaaagaaataagttgtcaagtgaatttcacaagcacaagggagagttaaagtgttgtagtgggtcatataagctttgacatatttttcctcataaagctgataactcttcagtattgagtttctaaaaaaggaagtatttcctgtggtaaattttcacttgtgtatctgtgaataccattattgtgtgtgaaacttaaaaactggtagagaacactacctttctcaataaatcagtacccacgatgggtctagtgtggaagacaggagggtgtgggaagtgttgttgtaacagaatttaaaagtgccaagggagaagaaattcacaaggtgtttatatccaggaaagtgtatttaataatgttttttacattctctaagaaaaaaagattgaaaatatcaggagagtctcaatgaaaagaacatacaaaaagaacataccaggattctaggactgatacattttctgtcaacgctattgctattacaagtaaagggattaagcacttgtgaatgttgataccatgtataataactctaattggatattgttcaacgtttatttccatattacccaatatttagtgcattgtaactaatagaaggccctcatagccaaccttacttgatcttcttgataaccttgagaggtggatattattatccccattttatagatgtgtaaaataagcctcagagaagaatagaagtttctgttgaaaaatatatatgaagaattttataccaaatgacagatatttgtcaaacatttcagaaaacatttggagaccggcagagttttttaaataattgaaataattggaattggtacctaagcagcaaaggaaatttaaggagaaagaatattttgaagtaaattataaattaaaacaatgtgaaatacagttttcataggttgtcataaatgctttcatgtagtttgtgcatgctttgcaactcagctgcaagtgcttacagaaactaattttttatttttaacaattttttgcaagtttttgaaaatgttttgattgtcaggttcatagacttctaactcaaaactaatgtaacaaaatattagaaaaagtggaaatattagaaaggggatcttagaatttataaaaataaatatctgaagagtacctatttgaaaaaatgtagtcttgttttatcatatattagttacagtaaaaattatcagaaaagggggggaaatggacaactgagcctatgtaaacactgaacaaacactgtagcttagtgtgggaaagaggaggtgacagtgggaaagggggggcatttgaagggttgacatgacccaaggtagagtttatagaaagacagcaaggtctctatttgcatatcttatgacatgagtggctggtgggtgttcaagaggctctgaaagtgtgcttttagccatctgctgagtgacaacaattcttttagctccttattctttttttttttttttttttttttttttgagacggagtctcactctgttgcccaggctggagtacactggtgtgatctcggctcactgcaacctccgcctcctgggttcaggcagttcttgtgcctcagcctcccaagtagctgggattacaggcatgtgccaccgtatttgactaattttttttttttttttttggtag

SEQ ID NO: 130421 - DNA, 2659 bp, Homo sapiens
ataacaagcacagggctgtgctctgcaatcctgtgcaacagtttagggataagaacacaagaatctagagggtttgataatttgctagtgtaatagacttatgaaaagcttggacacaaaagactgctagaagcctaccaagattttaactattgaaaaactgctgaagaaaggcttttaaatgagataatatatgttaaagttcccacttccagtgctcagtaaatattaattgaatggaatctgcttcctctgtgccagttcttcagggatggttaacacgtctattagactatctcttgaatatcagatgactttaagaagcctttggcaggaactgtgcagcaaacactgaattccaatttgctaacaagtatgtgtcttgcaaatggtctgtgttggctcgagcaaaaggcatatgcttaagataccagacaaagttgtcattcattgaatcgtggactgctggagttggaaggcaaacagatattatctagtaatccagtactttcatttgaccaccgagggcactgactatgcagggtggtatgcctggtccatctggggctgctagcaagtttgctgctgccatgatttgtgccctggtctgccaaccccaatttattgtcctcagttctgggttggtttcttatgctcaggaatgatctacagctcactcccttagagttgtgggttgaaaatccacaattttctgaagtggtctactacttactgcttatcaacttctatttttggaatacttgtcttttgtaaagtacctcagctagaggtggacttaacatgtggctgtggtgtgatggatggaaccctctgaatcctgcctgggccaacccccgctccctgtgagctttccaagggacacgtatacacagaggataacagatgagaaaagagccccatttcactgggaagtgagtgcccatagtccctggtgtggtgctgatagtaaacttgcctagaagatgtcattaccagtcaactgttagagcctcttctccttcaccagcattttactactggttgaccatggagggccccataacacaagcattagagaaaagaagagaaaaagcaagaagtcaagccctaccctgaatctgcttaccccctgcctcctagtagggaggagccaagccaggcctggtgcacctgtaatcctagctacttggaagctttaagcccaggagttcaaggccaacctgggcaacatagtgataccccatctaacacagcctgagagagccacagccctatgtgagtttgaccttctaaaattagtaaatctgtcccagttagattaatgtatcccccccccaaccccgcaagaggggcttagaggagtaagggagcctttccctccccatgtcattgtataatatccaaacttctgatgttcctgaaacaatcagccttgttacaatgacttgatatgtttgcagaagtcaagcaaacttgacttttagttgccctgtgccatcttatcttaaggtaaatacatgatttcccttagactttctgaaatatttgtgaatacttcaagaccctcataaccagccaaatctatgttgttgaaataaggatgattttctttgggtgtgaggtccatgttttggtcattccctctgttaggagatatttattgagccccactgtttaccaggttcctgctgtacacacaggatacaacagtaaataggccttcttccgctttcagggagcccacattctaacacattcctgccaagttgtctgtaaagaggtatgaagtcgcttttcctctttatccctaatgagatcaagattagatctgcccaaagccttttcttagctaccacaatttgagatgtaattctgaaatatacctttaaaacaactgtaaccaagtgatccatatgaagaagattctgtggtttggccaggaggtgattcctgaatagctggttaaaagatgagtttagatcactgaatttggcaaataactccagttgctcttatttactagatgaaatggaacagaatataagtctgatatatgtgttcatagaattagaatgattaaagtcttatacttcatggaagatacagttttggaaaaatctagagttacaatttatatgtaggaaacaagcttgactctagagttttcaaggagagtctgtaatgttcagactctccttgaaagtcagaactttgcagtaacacacaaggagggttcgttcatgttgcagaacaccatggagccttgaggagcaaagaagtagtagagtgctgcctgggcactgctccatggaggtctccgtgccatacctgatggtcaccagtgacaacgtttgctttacatatgttcttgtcataatggaaggttaaatgaaagtcatatctcctcgattcagactaattgtacgtggctagttgaagtaagtgaatgtcaaaagtgctccaacattttaaattaaacccagtgttttaaaaggttgtataccctgaaataccatctgataaaacctgcagaaaggataattttagttcataaatgtgaccctcattgttggcgcatcagtgagatgggagagaacaggctgagtcaaaggagatgatcctcccagctgcccccacccaactgttacttctctgtaga

SEQ ID NO: 130422 - DNA, 1946 bp, Homo sapiens
gctttccaggcagagggagtagcagttgcaagtcttgaggtggaaaggagaaaagggtgagtgtggctggaacttggtaggtatgagatatgtcaaggaggctgggaggtgcctgcaaagagagcctggtgggccctttaaaaggatagtgaaatctttgaaaagttttaagcaataaagtcttacaaggtaatttgtagttttcaaaagatccatgctgtgtggaggacagtagtagaggcagggaggccagttgggtggctgtcactacacagaccaagggagggagagggcagcttggagttagagattggcaggagatggcaaattcagaatctattgtgaggatcaacctacaagaacttgtggatgggttggttgatgggtaatgaaggaaagggaggaatccaggatgagaccatgatgtaaatgttggttgaaggtaccatttactaagattaggaaaaccgagagaacaaaaatcaggttttctgttttgtgcatgtgaattctgagatgactattggacaaccaggtggagggtgtggttaggcagatggtggtgagatggggagtggataggagaggtcagggatagtgggaggaatttgagcgacatcagtatgttaatgtcatgtaaagcctgggggctttaagggagtgcagggggccaagagaggagagcctggggcctgattctggggcacagcactatttaagtttgggtgtaaatggagaagccagcaaacactattgagaagcagcagccaaataagtagaaggaaaactagaaaatctaaagtccaataagccaagagaagaaatagttccaaaaagtgggtggggagtaatgaactgtattgaatgctgctgagatatagaataagaaagagagagagagatgttcatttggattagataagatggaacttactagtgtccttgacaagagaagtttgagtgatgtgcttggagtaggctgagcagccgatgagaggtgtggacagagggacacaggaaaaactcttttgacaagttttttggaaaggagaacaaagaggaggaggaatagctggaaggcctatggcctaggtttttttaaaagatgggatacagtagaccctagtgttatgactaaagcatcatgggaattatgtggaagaggggttattagttttctattgtagtgtagtgtaacaaattactacaaatttttttttgctttaaaacagttcttagagtttctgtgggttaggagtctaggctcagcttaactaggttttctgtgaagagtctcacaaggctgcaatcagggtgctacatgggttgagttctcatctgaaggcttgaccagggaataattaacttgtaagcttacatagattgttggcagaattcattcccttgcatctgtaggactgagggtcctagcttcttgctggttatcagttggaagttgttctcagcttgtagagctcttctccccctccccttccctacttactgctgttttttgtcacatgggactccttagcttggcctcttacttcatcaagccagcaaggagaatcttagagcctgcctgccagcaagatggagccttgcataatgcaatgtagtcaggaggaataggccagaaacttggccatattctgttggttagaagtaagtcacaggttccacccacaacctaaggagagggaattttacaaggttataaacaccaggtggtgaggatcattgaggggtcatttagggaggaaccaaagatgtagagaaaagaaaaaactacaggaggaaagtccttggaaagccttagggagggaacctgaaacccaagtaaagggctggcctttgggaaccttcctccattagattggagagaagatggagaatatgagtccagatgtgggtatattttctatattgggtgatgatcagatgac

SEQ ID NO: 130423 - DNA, 1083 bp, Homo sapiens
gcgaagtcccctgtacactgaagcgccgagagatttttccgtttgtgtatcttcaggagataaggggtttattattacacaactgactggttgggctttcaggcatgctattggacaaagcaaaccacgttgagattcatgcacggtgtatgttgctaagaagttttgagggcagcaagtggtaagcaatggagtgagtgatttttctcaagagtggttcctaaaatcagctgaataacattttaccagagttttcagaaggtattggtatttcaggaagaaaaaaaactcatgaacagctgagcttaatagttagagaccactaaaaaaagctttgggggctcaccaaaaaaagctcctcaaagcttgaagttgcatttccaaagaaatgttgaacatcggcaattagaatagccccagagtagatgtgggcagaaatttatttcctagaccaccctggaagtaccagctctgggagtgagaaattttcagcaagtagttatttgggatgatagtttttgacagctgcttgttgaaatccaaaccgtgaccacattcattaccatggtctgttgaaaagcctgcattgtatggctacaagatatagctgggtttgaaatgaagtcacatggtgtcagtgacattgaatatcaagagtagtgactccttagcatttttgtccagaaatactgaaagtgtgtcctgtggtttgaatagtgattgcacaatttgtgatagaaacaataataatttatgctctgtgatgaaaacaagcttaatatagggaaaaaatcaaatccgtaaaaacagaataatgagtgtgataattcacttgatcagtaaaggtttttcacatcttcaagtaaatttcctttaaattctttcaaaatgggcttcattttataacactctcatttgcccacaacttcagaaatttacacagaatgttggagtcatttgaggtttatcttttaaattactcttttaaagacactgtatctgaagagattttctaatggaatatcactagataattttattataatgcatatacgaatgttaacctcttacatatattcatgc

SEQ ID NO: 130424 - DNA, 1040 bp, Homo sapiens
attatttcctactaatgatattttcatatctctgaggcttttctctccatcttccttttcttacagcttttttcatgcaagacccttctggtgtcagtaactgcaatcctactcacactaaagaaaaaaaacagggcagaagaggaatttatcagcttgggtaatccaaccacacatgaacctgagcttgggaaaattagatgtggggctttaagtgatgtgtggtcctctgtctttctgtctctgtctctgtctctgtctgtctcttctgtctctctccttctttctctctctctctcagagtgtgtgtgaaacttatttcattatctggccgactagagccagatccacaggcagctctggccacacacttgtccaccttgtgaacaggtgcagaggaagtctttgctatgtgcatcagctggaaaaatcccagtgaatgatttctggatggcccagtccgaatcatgagcggacacttgtggccaagggtggatggctgtgatggatggcctgcaccaaaccatgtagttcaagagaaaaagaatgattactgtattgagcagaaaaagaacatgaaaggccaccatatgttataaatataatcaatactatcacaaatctgaaacatacaaatttgtagaagggataaaagtcacatctaacctccctacccaaagataacccctgtaattgtttttggtatatttattttcatttcttttctatgcatcatcctttttgtctcacattatttttccacctaattttataatgagagattttcttttgcacatggtggtatataacttgtagatgtttatggagctagtagggtaaaaatgaatcataaaaatattaacagaatatatgcatgaatatttttataacctctagggaatgatagccattttaaacttgataccaagtcagggccatagccaaaaggtgatatatgatcacaaaaaacttgtagactttttcacaaaagacaccattaaaaagttttaaagtaagtgaaagatagaaaatattatcaa

SEQ ID NO: 130425 - DNA, 1101 bp, Homo sapiens
atcttcagtcactccttgttactttaacccaattgggcaaatactgggaggagtgtactgaggataataatagcaacaataagagctcacatttcttaagagcctaacacgtgacaggcattgttctgtgttttacatcctttatctcagctaatcttctcaacaatctcatgaggagagtaataccagagaagtggaccctgagaactcagaaagctagcgactaaggagaaggttcaggatttgaactcagggtgtctgattgcagagctagaactacactgtgtatatgcagaggaagcatccaatgaatcatgagcattttatggtgactattattcaggtatgtatcttccatgtattgagtactactaccacatgcttaggctgggtttgacctctcatcccatttacttttcacaatcacccatggaattagggtttccgtttaacaatcaaggaaactgaacctcaaaggcattctgtaacttgcccaggattactcatcgagtaagaaaggggagtcctgaatattccagccagtctgcccttttcacccctttttagggtttgctttagagagtggattgaatttttcctcatcagactgaggattctaatgaggtcacacggatgataataattagaaatcaatggcttgtgtttctcccttcataagtagagtcttagtccctgagggtggatcacgtgggctcccacacatctcctcctgctgcgagctgttcgtgctctgtcagcccctctgccagaggaaggtgtatcatacagtggtctgtggcacaagaggaagaaggactcacacccatcttaacctcagcagtgctctgtgtgccctggtgccctaatgtctacagctgtctcagtgttctttaaaatgtaaaaaagctctttcacttgttacttacagtccctctactgtccatgagattcaactaccagtgcatggggaccaggccagggctcaacgccacatgacaaaccccattctgtatccagaatcctcctcctgtccactgactgagaggtgcctttgttccctggtagatctcattgagcctggatctttctctcctcctaatg

SEQ ID NO: 130426 - DNA, 1164 bp, Homo sapiens
ttagccaggaatggtggcgcatgcctgtagtcccagcagtggggggcaggggggtggttcaggagaggattgcttgagcccagggaggtcaaggctgcagtgatccatgattgcgcccctgtactctgggcaacagagcaagaccctggttgaagaaaaaaaaaaaaaaaaaagaacaagaagaatccacccccaaacatatcaagataagacatccattgcttcaaacactgggccaggcagctgtatgttcccgctttcgttttcaggtaagaaaaatgaagacctagaccatggaggggacttgcccagagtccaatttcaagtccagtccggggctctcctcagcatccagcacacgcttccctgactttgcgcaaaggtcttgctcctgacagggaccgaattacagattctgccactttacccgagaattactctccaaacgcactggtctctttgcaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggctgctgtcgccattttcttcgtcatcaccttcctcatcttcctgtgctctagttgtgacaggtgagaaccagagtgtatatacctgtgccttaaactaatacatcccctgtacccagaagagtttctgtggaaagcctgttaggaatggaatcccgccacagagccgtcccagaaacttgtgcattagctttaactctcttctctctgctgcagagcgtctcgggacattctttattcactgaaggaaaacccatatttggttttgctagggagcaactagaagagcccttatattttaaacttcccagaatgaaagtcttgctgttctttcgatcacacccttgtcaaaatggattttgtcttttttcatgtgcgggcattttgaaatcttgtgtgatgcgcatctttttgccaccaccctgcggaagtcacagaatgtttgctgctacgtgatttcggagggattgtttatgattaaaaatgtgtagtgtagaccttcagtttctcaagaaacagattattttccaaggagaggaacatgctgtatatgaaat

SEQ ID NO: 130427 - DNA, 1101 bp, Homo sapiens
gttccatgtggctggagagtcctcacgatcatggaggaaggtgaaaggtatgtcttacatggcggcaggcaagagaaaatgagaaccaaacaaaaggagttccccttataaaaccatcagatcttgtgagacttactcactaccatgagaacagtatgggggaaaccactcccatgattcagttatctcccgccaggtctctcccgtaacatgtggcaataatgggagctacaattcaagatgacatttgggtggggacacagccaaaccatatcagtgccttagttatagctgcaaagacaaacatagagtttgtgctcatgaaggttctattctagaggttgtacatacaacaataaacacaaaggccaataaataatatgctttcagataaggataacaggaaaagacagcagggtaatgagatgaaggctgagtgtagtggagtggacgggagagtttcagaatggttggtcatagaatgcttttctgagaacacgatctttaagcaagactgaaaaaataaggaggaaccagctgtatgatgacctgaaggatgttcattccagaaaacaaacagctagtataaaagctccaggtgaggggaagcttgacatggtcaagggctagaaagaaaaagcacatgagaagtcatggtcaaggagaccaaggaaccagctgaggctggaatggttgggtccacctgccccatgagaacccttcaatgaatgttggtcaaactgagctgaacaaagtgtactgtgtccgtttaaacaatgaaggtcaatagaaaagctaaaatagcctaaatcataaagaaaagttattgtcataataatgtgttgatttattgtacattctttctaagaattatggatcattttgcaagtggatagagaaatgtattttggatcagctttgacatacgcttaaaaacagtggtatgttaccctcaaacaagtaacaggccaagagattttatatatttcttgttgaaatttttatatttgaaaatgcttaaaaataatgctattttaatttctataataaattacaatagccatataacttttgagggatgcagagaaaactacatagaaa

SEQ ID NO: 130428 - DNA, 1001 bp, Homo sapiens
cattcgcataccctgatcttgctcactactttcaacctttctcataagatcttgattcctaaatttagccacccaccaaatttcttcatgccccatatctaccttaaaattaacattttccaacctgatttcttcaaatgtccatttcccaccctgaaatcagttcctcttcctgactttcctatcccagttaatgacaccaccatatgcccaaggtgtatctcccctttttattgctcatgcctgatgtcttcaaaagggctgttcattgattatcctaaatacatacactttttgaagacagtaacctaggcttttaagtaaccaatgctgatcattctagtattctcagtccccatgtgcgattagaccagaaattcctttgacagtctgtcagaagttgctttaaggtatattcagtgagaaataactatggtctgtctctgtcaagtaagccatggaaatatgaatccatttctcgactttagatactgtttcacaagtaagaattaaagaatgctagaaagtcagaatattgtaaaatgtgtagccattactcaaatatatggaaaagaacacaggtttatgacttattgagttgtcacttcaaagttattcgtcattaatgttttaaaattaaatctctattctttattcagggcctcattggctggcagggtaagaagttaaaattctaacatcagattatcattttttcttgttcatccaaataatatattcagataatacattcatgttcattcttatcaatatcacttgaatattattccaaagcttatgatattattaactctgcattctcttttatgaatttacaattacaattatgctataataactgatgaagagcacagaagagcattgtaaaaataaataaactttgaaatacgaaaggattagtggggataataaatatccgctcattgtcttatcatctttgatcttggcatttgttctatccagcaaatattttcatagta

SEQ ID NO: 130429 - DNA, 1026 bp, Homo sapiens
acaggaaatcactcttgatgcctcttccttcaaggtctgtatgctctatctattaaatattgaatctgcttttgatttcaaatccttcggccattctcttagtttagacccttatcatctggatgacatatgttcctgtattagctagtctccattctgccagacttggctaggactatattatcaatattttccaccctcctgccagggagaattttctaacatgccaatctgctcaggtcattctttaaaatccttcattgatttttctgaacattgtctccaggtaagagatctaactccttaatgtggcatagagtcttttgcgatcagacccctggtggtcagtcagcctcatttcttgcattctgctgtgtgatctgtgttctagttatataactcagagttcctcacgtgtggcccgaggctttcataaaccactccctagagttcgtcagctgacttccctcttcaggtgtcctattctctgagaagctgatcctgattggccaaccacctcaacctaatctggtttcaatgtccctcatttgcattcccatgtgctctattacatccctttcaaaatgcctttcacactgctgtaattgctggttagtggtctctctttctcccactggactatgagcttcttgaaggccgatgtcacatcttaatatttatttcctcagtgtctagcattggatctagtctgtaggaaccaatcacttatttgtggtgttgggcaagttacatatcctatctttttaattgtcctcatctaagtaacagaatgtctcatagggttttgtgagaaataaaagagctaatatatagaaagcatcagaacagagtctggcacagaataagagctccatagatgtgttcttgttttatagtccaccccagggacatagaatactcactgaatatttgtagaatgctatcgattgataaagccaagagggagttccacaaattacctgggagagagagtagaaaaattgtgggacatgtcatggctgtatt

SEQ ID NO: 130430 - DNA, 1044 bp, Homo sapiens
catttgtgggtaaagaatttctaatttttccttgacaattaggagtaagttttatttattgtctttttaaatttcaactggcattactgtgaaatgtcaggaaagaagggaaggtgttgacataaaaagtgttacttcaggaatttaggaaatgagtttttcatcatcttcatcgagttctagtttacatgccataaaagtctccaatttcaactgaacaattcactgatttttagtaaacgtacagagctagggaactgtcaccacaattcagctttaggacttttctatcaccccaaaaagctcccttgtgcctgtgtgcagttctcattcctgctgccagccccaggaagccaccaatctttctattgcttgctttcttttctgtctcactttctgtccttatatatttgccttttagcaaatctctggacatttcatttgagatattaatatttaccaataaaaatgtagtttctatcttctttttcaagatcagcatcaccttattttttttatattgcctgtaccatacacatgctacagtgcaggttcagggactcttagttatcggaactctcagactaataaagtgaaacatgcagcaaagaagtaaagcacatgtgtaagagtggaatgtgtgcctgtttctcagctttgtccctgtttcaatggtggtcaccccctctactacttttgtaactctgtctacaaaaataatgttatagaaagcattgaaaagctgaagtcagataaatactctcaagatgtggggaaactacaaaaggattaaatctggagaacatgcctgtttgggagctgtattctggtcaaccatttcttagccaaaccctttggggccaaatgtctttcagaattcagcttttagaaaggtaatacagtgtattcattgtatattaatgtaatacccccatgggatccaggcaacacacagtaatttttgtagcaaagtagatgaatattcacatttagttagagaaaaactaaccacatgtcagttcaggtcagtttggggaacaaact

SEQ ID NO: 130431 - DNA, 1034 bp, Homo sapiens
ctggccaacatggtgaaacccagtttctactaaaaatacaaaaattagctgggcatggtggtgtgcacctgtaatccaagctactcggaaggctgaggcaggagaatcacctgaacccgggaggcaaaggttgaagtgagccaggaagatcacaccactgcaccccggcctgggcaacagagtaagactttgtctcagaataaataaataaaaataaaattggtcactaacagctttgtacttccctctcccatttcacagatgtccagctgacccaatccctaggtaccgtatcatgtattcatttgcaagtaatcaggttctcttgattttctaaaagtaccaaaaggtgtgactaaatcagcattactgtcatctgccatctccgtgttgagagagccccagggttgcatatgtaagcttttatgtgaatttattctctgaggaatgaagggtgatcagataagttctcaggcatctcgtctcactgtatttgtgactccatcattactattaaagttgcttccccctacgccatcctttcaccccaaaccatacccattccttcatcatgcccattgtggtggaacatgatgaaactattgggaaacttaagtgttgagggagctcatgttctaagtcaaaggaaaaaacacataacacaatactttttttcttttcattaaaaaaaagccagtccctaacatagctatacacaagaacaccacaccttctgcattcagcagttgggaattgcaaccagagtggccttattaattttttcctggcaccttctaaggagggctgtgagcctctaattcacatgtaatcaatcactagcagcttgtctgtgttttcagtcaaatttagtgactgaagggtcactaaatatcacaagggtggtatttattcatttatacattcaccagatatatattaatatgataccaggcacattgttagatgataagacctcaaataccagaaaatccctctctctgccctcaagaatctcagattcatgagggaaggag

SEQ ID NO: 130432 - DNA, 1047 bp, Homo sapiens
gaataaatctaataagacagaacaatcccttaccaggatctgagagaaactgagaccaacaggtagatgcttcagtgcatttcctagaagtggctatttcggtacgtgatatgataggaggaagcaagccatgtaatgctgagctgaatgatgtcccttactggtagcaccagaaggaatacaaaccgttaaacataattgtccaatttgtcagcaggagagacaatgtttacaaaatgcaatggaacatattcccagaggtgaagaaccagcacacagatggcaagtagactatattagtcggctgccgttagcaccaggaagatttaaatgggttttgactggcacggattcaagacttggctttgcttttccagtcacacagactaatgttaataatacagtcgggctggggtagggaggctgactgagcaggagtcgtctgcttgtagtggaggctgctaggagccggtcagagggattcatgcataaaattttccatcccaacactgacgacgcgtcaggaactgtgtgtctagatgtaattaatcaaacttggacagctctctatgatcttaccaatatatttgagtccttcctgccccagttgttggcctatcctaaccccatagatcctctcaatggtgaagatgcagccatgtacctccaaagaccagaagaatacaagcagaaaattaaagagtacatccagaaatacaccacggagcaggcgctgaaagagcaggaagagggtaccagggacagctcatcggagagctctatatctgacttttccaaagatgaggcccaggatatggagttgtagtagaaaaagcacctgcttttcagaaagactattgtttcctaaccatgagaagcagactataatattcatatttaaacacagcaatttttttatgactaaacaaggtttttatgaataaaagcattgatatatatatattatatatcaccctttagatcttgatttcctggtcgtttctcaacctgaggtgcatagcatattcccacattccatttggtagc

SEQ ID NO: 130433 - DNA, 1053 bp, Homo sapiens
ttttacagggctgttgtaaggcttacctgaatttcatatatgtaaagtgctggctcataccgtgggatatatgtttacaatagttatcaataagcaaataagtgaaaatatgccgcacaaagtgattacaatggaattattgcttttatcatgtaaatgataactttggtcttcctgttatttaacatgacttaacattctacaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcaggtcagtcgtgacatgttatgaaatcacagaagcttctagaatgataggctgtatcaataacattttactgtttataggcaagaacttaatgaaaaagttattttatgaattgaattttgtcaaattagcaaaagtatcaacttcatcatagaattggcatcttttattagctactaggttgaaaaccacaaactattgtgaataaaatcaatatgggttaatgaagtagactcagaaaggagaaggtgaaacaaatgttgattaaggaggttatgagtcatggaaactcttgtaatgtacttggaagattaaaacgtttactttgtttttgcagactgtctgcaactttacagatggtgcattggttcagcatcaggagtgggatgggaaggaaagcacaataacaagaaaattgaaagatgggaaattagtggtggtaagtgtcaaactgctgtgtctcagtcagcttcttgtgtgcattcatagttcacataactgttctatatcattgatcattaacagaactcagtttggaagaaaaaaaagcaaaataacaagttaaatactagaacactaattattaagaaagtcctagtggagatagagaagtgacatgacataggagaggatttggctggagttggggggagttcttgctttgctgccacgtcacag

SEQ ID NO: 130434 - DNA, 1535 bp, Homo sapiens
tgctgcaaataatagaatattagcagaaaggatagctaaagaaattcaggttatacctttgcaacgagacgacgaagattaattaaggcagcctcatagtcaatcccagttgcttttccccagatttggtgactcatcaatggatatgtgttttggatgtatgatatgcttggtttaaattctctttgtccaggtcaaaaatttggaacttgtttcttattttactatgtctaggtttgcaagaattgacataatgtttgtttcactgatttaaaaaattttgcatgtaagaatgtactttaggaaacatacccaggaagtacagttgataaatataacatcaactgaaatagtcaattagcaattttgtgtttctaaatatctatggtcccctgaaattttgacttagtatataggtgcagagacacccacttagaaagttaactgtttggaaaaacatttctctttagtttcaaaaaccatatataattaaatttgtaaggatatactgagtaccctaggccaacttttttttctttgcagagaaccttttttgttttattcttcagtgttcatatagcacctggcccattacatatctaggcaactaaaaacaaacattgtaagaatgaatatttttaatgtagtaattcctagttacaatagatacataaagtaatgaactcagcattctgtacttttgcttcaggtttgaagtaaaaattatctagttaaattttttttatttcacgttaccatgccatttcacattaccataccatcagatagcatggcttattgtgggcatttctgcagtgaatacattttccaaaacagttaaattgtctgtttggatttgctttaaagtcttgtgtaagagagaagaaactatttctataataaaaagcactctcatcagatatctgacataattagatacaatataacattttactaagttcagtattcatgttttaaaggtgtttatactgatttgattgtgctggcaaatatactgtattgttaatattgaactgtttatttttctcttagtcttcttatttaattaacttcattgccgctggattctgttcagcctttaaaaatatttcttagtggtcattgctctgcagaactcaaaaagaaaattgtacttgttcatagacatttttaaagggttaatttattgttcagccttatcccttggcacgtaaacagactactagacttattgtaggttcgtttgagctttgtgttgtaaaattaaaaatgcttctgtaaagttttcaaggtagggagtgattttattattgtgtatatctaatatattaagtatgtgtgatactaaggtttgactgctataattatttgtactgttgatcacatgtacttaaaacatctgatactgtattctaagacaggttgtttttgcaattaaatttattttaataagacgatcatgaataaaactttaaattgatatttttattattattaccattatcattattattatttttagattcagggtctcg

SEQ ID NO: 130435 - DNA, 1053 bp, Homo sapiens
ttaatagagatggggtttcaccacattggccaggctggtcttgaactcctgactcaggtgatccgccctccctggcctcccaaagtgctgggattacaggcgtgaacctccacacctcgcctgctatgttttatagtactctgtgtagctaaggaaatgttatgatttggaaattgttgaaatcagtgtaaagattaagagtttgtcctacttggcttttagtttcattggtgaagaatctgtggcagctggggaaaaaagtatcttaaccgacaaccccacatggatcattgaccctattgatggaacaactaactttgtacataggtatgttttaaaatgtctaatataattactctttgcatattaactggattgacctatagatactctatttaggaacatgtacactttagaaaattgtatacttcgtttatgcttctttattctaataaagtatatataaaatgtaaaagtggagcaaaatgtattatgcagacttatcagatatggaggaggtaaagaaatactaatgtgatcttgtcctgtggtgccaagtgccccgttcaccattctttttcccactgttggcactatctaaaaagggaagcaaacaacattgctgctttgagagtgggaagggcactttgcactgcatgccattttctattctttgagtggcatgtaccatagatctatatggatctactaatatgcatctattagtagtaactatgtaaaaatatggttttttttttttaagatggagtttccctcttgttggccaggctgagatgcaatggcgcagtcttggctcactgcaacccccacctcccgggttcaagcgattcttctgcctcagcctgccaagtaggtgggattacaggcacctgccaccacacccgactaatttttgtatttttagtagaggcggggtttcaccatgttggccaggctggtcttgaactcctgacctcaggtgatcctcctgcctcagcctcccaaagtgctgggattacaggcgtgaaccactgcacctggccaaagatatgt

SEQ ID NO: 130436 - DNA, 1126 bp, Homo sapiens
agagactttgagtcagtaatgattcttggtgttcctgttgcaccttgaacacctgttctttgccagagttaactgatttcttcagtatactgctccttctattggaatacctctaaacagcacctgtggcacagataaaaactcagtgagaagttgaagtgatttgctcttgtaacaccgggttcatggcagacccagaaaaggaagtggcaatatcggactctgcttaccaccaaacccaaacatttgcaccctcaagttgggcttctttagtcataatgaagccttgggaagatttggctcactctacaggatgctgccattgtttaatgcaggaaaggaatgaagtctcaaggagatgaacttgagaactctgcctctttctgtaaaagtgtgccagctacatttatgcccacttaccaccaacaataagaaggctgttttattgcatataacttttgtgcatattatagcctgttttagaggtaagtactgatttctacttttactttgtgtctgaaaatattctgggaagttatgcaatggcaatttctaaagaaagaccatgtcattatggcttgctaaaaatgttgttggtcattttgctccttggcccttcctcttcagtttgatacacactctgacgtttgcttagtgtctgtcaagggttttcttccctttgccatctatttggatctgtgtacagctttgtctaccatggttgctcagcaaatattggtggtggttgttgttgttttgagacagagtttcactcttgttgcccaggctggagtgcaatggcgcgatcttggctcaccgcaacctctgccgcccaggttcaagcgattctcctgcctcagcctcccgagtcgctgggattacaggcatgtgccaccacacccagctaattttatatttttaatagagacagggtttctccatgttggtaagactggtctcgaactcctgacctcaggtgatccacctgccttggcctcccaaagggctaggattacaagtgtgagccaccgcacctggctgatgttggttttaaaaatctaaaaaattgaccatttccttctaggaagtggtaaaaatgtaaatttgttttcaaagacagagtgca

SEQ ID NO: 130437 - DNA, 1151 bp, Homo sapiens
acccccggagctaaggcataatcccagtttgacagatcaacactcaatgaattcagatgttcatctagctataaatacacctgacccacatttctactccttatcatcttatttctccagctttttctcttttattcagcaatgccctcaatattccttctgaataatattcctaaaactgaactgtatttacacacctggggttcacaaatgctggcttctgaactgatagcgtgttaccttcatcagattctctggagagctttttaaaaatgccacaccaggagattctgtttcaagggatctggaataaggttcaggatcttggtactcaaagatggggtgattttgaagtgtgtaatgcttggaggctagtggatgatctacagtttttccttgagtcagtatccagcaaccaaaagaaaagaagcctatgaaattattttggtatttttcatagctatgaactcatattggcttagggtaatcatcatcttctaactcgtcagaaactggagtatttttgttctagaattttgcttttagtgtgtgtgacacagtttgctgatggattgtagcaacttctagaagagcaattgctactgtttcttatgttatataatattacatctagttttttttcatgaatttggagcagtattgtaaatatttgaacatttatcattattcatttaaattccacaaggatgaaaggcaccacatttggggaaatatttacattaagcaaataatataattcccttcatttatactattttacagtttattgagtcaatcaaaataaggtagaataagttagaaaaggtattactaacaccatgattatgccaaagtcataggatttacacagttacaaggaattatggcaagagagtactgtgagcttacctacagatgtgcttagtactactagtttatttctcagtacttaggaccacttatttcaggtgattttttaagataaaagtaccagatactctaaccagtgataaataagacaagggatctaatactcagttaaaaaaattataaggtttggctttgggggtcagctttggaatgggtaagaatgatctattttgacattcgttttttgtactatgcctaagtacatgtgaatctatttgtac

SEQ ID NO: 130438 - DNA, 1081 bp, Homo sapiens
ataagatgactaaggaatacttttttacaagtagataattgaatcatattaaatatatacataatatattatatataataaattacatctgtaggtacacacatctactttgtaaaattaagcataatcagctatttctgagtttttctgttaaatatataaatatggcttcatacttatacttaaaaaatattctagatgataacaggcccccaaaatttaacaatttgtggggttattaataacactagcagcaaataaaagactcatttattcaattagttatatattctgactggtatcaaacaattaattagatttttacaaagaatataaaatagattttaattagtgtattggtatgttggtcaaatatgttaatttctcttgcccagcaattgacttctgaagcaattaattacaagagatgagaattttagtgagtatttaaaataagtcttttatgcaagcatttcttccttttttgacaactcaaggcacttttagatcatgaacttcccttctcagatttacctttttaaatattctcttgcgtgatatcctggtagcaagaattgcctcatcttcaaaaacaacctcaagctctttagaataaggagcatcatttctgttggaaaataaccttaatttcctttgcccgtttgctgtctctctggagaagagagggcactgatcagccagcctatttttctcctcttttatactttatagtattaatcaatcaccttgtttaaacacaaaattcagtccaaagttactagcttgcttatagcaatattgcacttccaaatgcccttagaatatctcttatttactttctgcaatctcattcctttttactgctttctcaggcatctgctttagcattatataatcctatatatcactgttgtgtgttggtcttcttctagattgctatttaccctccatgtgacatttaatattgatgagacctccaaaaatatggaggttacatataagattcagctgctgtggcaagcaggagtgcaaatctttaaaacgaagatgtgctctatatttgaggcttatagttcccaat

SEQ ID NO: 130439 - DNA, 1029 bp, Homo sapiens
ttaaaattctaaaatgttcaacaaaatatgatttcccagggatctgaacaaaatagatgatttgatgcaagagatcacagagcaacaggatatcgcccaagaaatctcagaagcattttctcaacgggttggctttggtgatgactttgatgaggtacgtaacccaatatgaagaatgcaggattgtggctgctataaagagtagcttcctgtcatatatagtaggcatgttcccttactactgaaagaacaagtgatatttgtaagaaaggtacttctcttaagagaaaaataaagtgttagtacctctgatttaaaggaaagatgaatacagtttggcaaacagtggcctgattaagttttcagctattaaggaaagaacagcatgtgattgtgtaaagttagtgacttttagtggttgaagcctaaacagccccattacgaggaactgagtgcttgcacatctgggcaaaacaaagtagacttcgtcattctgcatgaaacagacgtatcatgctctgtagctgttaaattagaggttaggctgcctctgtttattactcaggctatgaaaccaaataaatgtggagtggcattattaacacacacattccatttagattaatcagtccaataatacagacagactataattataatggtgatgtctgcactgtgaatttcaattgttctgctcaaagcacacacaagtaggactagtacacatttagaaacatttccaaagcttggattagcatggcaaagaatccaacttcctgcatctatgtgatattaaaaataacacatttagcaagtaagacctggttccatggaatccccaaaaatgagaatggggtatcaataccttttaaaaatggtgtagacaaggggtcagcaaaaatatggcttgcaggccaaattcttcccgtgacctgtttgtatatcccaaaagctcaggatgggtttcacaattttaatgttgtagaaaacaataacaacaaaggagactatggggcagaagaaaacatg

SEQ ID NO: 130440 - DNA, 1031 bp, Homo sapiens
tcatcttaaagagtctaatgctctctttgttgctcctctttgtcttttgggcagctctaggccaaattgtagttcacttgtatggttatgcttttctgttgtaatcatgactttattttttatcttcttcaattttttttcctatttaagtcgttctattagaacatacgtattttgggagccaggtgcggtggctcatgcctgtaatcccaacactttgggaggccgagctgggtggattgcttgagctcaggagaccagcttgggtagcatgcatggagaaaccccgtccctacaaaaaactagccagatgttgtggcctgtgcctgtagtcccagctcctgaggtggaagaatcgcctgagcaccagaggtgaggctgcagtgagctgtgactgcaccattgccctccagcccaggcatcagagtgagatactatttaaaaacaaaaaacaaaaaaaaagccttgaaagaagatcactgaatgtggaatgcacttagaaatgctagctaatggtaagctataggtggatttttgactagagcacagtatgaagtcatgatcatggttttcagcctcaaattagaacagacctcacttgtcacttgtaaataatttacagaatattagatcagtgtcatctccacacaaaataataagcaaagcaaccaatgtatactcaataatgttttattataatagatatgctgagagtaagtatagaccttaaataatgtttgcagcctagctaactgtaatcaaagacattagcagcagtcaaatagtggctaaggtgtgaaatgtaaagccccacattgcggttattaaacctataactctggaggactctagaattagctgatctgctagtccacgcttctataatagttcctttggagagcagactgttcactggctaacactacagatacttatattcctcttctgttttgccacctcttagataggaatgataaaaactaaatacttgtttttacagctgcacttgcagctagctttgagcctgtcac

SEQ ID NO: 130441 - DNA, 1050 bp, Homo sapiens
gtaaaaaggagatcactttttaccaaataaccaaaaatttttagtctgtcaaagtgcacaggtatgttctcagaacatttttcacaatgtgtatcagaaatatgtttgctatccttagagacagaaatgaatataataaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaacagtagctgtgttgttcatatgttgaataccattttccccctccattttctatattctccctatcttttacaattattgtaaattgaattatatttaagtgctgaatttcacagatgtagaatgagtctgattttctttttaggtttacactttatattgctgatcattttttgaaagtctttgtgaataggtgcaatgcactttaacataacctatactaataattctaaaaattgaatgtaactgaaataacatttttgtggataatcttttaaccttttagaaataagtttacatatagttagtacaaccataaaacagcattttaaaatgtatctactacatcgagattagccatttacagcacatttatttagaaaaccatgcttagataaattatctatgtagtctagttcagtctgtgatattaaaagggaacagtggctttagatataaaaataatttggttttgaaatggattttattacttataggaacacatgagtttggggattatgataaaacaagtctgttttcccaactagcagaagaatctaaattttatcctctaggaaat

SEQ ID NO: 130442 - DNA, 1398 bp, Homo sapiens
tagattagattcttcaggtgagactttacctcgcccacctagaaaccagattgagacaaacaatctttcttgatgtttttctgtgttgttgagtgacttttattaataggctctttagggtctttgctttattcctgaatctatcactttttgtcacttacttcccaaaatgtacctgactcctcatttcttgtaccatcctggtactgcaacccaagtgtcaagattaccaaaatgctgttacagtagtatgtctactgagctaatacaaatggcatcaaccacagttgatattttttaagtgtaatcatgtatgactaggcaaaagtagattaaagagagtaaaaactaaagcagtagttgccaattattttttatcccagttctacactagagggatatcacatactcacttcaggcacactagcttactactgtaagtcttaagaaaaagaacttgtagttatgtccccctggtggatgggaactaaagttaagataccagtgacctaaaaagatgagggtagagaacaaatcatttggagtttcatactattattttgattatctgtgttctttgactcttcaataatgctcttgagaaagatactgcatttgtaattaattgtattctttttctgcatgtgtttagttttgtttgttgttttttttaaggcattctgtgaaactttagaagagacaaactaccgcttacagaaagaactacttgaaaaacaaaaggagatggaatcactaaagaaactgctcagtgagaagcaacttcatatagacactttagagaacagaatcaggtgtgttgtgatacttgcatttctactctgactaattcaacccttaatactctgggctaactgccctttatattttaatatgatttaggaattttctgattctgaaagttgtaggcttttggcatacttcattgggaaaattatgctttatttagcataattttgctaaataaattttgaacattgaaggatgggaaacatcaggaaaataagccactaactgttcaacaaggtaaacattattcattttaatcattgttaaatcattattaaataaataatcattattaaatggaataccattattttatttaagtgacatcttagtttctaggcatttatgccagcttttcacatatgaaagctctggtttgccatctcatcagcatatcttgaattgatactaaagtcattttaaattaatcatagctactgattttctctgttgacttccaaagtgagctatttattagctatgtaactacattaaggcttaacagctaaagactgctatagctacctgtattcacaacattaaacatatgcctgttttgttcatagaaaataacttgttgctataacatac

SEQ ID NO: 130443 - DNA, 1035 bp, Homo sapiens
ttacgtcaaacctaaaacatatttgaaagtttagtatgcagacttttttcctccaatttgtagcagcatcatctacccagaacctgtgagtcatctttaacacatccttcactacccttaacatttcccttgcaagtaccactcaagtctgtctacttctctccatccctgccatcactaccctagtccaagcacgtatctctcaccttaattactgtagatgctttctcactggtcttcctcctcccctcttactactatagcccagtagagccacagtgatctttgtgatgcagtttgacttattctttctggtccctgcctgcctgccttcttttcaatcttaggttttgttattcctgcccacctccccttctctgtacatttgccatattggtcttcttttaattctccaaaatcagcttgctccttgtttctcagagccttcaaatatgctatttcctgaaaaggcagcctttcacactactaccccatccaaccctgacctcgtaccttacccatccttcagttttcaacacaaactgcacttcgttaggtaactggcctcctgactgaccactcaccaccactaccaccaccaccaaacactaggtcagttctctatcacagagtctgtaccatcccttctcaactggctctgatgctttaagacaccgttcatcacccacaggtaatgaattaacttatttcctatattctaagatgatactagctatgtgccagtctcaatagaattgagacaatcacttaaatcattatcagtaggggtcagttctctcttggaatctcagttgagaaaggctaattggtacttcactttcatagcatttcagcttataattatttctgtcaatatttgtctttctcccaccagattgattgtaagatgtttaacaacaggtcatgtggctattttattcaccatccaatctaatgtttagcacagcactaacatagttggttctcaataagtacttcttgagtgaatgatataactattgatattcactgata

SEQ ID NO: 130444 - DNA, 1052 bp, Homo sapiens
actcttataacttaggcaacctaatttttttaaagggaaggtgctaaaaaatttaatacataattcaccattgaagatactcaaatgcaaataagcagatgagaagatattcaacttcatttgtcagcaaagaaatgcaaattatagccagaatgaaatggttctacacccccactaaaatggttaacattcaaaagatggacaatgccaagttctggcaaggatgtggaaagactggaactcttctgtatacacagctggtagaaaacaagaaataaaacaaggcataaaaagcttaactgaatttaattcttttattttaaacttatttcatgaataatttcatgtagtcaacaggatagattttgtagaattgatagtgcttgagttaaacattgtatttgctcttttcttctttttcagttaaaagagatgtttccaggttttcgactagcacttcctccaaaacgctggtttaaagataattacaatgctgactttttagaagacagacaattaggattacaagcgtttcttcaaaatttagtagctcacaaggacattgctaactggtatgtaacgaattgaaataagagattataaaagcattccaataactggcgtaaattaaagaataaatctatgatcatagttatttaagcacaaaaatacagggttggagtataattacttgtcttctttaacaaagtactacaagagattttcttgctttctttcaataaggactttatttgacatttcatttttatcaaagcttattttaaatagtcagtaaagtgaaaaatccagtgtaccatgtactaaaccacccaaaggtaaacttttagtattttgtattttagcaatgacttaaacaaaaccacttacatattagtaaaattttggttaatatgatactatgtaattgtaagggtaatattctttatatttctccaaagtaatgcaaaaatattaaaattgtgaaattggcttaatttacatagaaggtagagtgaaaataccaaacagcattaaaaaaggaaaagaacaga

SEQ ID NO: 130445 - DNA, 1009 bp, Homo sapiens
aatacgcatgaaggtaaagacggtaacaatagacatagacactgggaccactagatggaggaggtagaaaggggcatgtgggctgaagaaacacctgttgtgttctatgcttagtgcctgagttatggaatcattgggaccccaagccttagtatcacaattacccatgtaacaaacttgcatgtgtacccctcaatctgtaatgaaagttgaaattaaaaagggcaagtattaaatcctccaacattcaacataataaagttttagaggtaactttccattttaccacaggggctatgaaataaataatttcagttttaaaaaaatctctatttgatgtatatttttatcagccttattcttataacgtgtgcttcttagaaaaatatctggtctaaaaagcttatgaaaaatcctaactgtccttgaatgcagtgcccatattttgtcaaaccagtaaattgatctaatccttaatttaccacattctaagagaggtaataaaatatagtgcaaatgcaggagtaggggagggtgtgtgaacaatatagaaaagagtctgacaaccatgtcagggtacggcaatgcttaacttggtgaccaataacagagaaagatcaaaatgaataccttctaatcattggtctgtaccatggaagaagacatagattgttacatgtagctccaaagggcaaatcaggttatgatccttcttaaagttaaacacaaggaaggggaatatcacactctggggactgtggtggggtggggggaggggggaaggatagcattgggtgatatacctaatgctagatgacgcgttagtgggtgcagcgcaccagcatggcacatgtatacatatgtaactaacctgcacaatgtgcacatgtaccctaaaacttaaagtataattaaaaaaaaaaagttaaacacaagaaagaattcttcaataatgaatgcaatagattagcccagtgacccaggatgtggtctccaggactatcctgct

SEQ ID NO: 130446 - DNA, 1051 bp, Homo sapiens
taatatgctttttgcttgaattctttcccaaacttcagagtgggaattgattgcattcatacataatccatgtgtttagagaaaatgtttatacacattttgatagccatatgctaaataataagaggagcaacacatttctgagtcatttcggaaattattaacaggtgggagtaaggaacggctattttttcattaaatcaagatgagagggaaagaaattgatgtgtcaaatgaatgcaattccatttgtacttcccttccgtgattagataatagtattattttatatgttggaggaaactgagacttggagctcagagctccataggtggtaaagggaaatttgacatgtaggaagtcttaactgacgactcatgttttttttttttttcctacacagatatgcttcatttgtggagatgatttttttgtttcttttgtttttcctaatataaaacaactgttatgtatttattcttgatacattacttaagatgtctgtagtttggcaagttttcaacagggagtgctttccactagtgagtgctttgagcagaaacaaaagaatattgccccacacagatactcttaactggtcctgaaaggacctttctgtgaccatgtcatcacacatctcttcaagacgggttttctgaagagagccaatgcatggcatcacatttgtgagttaccactgttgctctgtggttgggtcagaagagacggttctctgtccttagttgctttgcagagagcctgggaaacacattcagcatttacttactgagtacaaaatgtaatctctactcttggagcttttgcagtgtgatgtggaaaattagtcttttgtgcaaggaaagctgaacagctaattctttcataacacagagctctgtaaatataggtgtcttgtctgtctaccaacatctcaccatcaacatcataacacctcacaattttactgttacacatatttgtatgtgacatttatcaagctcattttatgttagtaacataaaacacatataagtgtaacatattatttgag

SEQ ID NO: 130447 - DNA, 1146 bp, Homo sapiens
atacccactgcttagagttattgtgagaattaattgaggtaagaaaactgaggctcaggttgtcatttgctcaaatcacacagcaaaaccgtgatagaatgcagattcaaactgggatattaacattccaaagcctttacagttattgactactattcagcactgccttcaatatatgctgatgactgcacacaggagttagaaatgcccactgtcacttgcctgccttgagcggtttcttgtttgtataaataatccaaaatacttggttgtgttgtaagaagcaccgtgttttgtgagacatttcaaaggtaccacaaataggaaagatttcattctagaatgaatagagcacatatttagtatctacgtgctgtttggttaattttagttatttggtcatgcttttaaaatctatttttatagtatatattttcttttatagcatatcagaattatctttagattcaactcttcatgccgtcaatcttcattgcaataacatctccaagatcgaagccattgatcatatttggaatttacaacatctagatctgtcatctaatcaaataagtagaattgaaggactaaacacactgacaaaactgtgcacattaaatttgtcctgcaatttgattacaaaagtagaaggtttgtaagtgattttcatttaacacttagcgtaaggaaaatgatttaggtccatttttttccccaaaagaatggaataaatatcagaaactcttaaaaattgagtctgaaactcattatacaaaatattttctccaaaaaagtgtcaattttttaaaaattctgttttttctaaatgccaataaaattgatttcgctgttaccagactggatttacttcagaacagtctgaaataacattgtaatgctatatctctgtaattaattatttaaattttataaaggctttattttattttactttttttttttaggacttgaagaactaattaatctgactagactaaatgtatcttataaccacatagatgatcttagtggtaagtagaaatgcttatgttttctgtatgctaaatgttgtgccacatgtgataagttaacagctcagctaaacatgttggaaatctctgaatattaatctaatttttagccaaa

SEQ ID NO: 130448 - DNA, 1034 bp, Homo sapiens
aaattcatcacagctgcagtgcctagaaggtcttttggataatttagtttcttctgattctcccctaaatataagtgaagatgaggtatagtatttactttttttttcctaatataaaaaataccttcaaatttcaataagtgaatataaattaaaaggattttggtttgtttctgtgtcatagatcattgatagaatgccagtgataacagcacctatcgatgagttagttcccttggaacagtttgcaagtacaccaagtgatgctgtgttgacgtcttttatgtctgtgtgtcaatcttctgagccagagaaaaataatcatgaaaacgatttgcagaatgagataaaacttcagaaattagatgaccaaattctacaacttctaaatgaagtaactatttttcctacttctctatagacatgtttattgaagaaaacatagttaagaaaatgtaaaataaaaattatgtactagctgaccaacctattttagtgcatcagtgttcgtgtatttttgttttcctctacagaaatagggttctattattgcataatggtagtaaaaggtaacataaatttttcactcactttacttgtcttcctttacatcttcattatgtaatttctttgtcttgttctgcagtactttacattacttctattacacccaacttttatttccaccgtaagcaagggagaaactctttggactcagtgttacttaacgcaaaggaatactttggcctctactatctcttcagtggtttaatggtcaaaatcacttctacaacttatagctaaatggcaggttaatttacatagttcctgtatcaatttcattttctagtagaccatcacctaatcaatctatactttcctgagctgttaatccttctttaccctgctactgaatctctagtttttagaatctgtgaactatgtgtatgaactacaattcctagaatttactgctattcaggtctccaaccctcactccagcattctcactatcatccacagtggcagtggtt

SEQ ID NO: 130449 - DNA, 1405 bp, Homo sapiens
tgtagcaggcactgttctgcacttacctacatgctttgctaccagtaacataatttttggcccggcgcagtggctcacacctgtaatcccaacactttgggaggccgaggtgggtggatcacttgaggtcaggagttcgagaccagcctggccaacgtggtgaaaccccatctctactaaaaatacaaaaaaacagccaagcttggtggcacatgcctgtagtcccatctactcggaaagctgaggcagaagaattgctggaatccaggaggtggagtttgcagtgagctgagatcatgccactccactccagcctgggtggcagagtgagactcaaaaaaataaaataaaaagtttcactgtagctctttgaagtaggtactattattcccctgttataaatgggaaaattgaggctgtgagaagttaggtaacttttctaagttcacataactttgttgttttctttcagtcccttgttgaacagctagaccaagagagagagaagagatggagagctgagcaagccgaaaataaactcatggattatattgatgagctgcataaacatgcaaatgaaaaagaggatattcatagtctggctctacttaccacagataggtaaaaagaaattaataaacctgaagatacctcatagcataaacaatactgactttagaactggaatacattagtttcagtgtggttcaatcaacaacaatgtatgtggttttagtttgatttgaactaattttattagacaatttagcactttattagcttgttatatcaacaagaaattcaggtacatgtatttgagccctcaagcaggaaggtgtcagataaatattataagtaaagaacagcaagagactagagcagtgattaacaaactttatgtaaagtgccagattctgtaaagggcaggcattggcagcctttttctttaagcttcatgggtcatatttgatctcatcacatacttatcttctgcaatgggcttttgtatcatatagcccagtttcttaattctgatgtttttattctatcctcaccattacgtctcccattttatctgggttttttgttttgttttgttttgttgtattgcattctttaatacaggtctgtcatttcattctgtgaaaataccagttttttaaattacaataactttttttcttctgtttcctgtaattatttctaacgtcatgcttttcctcaaatgattataacatgtttagagtttcttatggtttcttacccttgaatgagcactaggtttttagacttgacatttgctaacacactttgggaagttgctcttggttccatttcttgtctgattgtgcagtggataattccccttctaaaatctgatttggataagttgatgtacacagtt

SEQ ID NO: 130450 - DNA, 1031 bp, Homo sapiens
tatcaaacaggagttgagagcatgaacaaaggaagaccagttcagagagtactctcattgaagtcaacaattttatcatttttatatgtgtaatatacttaacaccacatataacttctgctttaggctaaaggaaattatttttagagagagaaattccaaaggacaactcgaagttatggttcacaaacttcaaaatgaaattaaaaaactgactgttgaactaatgaaagcaaaagatcaacaagaggatcaccttaaacacttaagaaccctcgaaaaaacattagaaaaaatggagagacaaaaaaggcagcagcaggcagcacaggtatttctctattttaatatatgagtagcacagattaacacaaattcatagcttctatcgtgaaacaaattatactacctagaaaacctaaaagatgtaaggccatatgcaaaaattaaattgctgttaatttaacggtcacatagcctgttgaattatgtctaaattaagactactagctcttaacacaaagcaattaaaaagaaaagttgatggaaatgttgcaggtggttaggcttttattctgagagagctggctttttaaaaggctttcaggtgattgaaggaatttcattttcatgctttctgaatggaaattatcattaaaatctgtgatgcaaataagcaatagttaatgctagtgtatttgttccttccaaggctgcactttgtgtgactgtaacatcattaatttattaaagtttgaaaatcaacttagtcaccggacactgtcatttaaaaggtacttatggaaactgacattaaaatagcaggggagactattatctaaataatgtaattgtgggtattttactcagataagactgatccaagaggtggaactcaaagcttcagctgccgatagagaaatatacttacttagaacttcccttcatcgagaaagagaacaagcgcaacaacttcatcaacttcttgcattgaaagaacaggaacacaggtaaatgaaaaatgtatcagg

SEQ ID NO: 130451 - DNA, 1039 bp, Homo sapiens
aaaatacagaaaattagctgggccatggtggtgcacatcctgtaatcttagttacttgggaggctgaagcatgagaatcacttgaacctgggagccagaggttgccttgagccatgatcatgccactgcactccagcctgagtgacacagccagaccctgtctcaaaaataaaataaaaaactatactcctagactcaaaataaatggggaaacagagtactctaactttcagaaaatgaaagtgtaaaaaacattagtgatatattatcctaacctaatgttatcctaatagattctgctggatgatgaactacttacttatatctttagttaccctataatagcctttgatattttcataatactgagttatgtttccattagtatgaatgtgagccacccgagaagaaataacatcctaatctttacattcacaccacatatacacatatatatgtggatgttcttgtttttttaaggaatgcaatggaaaaacttcatagtatggatgatgcctttaaaagacaagttgatgcaattgttgaagctcatcaagctgaaatagcacagctggccaatgaaaagcagaagtgtattgattctgcaaatttaaaggtattgtaagtaaaattcacttcaataatcagtatattacatgattatagctaaataaattagatcttcgagaattataaagagaaaaggcaacatgatctcatgaccaaatagatataaagaatgttaccaaaactatcctaaaaccagggtaaaacgttggtaatacttagattaattgtagaacataattctaatttctaagcaaaacttgtacatttgattctagtgtgtactttctctgctctctggataaaaatttcatatctaactaatcttggataggagtctctttggttacacataggcagggtgagaatctgaaggtattaaacataatccatcaccaccttggaaaaagttatcagagtattagggttcaagactatcaactttattatctcaatattattaataaagtaa

SEQ ID NO: 130452 - DNA, 1780 bp, Homo sapiens
aaaaataaaaaagttagccgggcatggtagcgggcacctgtagtcccaactgcttgggaggctgaggcaggagaatagcgtgaacccaggaggcggagcttgcagtgagctgagatcgcaccactgcactccagcctgggcgacagagcaagactccatctcaaaaaataaataaataaatgcatataaatatatgtgtgtatatatatatatatatagccatgtctttttcacaagtttatgaaaactaagtagataatatattaatgcatgaaagtactttgtatactgtataaatactgtatttttcctattagcatttgagcaagttacattttactgacatttctttaaatacatcacaaatttcaaaatgtgtaagaataaattttggaccttttctttcagaatgcattttaaaaatacattttctttaagaaattaaaatgtaaaatttacatgtcgatttaggtccatcaaattgaaaaagaaatgcgtgaacttttggaagaaacatgcaagaacaaaaaaacaatggaagcaaaaattaagcaacttgcttttgctttaaatgaaattcagcaagatatgtgatggttctgagaatgaatttaattgaaatagaccagcagacctattgtaaaaatgattaaatattgtaatagtagtaactgctatgactttgaaatgtctctttctatacatttcattatgaatatatttttaaagacttttgatcaagtatttattaattgtataggttttttataataaattgttgacaattttgtctattagaaaaaactatcataactagacttacaatatttttcttgtttctgtactatacattgtttggtaattacacatttgcctacaaatttgtgaatgaaaagattagtattttcaccatatgaggtaaaacattttaatcattgttatcttattgtgatgatgaagaactaattatatttgttatttaattgatgtagctcaattcttttaaagtacttatgtagccaaaaagcatttgaaatctgtatgataaaagatgtggcattcttaagaaagtatatgtagccatctccacatcactcattatgaccccttcttttataatgcttatatcttttcattaaagattacatttaaggttttataaatattgtctgttcctgaagaggaacaccactgttccaccttcattctcccttctaataactgtatatgaagaaattctgataatgtaactggaagcagtaattcatttcattccataccaggtcattactgtattactgtttcacttttgtcacatcatatgctagtatgcagaacaaaagtcttaagtactatgcccctcttctatttctgaaaggaagaaaatatatattttcttgatatcagtactgaactaagattttaaaagtaaatagaacaaaaataatttaagtgcttcataaagagaaggccccatttcattatagataatctttgtgttgaaatttgtgagacaacatcaaacataacaacatgtataatgggagtcttagaaggggggtaaatatttggagaagtaatggctgaaaactccctcaatttgatttaaaataccctacatggctgggtgcagtggcttatgcctgtaattccagcactttggaagactgagccaggagaactgtttgagcccaggagttaaaacactagcctgggcaacatagtgagccctgtctcttaaagcacaaacaaattaaaagaactacaaatacaaggtttc

SEQ ID NO: 130453 - DNA, 1293 bp, Homo sapiens
aagagcgaaactgtgtctcaaaaaaaaaaaacatggctcaacatagaaaatcaattttaataaagctgttgtagtataacttaacaattaggaagcaatagaaagacattgaaagtgatgtgaggaaagtttattcattatctctgcagcttcacctacaccatatagtctcatttacaatagtggaggtgggatagttattatttctttattccagtgagataagaaattatatcatggttatttcaagctacgtggtttgccagtttatgctgttaatagctaatatacatcaagagcttaccatatgcaaaacattttacatgtttttagctaatgttatcctcttaacaacagtgaacatttcggcagaacagccccatttcacagcgtaagaaactgctagttaagtaggccaagataggttagataacttgcctggtgttgtacagtagaaagtgagagctaagatttgaaattagaccatttattgttattctctatgttataccatctttcagtagtcttcaaaaataaatgtatgtaggtaggtttccatttgcataagggcatggaaaaatgcatgattattcttactcctctgcccaaggtggaaaagaaggaggtactgtgctcctgaaaatgaagctattggtgacatattctgtattattgcataaattaaactaggatttcacttgttcacagttaagaatttgaacaactgttaagatagtcatgactatgtatctgtatgttgttttgaaaattcctattaaatgtaagttataactaaagttctacattttatttgccattttggtgtcagtatgagcttttttaagcatgatgaagattgcttatctcttttattataattctttaacttaataaattacctgaattatacctgaattaatgtgataaagtatggtgcgtcttatctgacaggtccctgatgcatacccgtttatgagcctgatttagatacatcctgggataaataaataattgaagacactagtttggccgggcccggtggttcacgcctgtaatcccagcactttgggaggccgaggcgggcagatcacgaggtcgggagattgagaccatcctggctaacacggtgaaaccccgtttctactaaaaatacaaaaaaattagccgggtgtgatgactggtgcctgtagtcctagctactcaggaggctgaggcaggagaatggtgtgaacccgggaggcggagcttgcagtgagccacgatcacgccactgcactccagcctgggtgacag

SEQ ID NO: 130454 - DNA, 1038 bp, Homo sapiens
tccccgatcccagtgctgatgagagaataaaaatcaaccagaaggaaatgtctaacctttctccctacctggtctactaatgtacctatatctgtacccaggtactctgctggacttcagttattaatatgccctgttattatctaaggacagtcctcacttattgaattcacatcctgccttccctacttattgccacctctagcagtcatcccttctctcttctgcattgttaatgattcctctttctttaccagatcattcctatcagcatactcacatgttgaaatagctcccatctttaaaaggaaaaaaaaaaacttcctggagaccccacagttccctaaaaatattgccccatttcttcttacctctttgcagcagaactcttcaagagttgtctattctagctttctttccattctttcttgaaatttctccattaagactttcagccccacctctctgccaaaacagctctgatcaaagtcacccatgatctttccaaaggcaaatcactgatcagttctcactaacttgctctgacagcaatacttgatatggtcacactttcttacactctcttcccttggattccaagaccccacactttctgattttcttctgacttcagtggcaggttgctccctcatttcctggaccttaaacttccccagagttggttcttaaccttcccttatatgctcacctcctatgtcaaactagtggattccatcttgtggtataaactgtctattcgctgaagactactgaatttatatctctagcttggatctctcccctaagcacacactctcgtgtccagtggtcttgctttctccctgtggatgtcagaaggttcaaggccagtttctttatttccagtgctccaaactggttccttctgtagtataccttatttgtaattgctcttatcaaaaactgaagtcatttctgattcctctctagggacctgctgcttgccataccttcaaaatatatccagaatgttaacatttttcaccatcttcatagcta

SEQ ID NO: 130455 - DNA, 1034 bp, Homo sapiens
ttcgtttaaagatgagatatgatgtgtccacaatcaatccttgatactttctgcctaacatgaaccccaaaatagttcctactggagaacaggggtctaagtcgtgtgtgcctatcaacaatatatattgggggaaaaacattattatatataatacatataatatcatatataatatataaaatatatttatatataatatataaaaacattattatatatataaaaacacatatccatgtgtttcttacaaaccaccgtcttctctcaggtatctgtgattctcttagtttatgaacttacctgtactcttaaagaaactaaccacattttaccttgtagcacctcatgaaattttgactaatgtatacaatataatttacttttcacattttcatgtatttggtgaacaagtccatgatctcatttgttatttcctttgtatggatcagagccccttaacagtttgagaacaatgggagttttcaagctgtgttctgtggagctctgaaattcaaaagccattaatctattttatcttggacttcgctgccctgctttacgagatgctggccattcccattgccccaaccatggttatgtgtgatatatataaagttttctgtatattatggtattttgacatctccataaacctttctggctgaggagagactgcccatcctgggactagccacttcttagaaacagcatgggctcatgtcctttttagggtcatggatgacgctggaaaccatcattctcagcaaactatcgcaaggacaaaaaaaccaaacacctcatgttctcactcataggtgggaattgaacaatgagaacacatggacacaggaaggggaacatcacacaccagggactgttgtggggtggggggaggggggagggagagcattatgagatatacctaatgctaaatgacgagttattgggtgcagcacgccaacatggcacatgtatacatatgtaacaaacctgcacgttgtgcacatgtaccctaaaacttaaagtataat

SEQ ID NO: 130456 - DNA, 1145 bp, Homo sapiens
tcactgcagcctcaagtgatcctcccacctcagtctcccaagtagttgggactataggcacgtgccatgaatgtctggctaatttttttgtattttttgtaaagacggatttcactatgttgcccaggctggtctgaactcctgagctcaagcaatccgtccacctcactcagcctcccaaagtgctagaattataagcatgagccaccatgcctggcagataatgagtcttttggtcttcgtctggagtttggaagtttaaaagtaatgccaggcacagagtaagcgctcatgaaaacaacctgtccacaaagtactagtactttaaataaatgtgcatgtcagtcaagctgctgctgtgactacttgtgtttaaatatgagtatcttttactgttaacagaaatataacaaaactttattactgtttccagcaggatctattagtggagatatcattgatgagttaatgtcttctgacggtaagtaggttaaaattttactaactcacttatcagtaatgcttctgtggaatttataagtgaaacatgatttaaaagaaatgaacatatatttgctacctgctttactatgaagattcatgaaaattctcccttaacacttacagtaagtaataggcaaccttcagaatttatttttctttgcttgcattttgagggaaaggaatccatatggggatacttctcaccttcattgaaaataaactgttagccctttccactcctgaaggatctggtccaagaagagtaaaataacttgtctaaatcaagcaactgatctgaacacctgcctttgtaaatacccctacccaggccaatttcaagctgccaatgggaagtcactgaattagtattaatattaaccatgttgtcatctaacctgaaaaattattaaatatcagttagctacaatatgctaattactttaataatttctctccttctgtaagttcttggatcagagtcctactacctaacaaataaagtagaaacctacgaagtggtagcagttaagttagcaaatgttatagtaactagagatgtactaaacatgtatgtagaagcagagaacatcagcaaactttgtaagtccagttcattcttctgtttgcaaagtggaaaacaa

SEQ ID NO: 130457 - DNA, 1048 bp, Homo sapiens
gaacctctgcagaaagaactggtaagcagaaatcatttgcttttttttatggctaacaaattgaggctaataaattaaactcccaagttttcaaagcctgtaagttgagtgtaatttttagtacttggctctctagtactaggctctatagtataaatagcatattcagactctaaaacattgtcagaatatacagattgttctacttccaaagatatgactagaaaaattaaattgaataacagcttatataagtcatttgtctgctattgttgtctgtgtttttaaatataatactttctcctttcagattcctcagcagcgtcatgaaagcaaaccagttgatgaagctacaagattaatggctctgttgtaatatactggtgatgcatctaattctccacaaagaccaataaattgaatgttttatacaattttatttttaaaaatcttgttaatgtacaggcattggcacattttaaaaacaaactacataaacagatctttcctataacctaggaaagtggaatgtcagaagtcaacaaaatgtgataaacttaaagtgctaaaacagaaggcacttcacaaaatctgttcactgaaacagttatatatcctcgtttacatccttcactttacaagtggcagtgaacgtctgtttggatagaaggacatacagaaatacaggcagtttagtggcagtaaaaatataagacaagtaatgagtccttggccaacttgtttttgatgacctgtagtgtcctttaactttcctccttaagaagaaaaaacagaaggattcacaattagaagaaaagttgaaatccagaatatagttacttttgggagtggggacgtttgtggatattaaatcacttatcccctaaagcaatcagagccctttgtttttatggttgaagttttgtgaagtaaagaaagtattagggaagaacacttcagaatcagtgaactaaaaaaggtgttacattcattattttaaatatttaggttattaagaagtctaaaatgttacacagttagaggtaga

SEQ ID NO: 130458 - DNA, 1003 bp, Homo sapiens
gtttcagtagtagatggagtcagctctccaggactcagtttaattataatagtccatagaaatctaacatttcatctttcaactttcatgagctagcggagttaagctttttggttgaatagttttatgattttataaatgctaagaatgaaattaagcagatgatgggggttttggggatgacagtttatataggacggtcttcatagttgacacattgaaaccaagactagaatgacaaagagctagcaatgcaaagagctaggaagtgttgggagtggtgggttcgaggcagagaaaaatagcaagtgcagaggccctgagctagggaaaagcttggtgtatttgaggaagattattttatttggacaggaggtactagaacttttatatatgccaccaggtaggatctaagagagagatctatgggtaggctgcataaggtgcaaaggaggtaagggttttgaaggagaaattgtttggcagcagcaacagtgaagaagaagagcaccacccctacctctgttaaactcaagaggaggactgcgagggaagctgtcatcaggggtcttccattaagacaagaaggtccaggaaggattcagagacgtattgttatgttagaagggactaaaagtatttgatccaggtttcttgtatagatgcgggatgacagcactgtagcctagaaagattttggtcactgtaaggatacaggaaaaaagcaactcagtttctcttactctcactctcatacggtcactcaacacttccaatactagatttgtggggcagttcccccacacctaacaattctgcagatgaatcttcagcaggcagcagctgggtgtcctttaattaaaatctgacactgctgacctggagatagcgtcagattccacaggttgagagttgagtcctaagcctctccccaacttccagtgacaatcacaagtcccagatgttttacctgtgcttctcaccaaccagttataaataagtg

SEQ ID NO: 130459 - DNA, 1028 bp, Homo sapiens
acctccggtgcggcggtcttcactgtgcagtctcagaagcacctcgggaagtttctgcacaagtacccacgccagcaaggggagacttggctggctccataacgccccaaactcgcttgagctgaggataagtctgcaacaccgcggaagacaagggatgctaatgagactggacttccgaacctcgctctatgggtggggcttcgctttttcactgcaccttgctccttagacttggctctatgggcgggactacgccaggtgggtgggaactcactctatgggcgggacttccgcctatggacggggctccgttcggtgggcggagctacggctcgtgagcggaatcctgactggttcatcctccccggaacttcctagacgccgtacgtgccagatggtgttacctggagcttaaaaagctgcacgcaagtgttaaacttctggtgagagtttaataaattaagttttctggagggctggcgtgaagtttgcaggggtcggggttggattgggccggtctcgtaccgctgtggcctgtaggctcggttccgtcgcgctctgcctcaggcagccctactgggtagcaggcccgaaaccccggtgcttgttgggctttcatctcctgacggggtcccagttttgggctgtgtctttcatgatcagtttctacgtggttttcagagaatttccctccactcgcacacccccactagtgtattactttctccacgaaccttgctcaggtctacagctctagtaaacctctccacttgtagactgtctgttcatggtccatgtgtatattataggtagtgtcatgtacaatatacctatcatgtctgtgtatgttccgtatatatactgtcattatttatgttccatatatattttttgtgtataaaatataggttctctaccacacgtggcatatagcaattgatttatactagatgaatgattggattttggttactattgtaattattttattttaatttttatttatttatttttgagactgagtc

SEQ ID NO: 130460 - DNA, 1052 bp, Homo sapiens
agaagtgaaatatgactcttccctccgaccacttagtatcaagtatgacccaagctcagctaaaatcatcagcaacagcggccattccttcaatgttgactttgatgacacagagaacaaatcaggttggcttttctttttttgtgtgtgtggtggtggatgaagggtttgaatgattagactatactctttttttttttttttttttgagacagagtctcgctctgtcgccaggctgaagtgtagtggcgcgatcttggcttattgcaacctccgcctcctaagttcaagagattctcctgcctcagcctcccgagtaactgggattacaggcgcacgccactatacccagctactttttttgtatttttagtagagacagggtttcaccatgttggccaggatggtcttgatctcctgacctcgtgatccgcctgcctcggcctcccaaagtgctgggattacaggcgtgagccaccgcacccagaatacactctctaatctttcatgttttgtttttgctagacctggaatttgtcaaattgaagcatatttttcttcgtgtgaattaagatatcttgttatatatttgaaccttcagataatcttaccttaaaataataaagagtatttggaaaaggatatgttgcatgataatttaaaattgaccttagcttgttattataacttcacttagcatttaccattataaaaatattaaagtttaatagtttttatagatatttcatgatttgtttctgcaaagttttagccgtaattattttagcattatttgcaaacctataatgccatttaagtacctgctttaatagaaaaagtttagtttaaaaaaaacttattctcttattttaattgccaaagtaatatccactcatagtaaatgaaacaatatggaaacatataacaaatattaatgtctctttcttcccacagtctctcctgaagtaactaatgttatttcttccataatatttcggtgcttagttatgtatacatacatgtgtatcatccttgttttgcattttcttatt

SEQ ID NO: 130461 - DNA, 1839 bp, Homo sapiens
agattttaccagtccttatcttgtctgtgacttacagactctcctttcatcttcgtgttctttttttaaaaaaatttaattttgtagtttgctccttacctttacgacctttaaatgatcagtcttgttcacagtcctttctttgctctgccgatttggagttttctctgctgtggtaaatatatgaaaccttcattaccaaagaagagtagtgtctgttataattttgacatttttactctttcagaataaaatattttccaggggcttgattttgccttctttttctatttgataagtttaacaaatttttttctgtgtgtgtgtaggttaatgtggaacaagattttgtgtttctgctttaaaatgttactggtaatagtagtgggaaaaaaaatcatgtccaaaattatctttgttttccccgtttggtgtttttacctgaaatagttggtttacagttacctgcattttttttttttaacaagagttcatgtttatgtgtaaatccactttacctgcctcaccaaatctgtgtgtattatacaagcaaaatgcaccttttaaagaagaaagtcgttcttttattgtgtgacttgtttttagccatcaagtagtaaattagctgcaactagaaatgatcatttttcataaatggttagtattttaaaaaatggaaagtgtagtggccaagtattgggagctactcagattgagaattgtaaagtatgtggaatagttctttgggacatagcttatcaacattttcagatagttcttaccttaaaatgtgaaactgctggtaagatctacatcagggttttgaaaagcaataattatgagctaccggcataatacaggatgtcgcagataaagtttctgccttcaaagagatggtaatctttgctgtttaccccacggtggctgaaatttcctttacttccttgtacagttgttaagcatttactgcataattgtgggaggtattttgggaaatacaaagatgaaccgattagcaatttctgccttcacactaattaggtagatagtgctatacacaaatgccttatttgtcttttaatatataagtttcataaatggtaccaaaatcctctcagaagtcaacttcaaagagagtagagctcagatcttacttggcaaggtagggataagagggttagtttgtagagctcctggcttctgaaatcgtggttttgaaggacgattatgactttggataggcaggaaaggtaatcctagcagagaggtatctctaagagagcacagagttcctgtttggggaaaggcaggtaattatgtttgggtggaacataaacttatttgtaccaggataaagggtgataaaacttgaagtaaaaatttggaccagtttatgggttgtttttaatgccagacttatgaccttggatttacccggtggtggggcttccacagatgattttgaattgggagtgaaacaatttgaacactttgtttcagaaggattagtgggatagaggtctgtagtgtgaactgaggtagggagaccctggaggtagaaagacctcccagttgttgtagtcatggatagtgaggatctgagctgtggtgcacgcgaatggaaaggaagaaaggaagtcgaatagccaaaatttgatgagagggcaaatgaaagtaaaaataactgattctgatccaggttggttgggagaacagtggtaccattttgagcaagatcatgaagctttaccctcagcatatgtgtgctactttacaactttttggagattactaattcttggtaaaatgctggcctggaaaatttccatatgcgcctat

SEQ ID NO: 130462 - DNA, 1046 bp, Homo sapiens
aacttttgtaccgtgtagaggtaaacttgtcagttttttcctttgtgttaaaatggtaatctcactgcagtggctattggtaggtgatatttaaatttgtaagcattgtaccacagaatagttattctcctgtcaaggataaagcaaaagttgatttcttatctggaaaagtacattggtgaaatgtagatatttatttttttgaaaattttgaatttaattctgttgcttttacagatgaagtttgtgtttcccttttataaaagcttagtcttcaaaaatttacattttttgaggatataaatgaggatctaatttccaaaatatatatagattgggtatccctaattcaaagtttgaaatgctccaaaatgggaaactttgagccacctacattactcaacagaaacattcactggagtatttcagattttggatatttggattagggatactcaacctgtatcatgatattttattatttttgtattagatcataagctctaccattgaaaaaaacccaaagatattaaaaagccctccttagtggatgcttcaattcatacatttaaacaacttttttagggaatgtataatgtaaaaccatacgtcagatggtttttaagttataaggaagactagcatggtttttaagttataaggaagagtagcatttgttgatttagtcttgacatttcttttttctttttttttttgagacggagtttccctcttgctgcccaggctggagtgcaatggcgcaatcttggctcactgcagcttccgcctcctgggttcaagagattctcctgcctcagcctcccaagtagttgggattgcaggcatgcaccaccacacctggctaattttgtatttttagtagagacggggtttctccatgttggtcaggctggtcttgaactccagaccacaggtgatctgcccgcctcagcctcccaaagtattgggattacaggcatgagccaccacgcctggccgtcttgacatttcttaaatctacagttcactcacagcacatactggcg

SEQ ID NO: 130463 - DNA, 1057 bp, Homo sapiens
agctactcttccttggagaggtgtcattatagtggagagaattctctttccttctagagactggaatggtaatcctctcttatggaaatacaatgaataaggtgctgcttctcctttccaagaacaggtagattcattgattgctatctgggtttttctcgcattatcacttaaccttatccactatcgctttattttagtcttagcagtattttttgtttgtttgtttttagttcaagttggctgctaagtaatgccatggttaaaggtgaaatgaagaaaatgagtgtttagtttttattacattatagcttctgagtggagtagtgaatgcatttcattttaagaatttaggttattagtgcatagctgcgaagcatttttgaagcatttcatgtacactaaaaaacgggcccctgcatcctaatgcaaatctctttgcaaatttctgaaaatagtacattggctgttgcggggaggagtttggtaattggatgtactgagaaacatgatttatagaaataggaaaggccagggcacaaagaagggcacggatagagttacatgaaggtgcttcttgatggctgtcctccctaccctaaattatttgggtagttaaaaaatatcctagcattaacagaatgtaggtatgatagccttttaggaaacaaggaaaacaagttcttttgatagctgttcagtatactcataaatctgattgactgggctgggtggaagctgactgttgagtcctgacttgaaattaggatactgtggttacacattagccccaacttgccaagatgtcctactttttgtctgtgtttagttagactggggaggagaattagttaaatgaacctgttttgtataaagtaggatattctttaccttagaagtaaacaaactagattgttcttctctttttaagtttttaacggtagaggcacttttggcatacaggttaagagtcacagtttaaagtcaggcagacctgacttctggtagtattgcttaatggcaggattgcctcagtttcttcttttgtaaaatgtaa

SEQ ID NO: 130464 - DNA, 1048 bp, Homo sapiens
ggatggggccatatgagctagtgaatggaatggagatcagcaagatacaggaagggtgagttgttggcatagatgcagaggctgtgatggcttggggtatgatggcatggggatgatgggtgatggcatgggccagggaagaacagtagcactagttggaaatgtctttgattagggagatcagtggtgatgatatggacagagagtctgttaaaagtaaatgattcggagggctaaaagaccctgggtattgagaaagcctcttactcttccctcttcccttctcctgacatgtagttccagtgatatgattttgagccttagtgatgagtagttcctatcaaattggtttttcctttctgaatttgcaggtcacatggaaatgaaaaatctaacagaattatatttttataacaggattccactagaaaagtttctttgagatacatcaagagagctgtctaggcagttagagccattacactgttcactaggattatcaaaaatcccagtttggccagaactgagaggtttcccaggatgcaagtttaaaacctgatgctcctgagcaaactgggacgagttggtcaccctcctgtttactctttcattttataaattcattgaaatgaccagtatttctatgtagaagtaatattactatattcgtatatataatttaatttaaaattaagtcctctattttgtagtttacattttaatgaaatatttattttatgctttggagttgctctattgaggggggagactgcatggttcatccatttttatctttgccacattcattgagttttaaatttggtgcttgataaaatagctttgcctaagtgcaggctttctaaccttttaggttccacatttattgaactaaactgctctgttacatatcatcctatcttgttactgagtttttttcttgtgtattagtgttgtcttcaaaattagactcagtattgaagccaggactttgtcttctaccatttctgtatccttgccatacccactttataaactaggcagccaataa

SEQ ID NO: 130465 - DNA, 1042 bp, Homo sapiens
ccatcctatagtcatctggtcaaagaccttatatgtatcctgagtttttctttcatggtgccaatgctctagttcagataagctcactatcttaaatctaacccccagagcttccaaagttatttttccaaaatgcaattctcatcactgaaaccatcaggataaactttaaagtactatgcatggtatattttaaatacaatataaactattccataggatcctatgcagtttagaccctctctgtttgcctgatcacgttacactgtccttatgttccattgtccactatgcaagcagttctctggatgtgccgttctttctgtaattctctcttgaagaattacacacttcaagacgcagttctctcagaggttatcttctctgtgatccctttcttgatccctgaaggctggattatctactttctcttgtgtgccccagatgtagtactttaccttttgcatctattttaggaattatcacactgaaagctatttatttgtttacagggttgtctcctcacagactatgagctccttgaaagagggaatcgtgtcttactcatctttgtatccccagtgtctagcagttcctgatacatagtaagtggttaacaatttttttaaaactaagactataattaatagtcagacttcatacattttgatagttaattatgtagacctagtaatacgttgtcataaaaaatatggctatagacttctaatactcctgaggctcagttttctcatctctaagatagacagagtgcctccctcctcacacagtgttactgtaatgctcagatgggagaatatatgacagtaccttatcttttaagtgtcatacaactttattaaatgaagtgcggagaataattgttgaaattgataattttatttgctgtatctcttcacttttaaggcaagatggtatcattttttaactatctctcatggttttagtttaaatttgcagttactgcttaccagaacatgtgctcttgagtctggggattgggtgatatgaaagggtttat

SEQ ID NO: 130466 - DNA, 1050 bp, Homo sapiens
tccattttctctgactgttttggtacagaaataaataggactgcaaattagtcattcttaattttggcatttcaaaataataatggcataaatttgtgtatagtaaaagtatcatgtaagtctttagacatttgttcaaatacaaacagtgttactatgaagtctcagtaagactcctgtgttggtgttttggcttgctgattccaaaaatcctcatctagttattaaagtcctaatgtatttgaaagtaaaatatttttatttatgattcaagtagtttcctgtttcatacaatatttcttctcaaataaatgaaattcacggtttttaaaacattactgaaataaatgctttaataggaattgttacttattaatagaatgacaacgtctactcctgtatttttgttaataattttacccttccagaaatgttacgccacagactacattggaatttcaagtttggagccatcgcactttaaaagcagatgctttattaggaaaagcaacgatagatttgaaacaagctctgttgatacacaatagaaaatgtaagttttttgttctgacctttatttccttataagtttattttagacactttgaacatatcctgaatcctaaaagcaaaaacatagttttgtatccataaagaacttcagttattgcttgtgattgattaactttgtggcattttatgaaataggaaatatttaccatggcctttctgcattctgcagatttacaaggtaatctcagtcatccacaagtaccctattatcagtgactatcagtcatttattatttgcttattattatattctttaaaacttgagaaaattatcattacatgaccctactctattttgtcacttgactactaacaattttatttgggtaaaataaattgtaactcttaagttttcttttattattatataattagtttattgtaaaaaacatgaagaagatagacaattatagagtaatataaaaattttctataattttactatccaaggataaccaatcttaataatttggtcac

SEQ ID NO: 130467 - DNA, 1088 bp, Homo sapiens
attaccttggctgtgtgcagtggttcatgcctgtaatcccaccactttgggaggctgaggcaggcggatcacctgaggtcaagagtttgagaccagcctggccaacatggtgagaccctgtgtctaccaaaaatacaaaaattagctgagtgtggtggcacgtgcctgtaatcccagctactcaggaggctgaggcaggagaattgcttgaactgggagacggaggttgcagtgaactgagattgcgccactgcactccaagcctgggctacagagcgagactccctctcaaaaaataactaaataaatatataaaaattatctctgtgatttaattgagtaggatacggatatgctcaggaaaaataaaatttaataaacactcatacagtcagtagatggcttcagaaattttagtagcatcctgcacacctaagaagtcggtaaattagtttgcaagggctgccataacaaaataccacagactgggtgccttaatggaaattgattttctcacatatccagaggctggaagtcggtgattaagatatcagtggggttggtttattgtgaggcctctcttcttggcttgtagatggacatcttttccctgtatcttcacatggtcttccctctgtatatgtgtctgcgtccaaatttccccttatcaggacaccagtcattggattagggcctaccccaatgacattattttaacttaattacctcttcaaaaatcgagtctctaaaaacgtcacattttgaggtactggggagtaaaacttcaacatacgaatttggtgggggacacaattcagccccaaacaaaaggtaaataaatttatttgaagaattaaatctcatgatagtatcataatccttttacaatagaagacatttatgggtattagttttagtcgttcattttatagacaaatgagtaaaataatttaaagtaattaaaattagattttaatttaagtaagttggtcaagagtatacacgtaatttccgggttgtgattaaaacataagttttctgattcttagctgcctaattttgattagaagtaatataaaattaataag

SEQ ID NO: 130468 - DNA, 1385 bp, Homo sapiens
ccttttaccttcatctctccatttctctaagccctcactaatgactattaatatatagtctaatatatagaagtctaatatatcgtttaatgcatagtctaaatatatagtctaacatagaagttgaagcaaaatgaccttgagtttaaataagaactagatgttctaataatgggaaggaagtatttgtccttatataaaaatgataaacgattgtcacaatatgtagcatttatcgagcacttataaactgtgcctcagaagtggtgctagggctgtctgtatggttttgcatttggtcctcaacactgtccctttagtttgaagtccattgtctccattttgtaattaagaaaccaaggcttaaagatgtttgaataagttactcaatacacagccaataagtagcagaactggaatttgaaaccaaacttaatctgactcttgtgcagaaattttgcctcaaccacaagagtcatctgtggtaccttgagctgaaaagcaagtttagacaattgctacacttattatttaaatgtatttatatgttctccaaaatttataatatgcacagaagcaattaaaggtgatattgaaagcgtgggattgagggggaaagaggaattacttaactagttgtcaaaggcatgcaaagaattccttccaaatgtcaagtactgaattagagtgattcttgaaatgtaggtttgatttctgaagcatttttatatgtggcaaaagcttttaaattagaatattcttctttctagtggaaagagtgaaagaacaattaaaactttccttggaaaacaagaatggcatagcacaaactggtgaattgacagttgtgcttgatggattggtgattgagcaagaaaatataacaaactgcagctcatctccaaccagtaagctaactttatatgtttgtaaaatttcaaggaaaaagaataagcaagaagtatataaaaacctagtttttttctttcttgttgttcagtagaaatacaggaaaatggtgatgccttacatgaaaatggagagccttcagcaaggacaactgccaggtagaatattttatttgaatatgggtggcgacatgatgtggaacatatttcctgaataagaagttttatattttaccttagtttagaatttgccacacagtttagaagcttatgtctaagcatgtcatttggttaattcttgtgaaagtagctttttaaaaaattacagctttattgagatatcatacatatatcatgaaattcactttttaaaagtatacattttagtcgtttttaatatattaagagagttgtgttaccttctctactgtctgatttcagaatattctaccttgaagagaaaccatgtatatacat

SEQ ID NO: 130469 - DNA, 1036 bp, Homo sapiens
ttgggggtcaagatgggaggatcgcttgaggccaggaatttgagaccagcctgggcaacaaagggagatccagtctctacaaaaatttaaaaaattagctgggcactgtgatgcacgtctgtgatcctagctgatcaagaggctgaggcaggaggattacttgagcctaagaggttgaagctgcagtgagccactgcactccagccttggtgacagagtgagatcctgtctctaaaaaaaaaaaaaaaagtttacagtagtttatacttgatttttatttttatgattcatataatttcatgaactttttgaaactactttcagagcttttaaaatagattaatattaggcttaaatatttaaaatgtacaatttgaatattattgtgggagaccgtatttattttgacttagtatgtttgtatatctcagtatttttttatctgcagaatgaatacacttagaactgaaaagtaattaaaactttaatataaaacatgtcatatctttgttcattactctatttacctatcattttacttgaaacataaaaactcaattgtttggaaatagaatctaaaaaattttaaaaaagaaataacaaaaaagaaacttaagagaatttagtaaatcctatgaaaattctcatgaaatgttgttgaattatacttaaatgattgaaataaggcatttttttttcaaggttggctgttgaaggcacgaatggaatagataatcatgtacctacaagcactctagtccaaaactcatgctgctcgtatgtagttaatggagacaacacaccttcatctccgtctcaggttgctgccagacccaaaaatacaccagctccaaaaccactcgcatctgagcctgccgatgacactggtaagcaaggctatttatgacaccttgtttaaaggaaaagtaaatgaagtttatgtatccatccatgcctacacttccctttttgtgtagtcttttttttgagacggagtctcgctctgtcacccaggctggagtgcagtggtgcgatc

SEQ ID NO: 130470 - DNA, 1053 bp, Homo sapiens
tgaggtttcagattaggaattgtgggtcaatactaaggggtttaagacaaacgatatatttctgtcaaagacattattatatatgagggcttccacctcccccacctcctgttcttttgaagcttgagtaaggggatccatctgacggtttagttgctatgaagattggcaggtattccaggttaaaatgggaggcagtcatgatgtagtaaaaagattagatttagcttctgacaggaggtaacgtggtgtctcagctcaaccacttgccatgttaactctgtaaccttggacaaattgaacatcctcaaaatttatgaaaagaggataatatgcgactaccttataggacagttttggaggttaaatgagataatctaaaacattcataatagtccttggagagtggtatttaagaaaaatatattctgttccactttgttcctctggtcataacttctagtgtcaaataactttttctaatatatagttgttattttattaataaagtagatcagagctcagtatggtgagtttcagacagaagtacatgatatcacaagtttattatatttttttcttagctctttattctgaagtaattataaataaacagaaagttgcaaagaaatgtatgggaaggtcccatgcacccttcaccagcctcctccagtgttaacatcttgtataactattttgtacaaaatcaggaaattgacatgaatacaacccatacagcttgttcacatttcaccatttctacctgtgtgtgtatgtgtgtgtgtgtgtttctatacagttttgtcacacatatggcttcatgtaccaccagttcaatccaggtacagaactgtagcatcaccagaagactccctcatgatgtaccctctttaaagctacatccactctcaagtgtgaactgaatgttaaagaaacttgctgtgtatatgcaagcagtcatttctcatgtcatagttttaaaatggagtaaaaatggtattcactctagtatttctacttttttcttctttatttgaatgtacttttagggtg

SEQ ID NO: 130471 - DNA, 1061 bp, Homo sapiens
actggcctcagacagcactcactctagactagaagctaatcagaaggcaggtgcaatcatagaacagctaatgagcttgaacgttttaagaggagatttatgcaactggaaaagtatttggggtttaacgataagaatgtagacaataagcaaatggaagtggagataatttttctagctaatagtattttttaaaaaaagaaattggggtatgttccatggctcatctgtggggagagtttacatagtcataatgataactgtaagggaaggtacaacatatgtgtatatttggaatggttgggaggagggtaagtgtagatgtgtatgtgtgcaggaaagagacctgcagcttcacctttcctaataaaaagtcaatacattatgtttgaaattaaacaaatcacaataagtcaaggaagttaataagtaaaagaagtaaataccaaaaaaatggactgaaacagttgaaaatgttgccttggggagtggaaaatgaagtgaaagagacagtaggtactgttgttttttgcaataagtctcacagactgtatgactctgtttatgtgaaggtatatataattatatagctatgaaggtatattttaaactatctgaaagtatatgtaattttgataaaaaattaaagctaaattaaaaatagtaaaggatatttgtgaagaaacagttgaaaccaggaaattttgctgtaggacagcaataaaaattcaaggactgcttatgggaattattacctaaaaatagcaaaagtgaaacttgatcaggtttttaggtattcatttggttttggtagttaagctttcatacagaatagcccattgttacatgttagacatattcctgacaggcctttaaaatgaaattttatatttaactccttctttcccgtgagctttttatataaacaaataaagtaaatcataactttcagattgtctgattttagtgaaatgctttataagaaatatctaagtttttacagtactgaatatcatgagtgttccagtgtaggatataataggcaagtttaataatttttg

SEQ ID NO: 130472 - DNA, 1116 bp, Homo sapiens
atcaataggcaagagatccaggctctgtcactgtgagtcaaaccatattgtaaaacctgtattcctaggtgccgtgccaccaactctgccttttctctcactgaccacgtgaaccgtgtgatctggatgacaatgttgtttctaggaatttgattttgctttgcttattatctccaggaatatttgtttgggttttaggttaggcttaggatgtggtagaatttccttccacgtctcttctgtctggagcctctgtcctccttagatttaaggattatcgaagattttctttgaaatagtctgtagtagactttgatatttcatttaactcactaacaaaagatccagccataaatacaatgtccttctttgtgtatatgtgtgtcctgttgctgtaatagtccccattacttgagcttcttttggcccaccatgtatgtatacccttctctcccagcagaaatcttcctgtggtattttgttggactttagtacactctgattttatactgaatactaaatattcaactttattatgagttaatttggtttatttttgtttttctttagaactaaaggtggtccacaaattgcttatgaacgcggctttaggtggaagcttgctcacttccgttatttgtgccaggtactatagtggtaaataaatcttatactcaataatttagtcttctctttatacaatacatatactataactcagatgatattatgatattatttttgtttttagtctaatgcactacctagtcatgtaaagatcaatgtgtcccggcagacattgtttgaagattccttccaacaggtaaggaggattttagcagaataaaacaccatttgtctcattgtattctgtgcatctaaagaaagtcagggttttagagatttttaaaccacccagaacacagctataataataatgactgccaccaccacttgttgagtgcctttgttttgttttgttttgttctgttttcttaaatagagatggaatttcgccatgttgcccaggttggtctcaacctctgggctcgaacgatctacccacctcggcctcgtaaaatgctgggattacaggcttgagccactgcatctggc

SEQ ID NO: 130473 - DNA, 1386 bp, Homo sapiens
tttgggtctaagttttatattttgatagttttaatgaatatagctagttcctccataacatgattttttattcctaaattttttatttaattcatgtattggtgggctagattcatcaaatggtttattaaagagtttacaggattgatatattcctacagtctttgcataatgttctctgttgcttttacatataaacaacaatttcactagatataaatttctcgcacacttgtttttccaatactcagacattgctttactgttttctagcattgaatgttagtactgtgaagtgtgaggccagccccttgtaagaaccttatttttcctctgggtgcccacacagtcctttttcctgaagttcaataatttcactgttgattgttttgtatctttttttaggaatatattaagatcttccttaatgtcagggaagttttcttctattatgtctttgaatattttttctgttccatttgttccatttttcttcaggaacatcagtcatgggtatgtggaatctcctttgtcagtcttacatgtctgtcatcttttctctgatcatttttatctttgcacttttccattttattttgatttttctcaagcctatcctcatgtcactgtttgcagtactgccctacgttttgctgcttctaatgtgatttttcttcattagtggttttactgttttcttcattttcttctttaggctctgctagctcatctgttgtctcataattttttcaacctcttgtgtctcttcagtttatttgagagtattgagaagaatatgttgaaagttaattcttctgcctcttgctagttaggaatttttcttccttttctgctagcatcagaggaaaagagtagatgccatgttttagccattcttcttttgaattgattgagttttctctgggctgttgtttgctaaaaattatctgaagcatctggagggtttattcctagttttatatatgtgtctaaacacactctcacaagacctgctccatcctcttacctggggtatgtcttacttcagcctcatcatagagggaagtcacttggttcaactactactatgttacaactggacttagttttaataattggtgtttactatttctagttgattttgttgaggacttccttctctacccttcaggcagtatcagtgattgtgttttataacctttagaaaaacgtttattaacaggctgccaggccagatgtagcctacatagaggtggccctcattgtgattttacagtttttaaattacttgatgacatttgaaaatcattagattatgcttaagaatgaagatttctgacttctctttaaaacactcgacctgcaatcctgccttctcatgtggcg

SEQ ID NO: 130474 - DNA, 1125 bp, Homo sapiens
ttatcttgtaatacctttatctagttggatttcgcatattggactttaaaatgggtggtaaaaggttagagattgcttatcacatttaaagatttaaccttttaaattttagtttcatttttaatgcaatgacaataaagttaaaagtgttaaatagcagcagtgctgtgtatctcggtatcacctgcaaatgtatattaaaacctgttgtatatacatcctagagtgcttgtaagagttaagaatacaaaaaaatacatggcttttgcctttgagaaacttacagtctgatggatggggcaagtcatgtgcataaaaatgaattaatattgtgaggttgttacaacagagtattcagtgactgatattaatacaaatacactggaaattgcctcaaaaaattgttgaaatgggatttaagctgaattgaagttgaggagacatacccaagcaaaagtgtggcatacaaataagcatgttatatctatatgaggatcagtgaatttgtagtttggccacatcgaaactagcaggtaacttaaatggagagccagatcatagaagaacttggatagagggccaaagaattgggcagtggagttcttaaagactgttgagcagaggtatgatgtatatatgaatatatttaagatctgtttttaaattcacatattaatgctaaaaaataaccttgacttattttcttatagagaatggtttttcttgctttcacatgaagttttgaacccaatgtattgcttatttgagtatgcgggcaagaacaactattgtctgcagataaatccagcatcaaccattaatccagaccatctttcatacttctgtttcattggtcgttttattgccatggtgagttcctgactttattattatttatttaagtttgttacaaatgtattagagaaggcttttaaaaaaaaaaaaaaggataagcattatatttgctattcacaagttttgttaccaagaaagtttccctggagagtgtaaaaatatattttttgagtacctgtataaaatcaagattatgaatatgaagattatgtttatacagccacttagtctttaaaagtcctttcatttttaaatttaaaacccatttat

SEQ ID NO: 130475 - DNA, 1143 bp, Homo sapiens
tatttatttacgtatttatttacactttattatctattaattcattcagcaaaaatttattgacagcctactgtaatgccaagcactgttttaggctccagagatgaaaagaatacacagtccctgctctcagggacctaaattccattagatagaaatgagtaatcaatagatatattctgaaggaaagagtgtgttgctttttttatatggtatggttagaggaaacctcactgatggatgacacatgaacagaaattgaagaaagctagggactgaatcatgcagatatcttggagactattctaggcatagggaacagcaagacaaaggctctaatgtgggagtgcattcttgattgagaaagagaccagtataattgcagcagaggatatgagagagaatgtaataggagatgagattgagagatgctgtgtgggacctttaggaaattcacataagagttgagtagggcaatgagtgacctgatctaactaacatgatctgacttaaattttattaagcttgctttacgagtatgtagaagacagactataattgggggcataggaaaacatggatagaagcaggaaaatcatttgtaacaatccaggtgaaagataatagtggcttggacttgtgtcttctagcagtggaggaagtgagaagtgatttggattctgggtatattgcgaagttagaactaacagttttctgacagattagatgcaggggtgtgagagagagtcaagtatggcaacaatatttatggccagcttgtctggttgcaaattttgggtatgggagaaatccagaatatttaggtttggcttgttaagtttgaagtagacatccacatggagatgtaaaagagatagttggaggtataagtctggcaatgaaaggatatttagtttggagataggcatttgggaattcttggcacatagagagtattaaaaggcaatatgattgtttatagagtgagtatggatgaagaagttgttcaaggacaattatagtcagggagataagtaaccaacaaaagatctgaggtagtagaatcaaataggagtggtccccagaggacaagggaagaagaaagtgtgtttcaagaaggaagacatggtcaaccgtcatatg

SEQ ID NO: 130476 - DNA, 1281 bp, Homo sapiens
aggagcgaaggcacgatggggttagtcctaaaagcctcacaggcagcagtgagagtaagaaacgaacgagagagctgccttttcaggtgcacagggcccttttatatttccttatccagttaggttaattcaatttataaaacatttaggaagattgaggcagggtatggtaatagaagtcttttatcatcctatacagtttttgatatatgttatatagctatgtgttataaaatagattgttttaactttgtttttcatacctagcattttatataatattttagttttcatgatttatgccattcacttactgaatgctttgtttacttgtgaagtctcatgatttttcttttatcattgttctctaagaaattgttattttgcaaattttaaataaaatttttcatttttctttgcaggcactatttcatggaaagtttatcgatactggtttctctttaccattctacaagcgtatgttaagtaaaaaacttactattaaggatttggaatctattgatactgaattttataactcccttatctggataaggtttgaagattttgttttgcaataagtcatttttttgaaacccattttgtttcattttgttaattagtgtatatatatttatttcacccagagataacaacattgaagaatgtggcttagaaatgtacttttctgttgacatggagattttgggaaaagttacttcacatgacctgaagttgggaggttccaatattctggtgactgaggagaacaaagatgaatatattgggtaaggtgatataccttattaagcttaatttctagaacacttcagaactaaatcctctctctgtacccttaatttcatccccttttcatgcctttgggaagttcttctcaccagtaccaatgttcttgaaaaaagagaatatatgttgcttcattttcccactgccatttgctgtaaccattctaccatttccctttccatgtcattttcccttttttaacttaggcttttaaatagtgctcaccacagcctgtttcttgaaactcagtgttttcttgaattccatgatcctatgtcatactgattttctttacattctcttgttttaaatttttgtttttagagagagtttcactctgtcgctcaggccgtcgtagtggcgtgatcatagcttactgcagggttgacctcctgtgctcaagcaattctgccttagtctcctgagtagctgggactacaggcttatactaccattcccagctaatttaaaaca

SEQ ID NO: 130477 - DNA, 1050 bp, Homo sapiens
cttaataaatgacaaaccctacaacctctttttagcacatctttttttttttttttttttttttttttttttttttttgagacagagtcttgctctgtcgcccaggctggagtgcagtggcgtgatcttggctcactacaagctccacctcccgggttcacgccattctcctgcctcagcctctcgagtagctgggactacaggcgcccgacaccacgcccggctaattttttgtatttttagtagagacagggtttcaccatgttagccaggatgatctcgatctcctgacctcgtgatccgcctgcttcggcctcccaaaatgctgggattacaggtgtgagccaccacgcccaacctttagcacatcttttgaaccaattcagtgttatttaatttcttcaagtgtctactactttcatgattgaagatagtttagcatttcatattaaagtacatttaatttcattacagtttgtgaaagagacagacaatgaagtaagaatgcgactattgcagttcgtcactggaacctgccgtttacctctaggaggatttgctgagctcatgggtaaatgtaatttcactgtaatttctctgtacgtaattttgtgataataatggcctttggacatacaatagacttgattgaacctaaagattactcttctgtgctgtaggtagggcttcatttagaagaaagaaaaatgagtggctaatatcaaagcacttgtaagacaaaaatgaatgtgtcctcatatagctgaggtggccattgctttgctccctatggtgactgtgaagggagcgacattctgtagagagagttttcttcccaatgatctaattcttattgctggatctctgcaacaattttcttcttcaggcagaagcagcttacattgtgaatttctttattttgtatcattcatatgactgtgcaacatgttctattatttaagcagttgtcagaagaaaaaagtttaaaggaccagataaactttgtcttattttcttggtgtaggaagtaatgggcctcaaaagttttgc

SEQ ID NO: 130478 - DNA, 1553 bp, Homo sapiens
atatttgttaattgactgtctctaccccagaatgtaaattccatgaagacagggattttagttttcttcactgtatcactagcttatcagttatataaaaaattctcggtaaatgactgatgaatgagtgactgagtggatgaaagaaatggactcttatcctaagagaagttaagaggactcatgacacatgtaacaggaatagtaaaaagaaaatggatttttttttttttttaaatttgtctttatccatattgctacacttattatttgtaattccattttcctcttggagatgttaaaatagtttttatatgtaagtcttaaatttagattactctaaatacttctggcaaaattttaacatatatagtatacatatatccattcagcatttctatgtgctttgaaaagtattctattagatttttttcattttattgaaaacatctgattttgtttttgtttctgttcagttttaatcgcttggatctaccaccatataagagttatgaacaactaaaggaaaaacttctttttgcaatagaagagacagagggatttggacaagaatgaatgtggcttcttattttggaggagctcttgcatttaaataccccagccaagaaaaattgcacagatagtgtatataagctgttcattctgtacagtgaattttccgaacctctcaaagtatgttttccgttcttccacagaaatatgcaaaacagttcatccttttctactttatttattgttcccttgaaatgactgaccaggaaaaagatcatccttaaattttgaagcaagtgagagactttattaaaaatacatatatatctatataaacatatatgatagtggctctagttttatagagctccaagtgtattaaacatgacagccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgat

SEQ ID NO: 130479 - DNA, 1762 bp, Homo sapiens
atatgcactgtaaatttcattaacttaaacattttttaatagccatggaactgacttcttaaaatctgttgcctataaatatttcactgctaagtacatacagaaaaacagtaattattgttttgccaaaattttatttttctacatattgagagtgtgttctccattttattcagaattcatagtaaagacgaaagaaaggcagagatctgcttggttgaatagactccttttccaaatccttattatgaacactctggtaattttcaagcctaaagaattaaaaaaaaaattctaatgtatgtgacaggttatgtgatagagggaaactggccttcaaaaaggactgcgtataccataaaagagttaagtattagaattacaaatggtaccactgctgtataaattttgccatgacagaagttattgaatatcattcattgtaggtatgatttagcagatttgactgaagaaggcagctttccagttcgttttcagggtgctggtctccctcaagtaagaaattacgatgcactaggtgaggctacacagaaccctacaagagacaaaaccagctttgttttggagaattcatcagggtcttccacttttcatacccaattatagatatccaagacctacaggcagagctcttgatttatctacccagtagcagtcagaaaaactgtagaaatatggtcccccactcaccttctccccttcttcccttcccattcctgttctgtgctggactaaccgaaagaaattaggagtgcaagactctctgtgcccaaaacacagttcatgaggaaacagacaagagggaggctcagagacaggtttatattgctacttcattttggtgactcccccacccccaccaccagtaaatggcccagggaatagctcacaggcccaatacaattctgtctgttagatcagttaagcaacacaattctatctgttagatcagtttagttgtttgtcttccagggaaagcagcttaccagtgttttttttgtttgtttgtcccgccccccccatgtacttcccaagtagttgaaaatgaaaaggttaacaaaaccttttcccctgatgacttctgttaactacctagctcttcctaccctgacaactaaataggatggtatgtgtcaactgtatttattgccatgcagctttgcttttggtaaatatgaccctgactggtaagttgcatctggactgggaaatctccagatacacgacagaaagccacagctttgggcatacctgagtggaaaactcttgtaactgtatgtcctttaaggaggaccgtgagctgtcacctggggagataccatttcatagattgctgttagaagaccgtcttctgagaggaggttcaaaattgtcctgctggtgagctgtgtggttcctgtcctatagccttctgagtagactggtgccaaatacagcctattgtagacttattaagtctgaatgtttggttgaacctaagatgatgtggtggatgttgcagaagtaaaaatcttcctctgttgaaataatacacaactaaaagttctcctgtaacactcagttggccttaaaagccaagctttaggtcaactgaggatttgatctaagtccaaaagtgacatctcctatattccaaaatttctctcctcaattctcaaccaagaacaaaatcagagataatagtagttgtatttactggtattcatggtaaatcctttacataaattattctcttgatcct

SEQ ID NO: 130480 - DNA, 1058 bp, Homo sapiens
ggtttgttctcagtaatgggtctcacccttagtggggaaacgtcacggaccaatgtgacacgtggggaatcaggctcctgggaagtcaaatggaagagacttagtgcacagaatcagaatcttgggaaggcaccatgtcttgcagaagaaacctaaccctcagagagtaaaggggaaaaatgaagataaaaggacccaggagccacactcctgggcatgtatcccagagagataaaatctatgtagacataaaaacctgcatataatgctcatagcagctttatttgtaatagctaaaaatcaggaataacctaaatgcccctcagcatatggttgatatggtatgcccataaaatgaaatactagtcaactgtaaaaagaaacaaactattgatagaacttaggtctcaagggaattatgttgagtgaaaaaaagtatcacagggtctcactgtatgattccatttgtataacattgttgaaataacaaaattatggagaacagattagtgctgtcagagttagggatgggtgggggagaggaggaggtagatgggtgtgactgtaaagggacagcactggggatctttgtgatgacggaacaggtctgtatcttgattatggtggcagttaccaaaaatctacatgtgatagaattgcatacaactatacacacaagagcatttaaaagtggtaaaatttaaatataaggtctgtggtctgtaccaatgtcagtttccaggttttgctattgtactacaggttatatgagatgttagcactgggataggctgagagaaaggtacacaggatcttttttttttttttttcaatttgtgaatctatgattttttgaaagtaaaaatattttttaaagttctaataaggaatcaggaggtaagacctccataaaaagctttattattgaatgatacctgatctcacaaaaaacaaacaactaagcagaaaatattcttgaactaacccagaccctttcttcccatttgatgacctagtattgctggtaactcaacataaaattacatccctagggaaaa

SEQ ID NO: 130481 - DNA, 1062 bp, Homo sapiens
cctcctggaggagcccgggctcggggctcagctccgggccgcaaggccccgcctgggcctggcgctcgcgcacctggggctggggataggctgggatccgccctccttccctgggcggagagggtcgggcttgtggcccagagaagggtgacaggtcccgaaatcgctgcagcaccacgcggggagagggatagggtacccacaccacgtccgtggtgaagccaatgcccagttgagcggggggcgcgcgcttcagagcacccgagaagctggcagatggagtgggaagaggtgactcttgatttcagggtaaacaaggagattgtgagaagtagtctagcagctcccgtttctcctccagcttcaagattcttctgtctagtgttttgggttccctacaccaggattgtggaggaagcgcacggccagaacccgttgggaccgagcagatcaaccatttatgttgcacttaatgatcatctgcactttttgcatatccttagtgttgtctttgtgaggccacctctataatggataatcaaatagagggaagggcgggattgaatattgtgacttgatttcaatgtcccacaacaactgtgctagacagtttttatatgttaggttatttaacgctcccaagcacttattaaagtgatgttactctgtttcattctccaggaaactcaggttgaataattcatcaaattacacaactggtaagtggtggcattagggtttggaattcaagtccgtatggttttagggcacaggctttattgcttaatgtaaaagaacattattctttgggataagccagatacctaggtttcaaatctatgctatgagggctgttagctgtatgaccttgggcaggatacttcaccttttagggcctgtttctgcatttgtgaaatagagataaaatgtcacaaggttgctatgagaattaaattagatcctacttgtaaaacatttagcaaagtgcttgacacgtagttagtggtaagctatatatagccacatatatcctgatgtcattaataagggtcagcaaactag

SEQ ID NO: 130482 - DNA, 1040 bp, Homo sapiens
ttggtactatcactgggctttttttcttactattgttagagttttctcttttttcctccctttcaaatgttctttagtcagtgatttattatgctagaaagtatgcctgttagcaaaactataaaagttaatgttagatgtgaaaaatgattatatgtcatttgaccttcaaagattcataatgccaccactgctcaccaaagcatgatatttcaggtggatcttttagcaagactcaatgtcacttccattggtggtactcagtgacctgcaggagtcctaactagagcattcctttactgtacccaccattaccttcagcctacaatctagcttccttcccaccaatattttcccttcttgttcttgcttgtgagtgggaatcgtattggggttttttttggagagactatttattcttttaatataacagcttagcagtatgcaatcataactttttaaaagacattaaaattcatcagtattatggtcacatttaccaatatgaattaggtggatagcatattagtaagtttcctcataaaaaaaaagaaggaaatactacatactcattttagtaaatcattttgaaatgtctcttgcaaatggttgtattatatctagttcctgtgaaaattaccagagcaactgtgtggttttctggacacattgttatccggctatttcaccttccctggcttttagtttaccacgcctttagacttcaaggtgacggtcagtacctgttaaaagaggtacctgcaactgtaaagaggaacttacttatctgtccacattttcatgtttatgtgtcagaattttttaaaaagaagtgaaaattaagacaaatacttcctgatggtattgtcaaaacaattttataaaatatgtaaaattgcaccccaccttcagtacttcttgttctccttctttattgttccctgtagcacttactgccacctaatatactatatatgttacttatttgtcttcattgttgtctgccttcctgcagtgtaactaacctctccctgatgggg

SEQ ID NO: 130483 - DNA, 1488 bp, Homo sapiens
tagagacgaggtcttgctgtcttgcccatgatggtctcaaattcctaagctcaagccatccttctgcctcagcctcccaaagtgctgggattacaggcatgagtcactgagcctggccaagaagattagtatgtcttattagccatcttaaaagctgtattttactgtcattcagtaaatgaattttatcctagcaagagaatctgatgcaggcagtatcattggaatgagctaatagacacccacatcctgaggaggtgcatataacagtctgattctggcaagttcactctataagcctattgtgacaattggtcttaagaagtcacctgtttttgttaggaatgagtgtgcttcttaaaggcactgttttacttgctttctctttttattggttttctcagaactcaagacatggctgcccagtgtgtcacaaaggtggcgctgaatgtttcctgtgccaatcttttggataaagatatagggtcaaagtcagaccctttatgtgtgttgtttttgaatacaagtggtcaacagtggtatgaggtaatgtcaaatactttacctaaaaagtaatctgaattacccttttaacaatgtgaagagtttttttaatgttaaaaataacaacactatctcatctgttaatggagttttttgtgaaagtttgtccttgattgtagaatttttcatacacatatagaaacttcctttagttgtcatgcctatgtttatgtttagtatataaagatgtgaaaatccaagtgcacctttgatctgaagaaacttttttgtttttgcggatgggtgtaggttgagcgcacagaaaggattaagaattgcttgaatccccaattttccaagacatttattattgattactactttgaagtggttcagaaattgaaatttggggtttatgacatcgacaacaaaactattgagctgagtgatgatgacttcttaggggaatgtgaatgtacccttggacaagtaagtataaatagccactgtactctattttgtctaaattttaatcaatgaatttggtggtgtttttggtaagcagcatttaatttttaaagttgaaaaacatgtaatcactttaaagacagtttatatattaatatgattggcttgaacattatagaattcatcttatattttgtatgggcaggaactatgtatttatgaaaaagcctgttaattcttttgagtaagggatgcttcatgaggcattttattaagtaatacctccgctttagctgctgcagagttctctacggttttgttatgttcaagccataaatgcattcaagataacagcaacttctctgatcttctaactagtgagactggcacctgctgactcgcaatgccccaataccatcccctttacctggcttgctcttactcaaccttattccccctgataaaccttctctgaccctctagattagtttggaatcctttcctgagctcacttgg

SEQ ID NO: 130484 - DNA, 1882 bp, Homo sapiens
cagctaatttttgtatttttttagtagagacaggttttcaccatgttggccaggctggtctcaaactcctgacctcagatgatctgcccgtctcggcctcccaaagtgtggggattacaggtgtgagccaccgcgcccagccatcctctgtagttcctaagtgctccttgtaataggtagatatattttccaaatagttttctacttttcctcagaatgtatcacaactggacaatttattacatttttcatgtagcagttgtataatattgttctaggtagtttttttgtggaaatagttgagttgatgaagaggtggaggacgaatggtgagagtatagcaagaacctaggaagggcaggagcaaaatgttaatgaactggaagtttttctaacagctttttgaaaccacatttttataggttgttaaaaacaacttgaatcctgtttggaggcctttcaagatctctcttaactcactgtgttacggagatatggacaaaaccattaaggtaagttgaaattatatatatataaaatacttaaatatacccatgttcacctattttataaaattaatacataagatagtatttaaagaaagtaaatgatgtaagacacctacagagttaaattttatgtgtgtagaatactaaaatagaaatgtcttctggtaagtgacacagtttgaggagtaggcatgtttgactaatctgttgacctaatgcttagtcaaacagtgtcgtttctattttattctgtattttaaaaaataaaatgtccagtttaatatttttttccttttaataagattcctctgctctgctaataggaacctcgaactacattatttgcctttggtatgtctgttgcagatagaagcagatgttaccgtaagaactcagagcttgcttctgcccttagcaagggagggcagtattgatggcatttttcttccttattttcagaatgagataagtaattaattgaaagcttttagaaggctttagttttagagtatcagggaagtggagtatgaacagcaaatagcagatgtcagtatttttttaaatgtttttattcataggcatttatttaaaaaaagagtaaaaatataaataaaagaaaactcatggagtggtgttgagaatgaaaaatatatacatacatatacataaaagaaacttttgtactagaattattaactttacatgattacagatagaggtcttttttatgttcagacttcagtcgatcaaagggattttttggtttgtttttctctttttctgataataaatatggtaaaagcaggcaggataatgaggagtaagtataagatttggagtcagaccacagttcaagttttgacttagtcctttaactggctaagggatcttgggcaggtaaccacacttcttcacatttacttatttatttattttgcttattagtaggaagcttcacctggattcttcacttttataatagagttaagaatttctaccttccagaaaagcaaaaattaaattagcagaagtgaaagttttgtaaaaattttgtagaggtgccattgttactgaaaaactgcttcatttttgccgggcatggtggctcaggcctataatcccagcactttgggaggccgaggcgggcaaattgcctgagctcaggagtttgagaccagcctgggcaacatggcaaaatactgtctctacagaaaatacaaaaatgagctgggtgtggtggcgcatacctgtgttcccagctacttgggaggcttaggtgggaggatcctttgatcctgggaggaggaggtctcagtaagccaatattgcttcacactgcactccagcctgggtgatggagtgagaccgtgtct

SEQ ID NO: 130485 - DNA, 1035 bp, Homo sapiens
aaaaaaaaaaaaaaaactgcttcattactgagatccataaaaaattgcttccagtttgtaaagaactttaaaaatcaatctaagtatgatttgtaaggtatttgaaacagtagtgaaaatccaggtccgaaataaatagttgaaaattagctataaaaattattttttatcattttgccaaatccagacttttgcttttcatattaaaaatagtaaacatcattagatgtcagaaggcaggtaaatctaggggaaaatgtctaagccataactatttgattgtgtgtaatgatatgttaacaacaaaacaatatcttttaaacttttttgctcacagtggcatgcttacagggctattttattatagtaagtaaactgattttctgagctttctctaatgaatgtcttccattcttaaaactttcttggtttgtttttaactatacacaacttggtttgctacgtcatcactgactttatttcatttagttctgcatttctttgcaatatcaaaaagtcatacatttgtgattctcttactgttcgaaaattgcttatagggatagtaaagagttatagagcagtgaatagagtcagaatcctcagtagtttctttgccatgttgtgttatcattctagcatgtattattttcattaagatcaagtgaatacgaaaaataatcatgcatgctgccactttgcctaaaatgggagtgccttactgaatgtagtatctgtgtggtgtgtgcattctctttcatatatacatatgcccatgtgtatatatgtatacatttatttatttattacacatatgtttattatgtatactatatatgcatgtgtatatgtatattatatatccattaaatgtatatgaatacatgtatatattatatacttgcatatacatatgcatatgtatatatgcatatattgttatgcttaccattgtttaaaaagccaataatactggtctttgaattcttgaaaagagagaaattaaatgacacgaattgtcttacctcataccgt

SEQ ID NO: 130486 - DNA, 1043 bp, Homo sapiens
actttgtaatgaaattttcacaatctgtttagcatagtcctcttagagtcctcaggcaggttgtctgggctcatcatgaagctctcagttttgttgatgagatctcttcctcctgagagaaagcagatgtatacaaacctacaaactagtggttatcctgaactaatttaaggactagaaagcattagtgagacaaccttataaaagacaacccttaagcttaagtaatggatacaataattcattatttaagccatctagaaaagtagaagcatcaggttgtttcacatttaggctttacttgtttaattgtctatggaaatagtggtaggcatttgttaggaagtaggcgccaggatgcatgattgtatcccatctcttgaagttttcctggacatcaagcacaggtgtccctgccttctccttactaagggctgcaattgttatttggcaggtgggagtggacttcactggctccaatggtgacccaaggtctccagactcccttcattacatcagccccaatggcgttaatgagtatttgactgctctctggtctgtgggactggtcattcaagattatgatgcgtgagtatgactttggaaaaactaaaatacatgttttcacaattccccagaaagggtagtttgtttcatcggctagcactctgatataggtggtaggttgatgatgctttctccctaaaatccccccgtcttatcttctatttttctccttgtggcaatcttgctgtttaccttagatctctaatatctttctgtgattagttatcatatatggcatgtactttgctttatattacatatagtttgctacttacttcctgactgaatgtcagcaaggctcttgtttctttagtctggtttccttggggcttattcattaggcataagttgtatgagtgattgaagcccagatgacatgttttataaatactgtttataaatactaaatattatttatgttaaatactaaatactatttataaatactaaatactatttatgttaagaaataaaaa

SEQ ID NO: 130487 - DNA, 1053 bp, Homo sapiens
ctagaattaatattaggtttatcgccatctggtatttttgtagaacctctggccatatatgcaaatgatttttcattttattaataactctttcttacctttcatcatcagttgtatgatgtgaaacctttttcatggttttctatcagagccacattcccaacatgtattaaaaattaagcacagatgtaacagtcctaccgtagactaataagtaatttgactgagatgaaagtaaatcccttctattgggggaggacagagcttataggtttttgcaatggatcatacctatggagttatgtaatacatagcttagaggaactactgcttatagaacttttgactatttaaagcactatatgttgatacatataatcaaattagccagtattgtgaataaacacattgtgcttgagaatttttagtactgttttttatttgtttgtttgttctaggaatccaaggcattgtagaggcgtatcggtcttgtcttcctcagataaaactctatggaccaactaatttttctccaatcataaatcacgtggccaggtttgctgctgcagccacgcaacagcagacagcttctgtaagtgctctatggccagggaatgggaagaatgtggattggtagcagctcctggtgccatttttctatgtttttggtttgtcataatacaaagtcagggcaagatacaataacacagtcattcttggtttgggagtaacttttgttgttgttatactagtgatcgttaaaaataagacaacagcaaaacaacacttggcattcatgagtcttttatccttggaattaactttcttagataggttctaccaaaaaaaaaaaaatgcctatcatctacctttttgaagtagacataacaaattaagcttaaggaaagttaccacatcagatgctgttgcaagatttcttattgtactaaagatatttgaatgaggtaaccattacctattggaccgtggataccaaatttctcttagcctcagcatattcagaagtaagttaggggaaactacctcatactg

SEQ ID NO: 130488 - DNA, 2271 bp, Homo sapiens
aggatattgtagatgcacagatggtaggttgtcctgaattctacattattagattactttaattgagatttgttaaaacggttaggactgttttgtccaggaaagataagaggaccaaacatataaggtgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcataccttattaggtataaaacctactgcaacttagaaaaaggaaagaaaaaagaaaacttttccaactgctgcattaagatagggtggattttatgtgctttttttttttaagagttgaatttcttttcctgacttttaccttttacagcgtattacttagtgaacattacattttcagaatagatcctaatattttattgagggcctatgtgctaaaaactatgcatatctatatattggccaattatctttaataatttaccttttgaaattgcatgtttatcatatatccttaagtggacacatacagtgccatgttgatgtgcctctcagttttattgaaaagctgccccacagcccatgtctcttgttctctgcaatgcctcaagggagtgagctctcaaccacagatagctgtggcttctcagaagcagctcattgccaaggccaggctgagaggggacctgcttgctgtggtggttgcctagcccagatgagcatttacctaccaccttcccacttggctagctgtcctttggatatgtgctgttaactggggaaggcatctaactagtagcctgctactccatagtatggctcaatagatgacacatcattttgacattatcaataggagaaaagaaaactaacccttcttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctccacagcagcccctgagtcacctgcacaaggtgcttgggaactgctggttatgagcattcctggttttcttcagccaaataacaggtaatcactgtcaattggatttggtcttcattattttatattctgattttatcagaattattctattttaaaattgttttaaaatttaaaacatttaattcatgatcatgttcatcagtagatgctattattcataagaactgtgattccagcaaactagggtaattggtgcctttttacagttttgaataaaagcatttacaatttctaaattatcagttttcacagtttcagcactcaacctcatcatacgctgatttaatattgttttacattaaaatagtccttttccctgttgtgccaccattcatttaagtgctgtttgttcttaaaatgcatttaaagaaaaattacccatattgactttcacacctcatataatcagatctattacaaatatatatcggagtgacggtgcccaggatagatgtaatatttcttacagatgctggcacagaggaaataatataccagctaatctagtcacctaaccttgtggttagaattgcaattttaagaccagaaaaatttgaagtctgatcagagatttacaactgttcattatagtggtgccttaggcaatctttccaaagtaaattcagggccccattgctacttatgccatatttggacatactttttttttcttcaattttgtaaacttcctggaaagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttgaattccttttggataaagttatttcttgatgtgacagagtagtgtgttttcatttttattctttacatgtg

SEQ ID NO: 130489 - DNA, 1133 bp, Homo sapiens
gaggataagtttcttgagagtagggacagtattcgattcacttatttatctaccctaggaacttagagtatactcaagaaatgtttgaaggagtgaatgaatgataatctcagttcgaggattttatttctttgaataattatttaatctgcattataattgtttcaggtaatattattttaaaatacttcttccatctgtcctgtgtaaaattatgaagtttctgtgaattgtttatcagaaggagtgaatacgggttgcggtgtgcggcttggcgcaggctcacaaagagctgcagtggcgccccatgctcagctttgcggactgagttggcggcggcggcacggggacagcagcgcaccctcgcagccctgcacctgggccagtctcctgaatatttacacattgccgaatctcctgtggacaagacaccacggaggccaggactgttccatgatgggttgagcctcttctcgtgcctagagattccaagaatcctatccatctttttcaccaatatggtttgtggactgtgatgacccaaatctgacatcagttctggaacgtccagaagatactgagaacaacaattaccttcgtcagcaattgaagtggttgatatgtgaactctgcagattatataaccttcctaagcacctggatgtttgagatgctagatcaaccactacccatgggtcagaatgggaaaatagaagtgacttcagaagaagaggaagaagagatggctggagatataaaatacttaaatcactgtaagatgaagaaagaagaacttattagtgggaaaaagttggaggatgaaggaattgaaaaagaaaatttggcaacattagagaaaattaggaagactcaaagtcaaggccatttaaatgtgatgtggtgtttgggtcagtgcaagtttcagatggacttatgaaagagctcagggacgtatgcagatcatggagttataaaacataaaacaggtctgctggaatttttttgtcctcttcctgatagagaattaactcttacatgatttttatcttctggcaaaagcaaagcaatattgcttgaaaaggatttattcagtggaactcgtaaatgacagtacatgactggcatgttaaact

SEQ ID NO: 130490 - DNA, 1154 bp, Homo sapiens
tgtgaaagctttcctattccaatgcaatcctttgtttccatcaaattacaaaaatgactctgtcatcattattccatttgaaagtagtgaaattcaaaattatgtacaaaatcctcttcatgcttcttgtgtgtttgttgtttttgttgctgttttaattctaagccaactaaagagtttcacttccatgtctttcagagcctacatcatgtgtacagctgctataagcttgatgtgtcttccatggtaattaatgtagcttctgcagcactttaaagatttggttttaccccagccttatacttcttatgcttcccatcactttgtagtcctaggaaattaggaacctgcatgaaaatattgcagcaccggtattacaacacacccaggtcttagaaccaaatgtggccagtatagcagtttattactcatgctctgtacagcagcatttctcaagcagtggacatgttctcactatccattacgaatcttatattttatacctatgttgtacagcttagtgttagctgggaaatcaagttaaacaaagatattagaacagccaaaaatacaggtttcaggatttcagcttcagtagtgatggtttataaagtaagagaccaggaggaggagcagacttaaatgatccaagatgacagtttgtctttggccttcctggtcttttcgttcaaatatttttagccattttgcctgccatgtatagagtttcagacacatgtaactagcattagagccttactcatcgaagatgccaaataaatttttggtaattcagtgcaatcagtagtgctggagaagatcttataaatacccttcaaatatcagcatatcaaatgttactgcatgaggaacacctactgttgaggtagggcagacctgtcttatttagtttctcaaaagttcttctgaaaatgcatagacccaatgatatagagctaatcttatagatgaaaagtaagtgtgctaaaattattctttgcatcactggtcttacacacagtgcaggcttagtagagatcaaaaattcattccttgtcaaatacagcatcccaaaagtaaccaacttgataacctaatttttagtaatagttaagtaaccataattacccttatggtttacaaaggcacttgta

SEQ ID NO: 130491 - DNA, 1575 bp, Homo sapiens
aaattcatctaaatgctaataaaaattatgtattttgttaaaattggtaaaaaatataggaggtaaacaatggaaacaaatgatgtgctgcatggagctcatttcactctgctgaattctaaagtatgcagtaaaatattttaagtaatttcagtgtcttttaggatttcccatactcccttgtcaattaaatattatttctgttcttacattttgtcttacatttttaaaaaataaagtaaaaaataaggaagcttttaaatatttagttataagatactgtataatatgtgcataagatttacaactgaagcaaaactgtacaggacatatcaaaggcacagaatattgtcactgataattctttaggcacccattgtattggacataaatatgttttctttgcaattatactgtttccatgaaatacttcttttagtgatcagcataaaattgtataataattacctttacaattttgagatttagtgtatttcttaatttaaggatgctacctttagggcattattaatacaactgtataaaccagaattgtaaacaatgaccagtgacaattgcatgagatgtgagtagacttggcagctctgtgagatgtaggaagcacatggtatcaagctatatgtcatgaaaagtaaggtgtgcaaggtacacactcattgagaatatcagacaaaaaatgcctctgctcaattttcaaaaattagtctctcttttgaaatttgtaatgttatattaaactttaactcagtatgtattgctcctagagttatttggctcagcagtgtggaatttaattttgtaagaagttgggggaatatacagaaataaaatattaaaatatattacattttctctggtttgatatctaaatacagtgaatatacaaaaagatagttgacttttggactttttaaagaggaaatttcttaattatttgctcttgtcccttacagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatataggtagagtaaagttgcttctgctcagatttaaccttgtctcagacacaaaattagtcaaccagaattttgaagctacattttaaactgtgatttttattcttctctcataattgtggtgaaaataaacttgaggccccacggtgattaatatttttcaaattaaggaaatttaatgatttgctttaagaaacttttacatcctttaagaaattttaaagcatctcttcttatcctatcaatttataatataatagttaaggatttttatcatatgtgacttggaaatgcagagggaaacagtggttcctaacattttagctttaggtttctcaacctgttcaaccttttagcttttgatatctatatatctttttagataaatagacaaactcttaatcacactggggatatttctatttaaagaatccctaatatttgtatat

SEQ ID NO: 130492 - DNA, 1015 bp, Homo sapiens
gtaataagcataacacattgttattgacactggttatttaaccagaataaaaggaagatgattatttacacaggtttaggagatggggacattcacctcatgtataagttactcttatctcttttaatatactaatgaatgcaaaagcagactctctaagtttgctctgaacacattttatagtcctttaaatggctttttgccatctttaataaataatttgttaatgaatcattttaggaatgaatgctatatctctaccagaaaactatatatttaattaaattgcatattccttttcttcaaaagcattttaatttttgttatttctcattaaaaccaaagccagccaatccattttagtggctgcactaaaacaattcatacagtgtcttttacattcacattgtatgaatataagaaactgtccttttatattttgttttctgatatttttaattcattctgaatgatgtactgaggggaggagaaatgtatttatagcttcctaaggtagagatcatgttctacccaacaattcttaaagctggtttgattctataaaaatgggccaataaatctgccagtcattcattttgtgaattttccctttatgttcaatttcaatattctctgtcagggaaaaatgaggaaatattattccttcatttgggtaggaattccctctgtactcctcgctctccctgtaacacaaggtgttagtagtaataaattctatgtgtccattttgaatgcatggttaatgttggggtgtggcaaaattcttatatcctatttaaccatttattctaattataaactctatgcagcttaaccctgtaattgacatctgaagttaaactgtaggcaagatatttctactaccaaagaagatagtgctgagagcagaaaaaaggcagtagaatagagctccatgagacaatttttttcttgttctttgttctttgtgaaaaataatatcatttaattaaagggcatagcttatctgggtgtc

SEQ ID NO: 130493 - DNA, 1008 bp, Homo sapiens
agacgaaagttcaatgaagacagaaaatgtaattgcgtggatttgggaatagaggggatgattaagtccctgaggctcagtgggattgccagaagagaaactagaaagacagacatcatatatagatttagagaacatacttaaacttcagaaggagtaagaagacacacaggaaaaatatgggactatgtaaagaagtaaaattctatgatttataatttacacagaacagacaatttctgacagaaattgtagtgaaagcattccatataaacccttttttgttttaagaaatatctacttgcagaattaggtttctgaaccagccttaatattagtggaaactaaagacattggagcctaccttctgtctgctcagatgttgacatgttagccaataggaatttctaaggagtattctacttctaatgaagatgttgtattttgtaggaaaagctcaagactgttattttatgaagctgcatcactgtcctggaaatcacagttgggatagcaccatttctggatctcaaagggctgcattctgtgatcacaagaccactccatgctcttcagcaataataaatccactctcaactgcaggaaactcaggtaaatatttactgtgaaacaccttgtaagtgatgccattgaccttacatatctgtgttcagtggatttaccatacaatgaggtttgtctttatttcctcaatatgataaatacataccttcttaagtaggaaaacaaatcccaggagatgggaatgatgacatggcccaaatggtattctatgaacatctaaatagggaggcagtgctaagaggaggtattaacatattactaatggtaaagttatttttgtttatttaaaaaatttgcaggtatcttttatatttgaaataaaatggacatcaaacaaaactgaacaaatcccagaagatggaaatgatgacataaagtggtttttgccccgtgatttataccataggaaaaggcaatgccttt

SEQ ID NO: 130494 - DNA, 1035 bp, Homo sapiens
gttgctctccatctaacatatagtatgtagacttcgtaatgtatctcaccatactccaatctagcccttattaggtttcttgtcatattcctctttttatctctgacattctgtgctctagcatgcttttgttggggagtccaagttcattctcagtctcgaagattcaataggattcacaggactcagtaaagatggtgtacttgtggttaaattttactatagtgaaaggatacagattagaatcagcaatgggaaaaggttcacagggcaaagtccaggagaaaccaagtgtaagcttctagatatccactcctagtaaagtcactggtgcgtggtgtcgagggatgttttctgtggggtcagtcatataggccagcagctcccatgtgactcacctctgcctcccagagcaaaaactggtattcacataaatcacattgttaggataaactctcatggttacactggtatagcattgccaaggccttaggcatgcaaaactcatgctcatcaggtagagtattcaggggctcagaagttatttctaagaaggtggcagccaagcctggttctgaagacaggcttttgttggtaatgtaaaaggttggaacaacgcaggcctgctgagttaatcctttcaggcacaaggctgaatttcttttgactccttgaaggacactcatatttgctctctttattaagctgccacatggatttttatttggcttggaatattttccctttctaatggtacactcctctgcccatttgtgtccttgaagaaccagatactttctatatgctcctgcatacttctatttagtttgcatcctttaatactacagtgtccatggcagcttgtattcatggcatataggttacatggggaaaaaagaaagataggagaaaaatgaagagatcaaggcattagggctctcaaccaactggaagaactggtgcagtgggaataatgttaaaaaattgttgtcagaaagtgaaatagtagtgtcttaaggttttagagttacaggt

SEQ ID NO: 130495 - DNA, 1047 bp, Homo sapiens
cctcccacctcagcttcccaaaatgctgggattacaggcgtgagccactgcgccaggccctcagttctactcttatttttttttattaaatatgttccttcatacccaattagccaaccataagccagattctagcttatccatcattttaaattatcaatcataaaatatacaatctttatactgaaagtcaaacactttaggtatgcagagtttaggtattcatataagagatatgcatagataaagttatatatcaatgcataaaaataaagtatgaaaaataatatatggatggatgagaaagtaactaaacagagagtgatgtaacaagacagtagataaacccatgattaacaaaagtcacaggaaaccaatctgcaataatcccttagctctgtgcttagttttataacatctctaaatgaaaactagcatattataatcactgcttcaaggacacatttttatttgaaagacgtacatttatattcttcagccatgacaaaatcacaaatattttgaaatttttccacattctctttttcaacgtacaccaaagaattttaatacagttcaatctttaccttcgtttacttgatacccagtccttaaatttaagtccaggtagttccatccaacttccaaagctgattgtcaacatggagccttccatattctattagagtttaaaaaaaaaaatgtaccgtcaaaaaacaagaagtaacatggttttttttggtctgttttttaaccatatccatctcatttacaataattatgactctggacaaggtgcgctcctgcagtcctaaatggttggctaacttacctcaaaaacattactccaataaactttcatataccttcatcacttgatattatcccgacaaccttctttcatatagttataaatttataaaacaaatttacaatattatccaatgcctacacaatgttgataactttggtctatgatcaacataattcagatgtacaatattatgtcagggaaacaaaaattcagtatattcattttttgaacaa

SEQ ID NO: 130496 - DNA, 2088 bp, Homo sapiens
ttttacagctgcactttttaagcgtatggcatggcttaaactcttctccttgattaattaacactgtcgagttttgtttgattaattttagatgggagaagttgagagaatgatgatacatcatacagctgctgacttttttctattttttttttgcttatttcattaggaattagatggactgtgttctagatgatttcaccaaatcacttctctttttgctagaatcattttagttgctattggtaggacttactctataacagacttgacttgcttttgctgcatggctactgcttatttatgtaaatgttctgtactgccatctcatttccctgtttgctgcagctattctttttctatattccctccctatttttctttttcatcccttctttctctacctctgctgcagacccaccagtcttgattttcataatcactgcgtcagttcctgaagttcccttgaatttaggatattttcattgtgtacatcaaacataaaaattatttgaactgtatccaacctgatttgaatttgaaagactgtgagtagtagttatctcagacctctgaaaaatgccagtaatatgaggcatttctgtttcttaatactattttatatgtttttactgaaatatatgaaataaaactgctttctcctcagtggtttttccttactatgctacaactttattccccaggcaacctctaagaatgtttagaaaaatgttgccagtagttattttgacagctgttttattaaaatgatgtcttcccatttatgttttgctatccctattagaaaatatgaaaagataagatgtaattttgtttcactatatgatagaaaaatcagtctgtaagatcgaatccctgcaagtcactcttgtaggcttgctctagagattcagaagccctgaggcagcctcgttaagagctggtgctcttaataaggtagacctggtcaaatcccagctattccatctgagttcccctatcttctgcaggtttacctaacctaagtctctgttacctcattggttaaaactgagataatagtataatagtaatgaagttacatgaagattaagtgagatttcatatatatatatacacacacacacatatagagagagagagagagtttaagatagtatctggaagcattcaaatgtaaattagtaacagtaaaaataaacacagtaagtccttaacattgtcagtaggtttttggaaactgcaactttaagcaaaattacataaccaatattttttctcattattacaacaaaacaacatgattcaaggaactgctgtatgtcatctcacttacagttgcagtttccaagaaatatcaaaaacattaagtcaggacttactctatctgtatttaaggaacttctggtcttttagagaggatagggtacaaatataaataattataacagaaggtagaaattgataagcatcctgggaattctgtagctgaagttttgggagagttcttcacagcaggcattatttttagaagaaggggatcaggaagcctttgctaaagaggggaagaacatgttccttgaaacatagtaggcactaaataagtattgaatgaatgtacctttaaagatggttacatgtgggaagagggaaaaaaaggaattaacttccttggcagagggagaaatatgaacaaaagcagatagagggtcacaggatatttattaggagatgattctggggttttgttttggttttgcttttttcttttttgtgtgattcagttttaaccggcatacagagtccacgaagaggaggctgagaagtgattaggaaagtaaaatggaaccaggttatgaagagccttgcacatttcagcgggtcaaatgcaagggcttgtgttttccttggtaggtgggagaagtcacgaagggtttcaaattgcatatgataagggcatagctagactttaggaagatgcactcagcacagggagtttttgattctgactctgtaaggtgctgtagaagtttagtgagtttgtatttaaaaggacttcagaggagaggtaatttagcagcagcttct

SEQ ID NO: 130497 - DNA, 1185 bp, Homo sapiens
cggctcactgcaacctccatcccctgggttcaagcagttctcttgcttcagcctcccaagtagctgggattacaggcttgagcatctttttttatagtttcctgatatttttgtttatcaagttccaaacataatattgtgattgttgctaggtaatacattaagtttttaagttaatttgagggaacattgactcctttcagcattgctttccctttagaaaaatgatgtagccttctatctgtttagataacctttttttctttttctcttttttattgtattttaaattttgttgttgttactcctgaaacaccatagttagataacctttgatagccttcagtgaggctttactgaaaacacaagtttgacatatgtaaagttgactaacatttgaataacaaaggtgttttatttaatatttgtcatacctatatcatatacacttacatgtatgtgtgtgttcgtgtacatgtgtatgtgtctatcaacttatctttttttaaaaaaaaatttatctcaggagaaccatacagacttttgactggcgttgagtacgttgttggaaggaaaaactgtgccattctgattgaaaatgatcagtcgatcagccgaaatcatgctgtgttaactgctaacttttctgtaaccaacctggtatgttactaattttatttcactagtttccagtaagggggttgaaatcacaaaatattctcttggtttgtatgtgagagagagttcacaggatttgtcattttatagagctgtgtagacttttttaatgttaacaaaattaaatacttatattgtggcagtggtaccagtggtatttgttcattttgagatttgaagtttctatttcagtaatttactctttgttttagttagaaactcagaggaagtaggacatagttatttttatttgcttactaaacatttattgtttactattagtttggtgcaaaagtaattgctgtttttgccattagcagtaatgtgtttttatgtgtcagtaactgtgccaaccctgcgaatagaacaatgaacagaccttcatgactctggctcttaaagaggttatgtagctgtgtggaaacgggcatttctcatataatacaagtttttgcaatgggaattgatttgttttattagggaaatgcttacttatgccccacagct

SEQ ID NO: 130498 - DNA, 2075 bp, Homo sapiens
tctttattccctattattatttatctttaacagctagctacttgacctttctgtgcttcagtttttttcatctataaaatagaagtaacaattgaatttaccttatagagctgttttgaggactgtatggtaaatattgaatctactacttactgttgttatttccttctagtctttttttctaagcatatatttttatttgtagttaaaaacatactgtatatttgtttcttttttttcatttaacatcacattataaacattttcttgtgcaatttccaggtgatgaacagcctccttctaaatcattgaccacatttcttattctttcctgaggataaatttcaagatatcctgaaccaactgatgacagcctatttagctacaggaatactctggaaggaaatggtagcttctggagttttaactggagtgttaatcttgccaccatgacctaatggaatatcacataacctccctggtgtgaccattaagcttagcaggatctcagagaatagacagaggaatatgcaagctggttatcagagaaggctctggagcctgtcagtcagtttgaaccttggttctgcaactttggcaatatatatattttttatcactctgagccctttctgtacaataggataaaactaatacctatttcatgtggttgtttggaagattaaatagtttgatatgtaatcctggcaggtggtaactacttaatgaatgttagctcctattgttcattatattagatacctaaagtttgttttatgattaaatgcgagagaatggcagtgatgttcgcatgtaatgtgagtacaagctgttaacatataaaatagggcaatacaaatattttttactccgaaatggattgattttcctcccatttaaaataaataacagaaatattctgttttatgttttgtggccagaagctagcatgggaagaggcatttgatttaataatccttatagagaatttttaacaattttcttcagtaattcaaaggtggaaagtgatttttgtccagattattcttgttgaaagacaaaaatgctttatgttagttttttaaaaattaaatttggtcgggtgtggtggctcatgcctgtaatcccagctctttgggaggccgaggtgggcagatcatgaggtcaggagatcgagaccatcctagccaacatggtgaaaccctgtctgtactaaaaatacaaaaatttaacggcgtggtggtgtgtgcctgtaatcccagctactctactcgggaggctgaggcaggagaatcgcttgaacctgggaggcggaggttgcagtcagccaagatcatgccactgcactccagcctggctacagagcgagactccatctcaaaaaaacaaacaaacaaaacaaaacaaaacaaaaccaaaaaccaaaacaaaacacaacaatttaatttaagcaaaacacctgcagctaataatggtagcatttgtagtgcttactatgtgctacacactgctctaggtgctttacctgtaataactcatataatcctcacaatgccatatgaagaaatttattttattgtccccattttgtagatgaaggaactgaggcacagagaggtcaaataacctgctgaaagttacatagcttgggagaaaattctgtgctatgtagtccagctccagagcctgtgctttttaaatcagaaaacaaagaataataattaagtacaataccaatatgtttgcagtgagtttgtgttaatacaagaatttgattactattaaattcaagagcatgttttaaaaaattcatctgttttttggaaatatatgtatgcaaatttaaattcattttccccttttagtttttcagttatgggacaaaaatattatatcaaaacactgaagctttgcaatctaaattcttttcacctcttcaaaaagcgatgctaccacctaatagttttcaaggaaaagtggcattcattactgggggaggtactggccttggtaaaggaatgacaactcttctgtccagcctaggtgctcagtgcgtgatagccagccggtaagtc

SEQ ID NO: 130499 - DNA, 1052 bp, Homo sapiens
ccattggagcatttgctttgtatttgccacttttaaagcagttttttttcttttgtaattttgctataagaatgatacagttagcatctgttgtcaatgtactgtaatggagcccactaatgttctacatccctcctctttcatggagtacgattttggaagcaaagtaattttcagcaatctgaaaggctgtttgatatatagaaggagttaccagaatgattaacataaccattcttattttttcctatcctcaaaatggtactcctgccccctcttccacccccgtgtttcccaggatgtgctgagttttctttctactctggaacatgctgagagaaagagaaactaaatatatggagcagagaaaaaacttatctgaatattcttcaaaatactttccttgtagtccttcaaatttaaatttctaaaagtatttgctgttatgtaaaagatgtaaacttattttgatccttttgcaaatattaagtattgtcttatcccgtgttatgaataaataagaagtagagaaatcactgatttctcaggacctaaagattacccttttaagcctttatttgtttatttatttatttgtttgtttgtttatttatttattttttgagatggagtctcactcttgtcacccagactggagtgcactggcatcatctcggctcactgcatcctctgcctcctgggttcaagtgattctcctgcctcagcctcctgagtagctggaattacaggcatgccctaccacacctggctaatttttgtatttttagtacaggcaggatttcactatgttggccaggctggtctcgaactcctgacctcaggtgatttgctccccttggtctcccaaagtgctgggattacaggcatgagccactgtgcctggccttattcagttaatttattgagaacctgctgtgtcctagacactattgaccactgtatatgcagtatcactttgtaatatagcttttatacaatcattttaaaaagaaatttagaaaacaagaaaaaatattttatatttacctaca

SEQ ID NO: 130500 - DNA, 1023 bp, Homo sapiens
tattacagacattgtaatccaatgtacagggctatgagtaaagttataatgaactttgtaactacaagactgaactccagaaaatgtgagggaagggcatgaagcactcacgtttttatgtgaataatgaatacctactctaaaaatgtgtattgacattggacaaaagtatatattctaaactacaaatggtaggtggtgtagcatagtggttaaggacactaaaatgtaaaggttaggttgtacagtagagtgactaagggtacagactgaagctagacctcttgagattgacaaattggccatatgacatagagaaaatgatttaacctctctgtgccttagttacattatctgtaatatagggaacaataatagtacctacctgttggggttgtaatctctggcatgtagtaagcatctagtgagtctcagttattactgtctttaacatatggtataatatttcagaatgtatgttgttgattttaatttttaggtctcttgcagctgaatggggtaaatatggaatgcgattcaatgtgattcaaccagggcctataaaaaccaaagtaagttgtattttgcttgttatcacattgtgaatgattaaataatgaaacactgataggtatattctggttgttgtgtaaaggactttccagagatgcctaggtttagagccctggttctagggaagaggcctttgcctttattcattatcgaatataagaaataaggaggcgggcaggaatatagcagctatgcaatttcttcataatgtcaatttcagtgtcttaatcgtttgggatcttttataccatcaatgttggcactttgtctgatttgtttcagtggtctgttattgtcctgtatttgttaactttcatgacattttaaaggctcctacattgtctgacatccttttttaaaaaaaatcaaggaaatgtaactatatttttagtttgagagatgctttggtaacttattatataggctttgtcttgttataggtaggtagca

SEQ ID NO: 130501 - DNA, 1858 bp, Homo sapiens
tttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttcttctcgcttttctttctttgtctttatactttaatgcatgtagagaaaagaccctacatgtcatgtagggtggattcaggggatatcctgaatcccctgaatcactccttgattgaggggatagggaggatgtactcctaaaaatgagaatgttgataattgaccctccatggggtgcttatggttcttgaagaagctttaaggagaagttattctgacgtcttaaattggcactcactccagtttttttctatatctttaagtcatgaaatgccaactgccaaacagttgttagtcatttgtcccagccagtggcaatatttatgatgcttttcataatgtcaaaggactttaactaatct

SEQ ID NO: 130502 - DNA, 2481 bp, Homo sapiens
aagtggtctgtaatacttttaattttgtcttcaccaggtagttcattgcaaatagtagtgcttctcactaagtgggcttagaaatacctatggacatttatagtcatgcaaaggtataatactacattaattataccaacaaagtttagccagctgttacctctattgtagacattttttattccttgaagaaagctttttggtacaaagagacaggtttggcttgtatcaagtgaaccaaaaggaatgtgtgttttcctaataccatgtcatggttacctgtagactttggtcctccactaccaggagaagcagcaaaggaaagaataaacaataactgtgtgtaaactatttaaaaatgtataaccctttacctaccatctttgagaagcaccctgtttgaagcatttctaagccaaatatttattggatttatttcttttttttgtataaaatattgataactgtaatgttttatttttattcacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatac

SEQ ID NO: 130503 - DNA, 1382 bp, Homo sapiens
ttagccgggcatggtggcgggcgcctgtagtcccagctacttgggagactgaggcaggagaatggcatgaaccggggaggcggagcttgcagtgagctgagatggggccactgcactccaacctgggcgacagagcaagactctgtctcaaaaacaacaacaacaacaacaacaaaaagtagcggtgtggcggcatgtgcctgtagtcctagctacttgggaggctgaggcagaaaaattgcttgaacccaggtggtggaggttgcagtgaggccagatcgcaccactccactccactctgggcgacagagcaagactctgatccagacaaagcaaaacagatatttagagacagagtagcatattgaattatcagcaccagaatgccattctagggttatctggcttcaaagctcagcgaccacactgctaattaagaatgcttatgaagaatgtttaatgatatgaggaagacttacaaaactgtttttacaaagttatcaatgtgtggattttatttacatgaaagaaaaaatagtcacaaatgttacctttcaatggtagtataatagaatattaaaatttacttttatttcattctaaattttctacattctgcatgtattctctttataatcattttgtaaactcagaatactgttgtaaagatgtcagctccttcccgaggaaataccactagttagacttaatacacacatttttttatgttgaattgaaattttacttggtaatgaatcattccctttaatctactcttctagattactgatctctcattacccaactatctgatggcatcttcggttggactgcttcctacccagcttctgaattcttacttgggtaccaccctgcggacaatggaagatgtcattgcagaacagagtgttagtggatattttgttttttgtttacaggtgagtttaaggccaagggttgtctctttttttctctctgtttctttttgtatggcattgctgatttgacagatttcattgaaaataatcagagggtttttccattttagatttttttcttggttctttcattactactacatattttgacaacattaaaattttttaattgtgtggatatatgcaagtgtagaactgaattgatacagaaaaatcctcttaaagaggcaaaaaagaatgacaaaaatagggttatttttgcagtgattattttcagagtcatcacaaatcaaatactgtattttgattttgtgtgaagtgtatctgaaaataatttcagtaagattgggcagagttgagtgcttatcttatttatattcaaattattgaaactcacctatttgtattttttagtgttatgttgagagtgtaaatttctttcta

SEQ ID NO: 130504 - DNA, 1532 bp, Homo sapiens
atctgttcttaaattaccaatttgaatattattgatgtcatctatgaatgtcaattatgtgttctatttagagaagcttcattacatttaaaggtaaaggttgtggccagaagtgttgcattctgaaatttttgaactgagatatttattttaaagataacttccataatatgtaatgttttgttattaactgcaatataattttataacattcatttttgtcatatgttctcattttctttatttgacatgtttattctaaagaaatttctctgctcctgtaagtgctctaaattgaagaaggaaccttgctcagcttagctccattcacatcattctttgactagactccctggtacctttcctctgagtataggctccttcctcttttatccaaggccccaacaagtatcaccccatgtagttttcctgtctttattttacgggatttgtgtgtgtcgtataaacaatcctagctgtactgccaactttatgaatatattctgtactttccctgccattgcactctagcctgggtgacacagcgaagagtccgtctcaaaaaaaataaaataaaataaaataaaataaaataaaataaaatgatttggaagctgttcatcttttgttcattctcttcttgaaacacctgccttcctcatcctatctatctttgcttgccaaactcatactaggctttcagtgtctgccttgaatccctctcttcccaaaaagttacgctttggtttccacttctacaactaattttcatcctttattctttaatgctcagcatgtaggccttctcaatgctccccattctgcctgtttctgaggtagtttatgtgtatttgtcagtgtgtaaatccatcagtggtaggcattgtgtctttttatctcttccaagcacttcttggagcatctcgcatgagcagttgagtcagtgatcgataaggtggattgttaacaaccagtcactgtaatattctttccaaatcagcagtgatgcatctccagttcattatctattaatatagttgaatgtagttttactgaaaatgtgaaatgatttttagatttggttgtattaatagttatagattcacctatagctgattaaagtatcagattttaaaatttgtaaaaaagtttaatatagtggccagtagctttcttatataccagtaatactcagatggggatgtggaaaagttactttcaaaatcagtagtagtggcaacaataataacatgaagtgcttagaaataaactaacaagaaatgcatgagatatgtgaataaagtgaccaaactttagtaagaggtataaaagaagattttgagtaattatagaaaaatttctggataagaatacctaatattgtagagatttcaggtctatccagattaatttgcagatttgccttaatcccaatatgaaatgtactgattttttttgagtgacagaatgatctgcaagaataaatatggccaagaacagttatggccatttttaaaagaagcgtaaagaag

SEQ ID NO: 130505 - DNA, 1845 bp, Homo sapiens
gtgttactggaatacagctgtgctcatttatgtgtgtgctatgtgtgtctccttttaagccaaaacagcaaattgagtagttactacagaccctactgcctacagagcctgaactgtttactacctggtgcttcatggaaaaagtttgccaacttctgccttagagtcacaccaacaaaacagctaccaaggctgagcccctgcaactgtaggaagaggcccttaatttctcacatatatcttgtatttttatttaacagaaaaaaaatttttaaagcaataaatgggtactgtgtgtaaaatgcaaacaaaatagaaatgagtaaattttaaagtgcaagaccttacccatcaccctggctcacttcttagggaactgctttatagaattgaatgttaccaaactgccagttactttggttatttatatgagcccaccataggtttgaagcaacaaatagattctttgttttggagggagccggggagctgtgaaactggtactgactgaaataataatagtgaaagatgtcatcataactttaagcagatataactgttctcaagttttctttgagtttgcattgagctatcaagaagataaattacttttactaatttagtttatatttgaactgaaatttattacaactaaataaaagtttttggcaaatgactctaagaccacaaatacagtatagtcttagcttatgctatggggtcttctggttctgtcttagctcctttgtagccctggcgaagtgatttaatgattctggccttcagttttccttatttgtaaaatgagagggtacagatgaggtcagagtttgcttttaaaaagacaaatgttctgagcaacagtgtaacattaccttttattttttaacagtttagtgatagtatgtgttataaaaatacacattttctcattttcttgagttcttattctgtaatatgttttcttattttcttaattcttattctgtgctgtagatagagccatagattcaaaaaaagatatgatcggtcataatacttgtcactgtatcagtgtatctaatgatgatttcttcttactattaaagtgtaatgattcgctgccagtggtacagttcaggcaaaatagaaaggcagacacagtctgtgttttgaaagagttggagtctggcccttaagggtcagataggatgaacaagttgtgtaatgtcatctcagtgcacatcctgagacctcacaataccactgaatgcagttgacctttatttccttgaaactgttttcccctctttgtgtctctttagttatctcatcagcttctgcagtttttgtgtcatatgtaggcttacaattcactaatctatatctctagcctgttatattaatgtatatagagtatgttttattaacccttcctagattaaaaaaaatttgtttaaaagcaacgaggttattaaaacatgttttaacaatgtttgttttttctgtctgtatgtattcattgtaaaaactttgaaaagtatagcaagtacaaagaaaaacatcattaacattttcgtgtttatttttctctttgcattttattgatatgtattttaatataatattgagttaatgatttttgtgaccttcttttacttgaagtaatgaacatcttgttattacgtgtattacaacatgacttttaatgactgcacagtcagctgtagttttccatctttgtatcttttttattctgcttagaactgggtcttagatatatatagaaggcatatgatacatgttttagtacaaataataaacctatagtatgtcagactgtatgaagaaaagcttttcaacttg

SEQ ID NO: 130506 - DNA, 1025 bp, Homo sapiens
ctatagtatgaaatataaacttgaactttgacccagtcttgggtaataataaataaactgtcccaggactttgaaagaaggttgggctaaggaacctaaatagattgattctgttagtttgtgtttcaatatagcatgtatccttgggccttttcttgtccatctaccgtgtgccaactactgtcctcggctctttccacatatttctgatccttaaaccagccctgcagaagttaattatgcacatattatagactagtgtctactagttgggagcacagggctggtgttgtgaaatcctgctgtctgcttagaatctagtgaccttgggcaagttgtttattctctctgggcttcagtttcttatttgtaaaatgaggaaagtaatgatacctacttccataggattattgagaagattacatgagatgaatacatgcagcagagcctggcttaacaaacacgtgttggcttttgtcgtttctgttgttatgacccaaggtcaccaaggtactaaattaatggtagagtcaaactttgaaccatggtctgatggcagtgtctcaaccaaccacctctttatttcttgaatatatatttaatgcctggtgtagtcatgggtaaatagtaagggctcattatgtatttatcgactgacaataaggtaggcttttcttttgattttgtctcttacatattaagtatataactaagaggttgtattttgtgcttggtaataatttaaggtaatcatgtagttgaaactgagcttgacaagggacaaatctcaatttagcattgtgtggtcaataaaaaagaagggaaaaaaaagaaaaatggcctcttgcaataggtattattgtcaccatttcactgagaagaaacagaggctcaaccatccaggaacttcttcagtcacccacctaccaagtggctgagctagggtttgaacccaggatcagctgatatggtgcatcttactgtaaaattttgactcagccatagcagggtggactgtgaagccc

SEQ ID NO: 130507 - DNA, 1015 bp, Homo sapiens
cacaggacttttgtctttcatttttgcctttttatttaccatttataaaagatctggtctggattatggaatttaatgtttatcagctctatgtattcctttatagaggcttgaggaagtatttcacataacatgttttataatacttaaccatttatccaaagatatatttacattgggttgtgcccctttcccttagatcatggtaaatttttcttattgaggtaattatgtactacttatatttgaaggaagcttatgacattttacagtagctaaaatgttgagattagaggtacttttactattcttctcaaaggtaactgatcagataattacccaaattattcaagaaaatagatcagaaataaagaacaacataattttctaagaattcattgaaatttatggaatcagctctcgcactgcccatctttgcagttttgaaaaagaaattgcttaatcacaaatgttctacagtctttaaatgtagtagaattagacagtgagatcatctgagtaaattgattggtgattccagagataagactaatattttaaattatttatgatactgattagtataaaaacgtactcatcacagaatttgaagcaaaatacatgtacacttcaaagagtaaatgacaaatgtataaatgctgtagctcaggattatatgtacctttaaaaatacactaataaagattattgttcaaaaattaccttgttttattccattaaaaataatgtcacttccagagttgccttgaaatcttgctgtaaagttttcatgtttaggaatgtacctgtttctttatataatattcatttatgttttttgtactattttcaaatggttttatttttaaaatatagtttttaaatccatttgtaatacacttgatgttaggtataaaataatcttacttcttttcctaatggttaactagttgtaacagcattgtatactgaataatccattctttccctcattgattggaaagctcacattaaa

SEQ ID NO: 130508 - DNA, 1484 bp, Homo sapiens
attatgagcaatcagaaacccaatccatggacctctttttgattgaactcgcccatccaagtgaaacggtgtctttttacctccaaaagtccttactgttggggattttatcatctatttagcaaaagcccatttaaaaaaaaatcagtgccagaactaatttttatggctatggggtctcttattattcaaagcaatattcattcagctacagagatctaaaaaaaccactcttctctttatccaaatcaagcagagatttattaccaatatgaggatggcttgtttttagagaagactggagctaagcagttagcatggggattatgccagaagaggaagataatctctttggctgccatttccatgctcctttgtttgtcagtacaactagtcccttattattagcaatgtcctattgtgtcccatgatagtaagaagttacatggattaaattccttgtagagataatatagtttagtgtgcttttttgtttacttcataacatttatagttactacaagtagcagtatggtctatcagttgcagtcaacagatacacctactcttataaggactttgtgtattcggtctgggggtatatttcataacaatcacatgtaagctgatacaagttccctaagcagatattttttaaagtttctaatattttgtttttatattgctttttattttaggttggcaccccagattttgcaaggcgatttcgagcaacctatgtttcttgggcaattgcttatctcctaggattgatctgccttatccgagcttgttattggggagccataagagtcagttatccagaacacagttttgcataagcttgtttatgattcagtaatgcaggtgagagtgtctagcagttcttggtaagctactctggacatctttaaattatttatcctaatggattccattctggtttatgtataatcgtttcaagactttgggagtcttttatgaacaaatgctcattgcactatattatatgcaaattgttttgctgctaggttttcaaaatttgaataataaagccttttcatgttcttttacatctcttatagatatttttggatttgttaccaaacattacatttactctcacccttttattatttttaaataagttatttcattacttgctgatacatgagtattcctaagtgtttataaatatttctataatagtttcacatttatatttacattttaattaaacagtatcaaaattgcttgcttaaaacctaagcaatatgcattttgcttgaactgcttactgtaactttaacctaagattatagtgaccttattcaggaaaaaaaaaaaaatttagtgtaacttcaaagacttgacattcttgtcagaggaaaaaaaatttctagatactgtttgcttgttttttgttgtttgtagaaagataaaatattttggtagtaatttaaaatacaagaacgaatatttat

SEQ ID NO: 130509 - DNA, 1049 bp, Homo sapiens
cttttgttgcagtttcttttggtgtcatcatcatgaaatctttgcctgttcctatatccagaatggcattgcctaggttgtcctccaggcaacctatataactataaatgttatagtttacatttaagtctttaatccatcttgagttaatttttaaatttggtatgaggaaggagtccagtttcaatgttctgcatatggctagccagttattccagcaccatttattgaatagggaatcctttccccattgcttgtttttgtcaggtttgttgaagatcagatagttgtacgtttgtaagtgtgtggccttatttctgggttctctattccgttcaattgatctgtgtgtctgtttttgtaccagtaatatatattgcatgtagataccacatatgtactaaatatgtaagagattttatgattaataagtgcttgttggtcattgccttatcctgtgaggagatggcacttgagttgtggagtagcagtaggttatttttttcagagaagatttctcagatgtagtgactatttaatttgagtgatgaaaagagagcacaggttttctaagcagaattcatgcactgaaattaatgtactaaagtgtattctcttggctcacagaaaagccgctctaatattcacttagaaacttttgacttattcagtacataattttaataagcttagttggcttctaataaatggtatattacaaactgccaaatgcagatgcacaggcagtgataagaaacaacaaccagatgtgatgtataaggcaagaaaaaccaccagtggatgcatagaaattaaaaccaaaaatagactagggctaaatgttacataaaagcaatgaatcctgcatgccctagtaactctagatagcaagctgtacaatatagtaattaatggtggtccccaggtcatccagatgtttgtgtttgggctcaagtacccaggaaaatttacgatgtatatttgcaaaaaacttcatcagtttttcaaaaagatttggaaattaaaggaaataattttgtatgcaaaat

SEQ ID NO: 130510 - DNA, 1024 bp, Homo sapiens
gatcttatagaaaagaaaaggcagagacttctttttttttgagacagagtctcactctgttgcccaggctggaatgcactggcacgatctcagcttactgcaacctccacctccggggttcaagcaattctcctgcctcagcctcccaagtagctgggactataggcacacgccaccacgcctggctaatttttgtatttttagtagaggcggggtttcaccattttggccaggctggtctcgaactcctgacctcgggtgattcacccgtctcagcctcccaaagtgctgagaatacaggcatgagccactgcacctggcctgacagagacctctgtggttagcagactgtgtgctaagcagagtgatagttgctttatatatacatatatactagctgtaatctttacagcaatcctgtaatacagggatgatttttgtaattttacaaatcagcaactgttaagagaggttaaggattttgctcaagggacttgcttggttaattattttcgtacaatggcaatatttttactactaataaggaagtattgaatgtctgaatactccgtgatttgttaaaatatcacaagacagtgtattaatatgaagaagaatttgtatcaactacttagggaacaacttacatagaaattcacatggaataaatcagcttaaacattattctaagaggaaggtttgtagaatcagagtcacatgctaaacatgggaggactcagagcattcattacttatttgagtgcaaatactgtgaccacatgaacactcctagctggtatctagatttattttctttttgaatgttttccttcagagcaaaatgatgggtcatctgttggagtaagattctgagacagaattttttttctttaaacacaaatatcctaaaattagttttaagttacagaagttggtaaatttattactgtgaaacaagtgtgttatgtgcttttatctcacaaaatgtatggggaaagcttcccctagagctccaaagactgag

SEQ ID NO: 130511 - DNA, 1047 bp, Homo sapiens
ccagtaagtcatttcaagtatctgaataacattcatgtgaggaaggtagcacatttattacttagatttacagggaagaaaattgtactaagcagtgtgtttttgttatattgtataagcaatgacagaacaggaaacagttcccgactttttagtttatgtacttggtgactttctcacataagtagaataaatagtttaattttagtaatgaatctaaatattcaagtatttaaaaggccagccctcaagacttaaaagaaaaataactttgatggtatatgaaatatgattgtattcgttggaagtgaactgagacttactgaacaagatgaccccaattatggtattacattcagtattcatgtaaagcaaacctagattgcgtcagagcattggaaaagtcatgggaactatttcagaggaggatctcatattgtattttaagagagggagagaagtattggagggaaaaactcatgtaaccgtgagaaggtgattgcttctgttgtgatccctgatgacatttaaagtaaaagaaatgtcttatcagattggatagttttcagttgttttcttttcaattcctctctttgtttattttacagtggatggaactgaggttcaacactctggcaaaatgcccacactgcaaaaaaatgtaagttccctaccattggaaatattattgagaaatacttgagacaaatttgaagagttcagaattttcacttaagtagattttgattttaaaacatgctgtggagtgaatccatgccaatgtatttatgctttttaagactaaaaagatatcctaaaacaaatatatcccattttgaaattaaaatgattaggcttgattatcatcatctaaagggaaatcaatttctattataagaaagtgaaattgctaaaaattatcagtaacctggttaggatattataatctgttacaaataatctaaaatttacatttataaaatgggctgtaatctaggagaaaactcaaattgttctggacttcataattaggtgattgttggcctt

SEQ ID NO: 130512 - DNA, 1057 bp, Homo sapiens
tggcttctagattgaggaaaaatttgaataataatttatcaaaaattttctgacttttataaattattcttggagcaaagggaattaacactgttacccataattagataaaaccattagataaagaataagaaagtataagtaatttgatatgagcaaaagttataaaagtttttgttttactacttctaacttaaacttagtttgattttttttaaagttaaattcataattaacttaccctgtcaggaaggataaggacaggttttcttttattgttcagcccatataggagacaaacattttctttagaacttgaatatgaaaaatatttatcagagtatacacatgggagtctaaacaaaacctgctgtcactaagacatgaatgagcttaagaaaatataagtggtttgcttttttttatttgtaattttacttttattaaagaactttatgtatatagttctaaatgtcaaatgggactgcaatcttctcatctagctgacccctagttactgttcccaaaatgctttcaactctttcagctactttattgatagtcacttctatgtgtttattttttataatttttaaatttttatttatttattcatttattttttgagatgaagtctcactccgtcgcccaggctggagtacagtggcgtgatctcagctcactgcaacccctgcctcccgggttcaagcaattctcctgccacagcctcccaagtagctgggattataggtgcacaccaccacacctggctaatttttgtatttttagtacagatggggttacataatgttggccagacttctatgtgtttaaattgcttatcctttttctatttgattaagcaattttagacattacccactaaatagtaaactgcaaaatgagaacttagcacttatactgccctcccactcatattcctttccttgctttcatactcccagtcaaattgcaacattttgtttaattaatacttagtgtttacaatttttatgattaggtaaattttgttcacagctgaaccaagcaatgtggt

SEQ ID NO: 130513 - DNA, 1028 bp, Homo sapiens
gtaagacttggcgaatgggcataagggttggagtaacaattctgagcatatgcctttttacatgattttcatttttgagccatgccaatatattactaataaaaatttaatatgtaataaatacattaaactttggctacattatattattggtatttgtgaagtttgtcttggattagtacctcaaacatgttaacaaagccatttttttaggctgtgtccccacatctctgtataggtccttgcagttgcatatgttatttcatcctgcttgattactccagcctataaagatattaataggaagaatcctgttttgagatggaagatctattactatctatacacttttccctaagaccatactcattgcctcatacacttattagccatttatagtcttttccaaatgagatctacttttttttttttttttttgagatggagtcttgctctgtcgcccagtctgttgtgcaatggcacaaatgagatctactttttcttcctataggtagatgagtaggaaagggattcttaaaattgtaacatttaaattctacacatttgctgaggctcctttctttcatgcagtcttttctaatttctgttgctggaatatatatgttcccaaaacaatacctcatatttgtactatatatctttttgtttttgtttttgtttttttgagacggagtctcgctctgtcgcccaggctggagttcagtggcacgatctcggctcactgcaagctctgcctcccaggttcacgccattctcctacctcagcctcccgagtagctggaactacaggcgcccgccaccacgcccggctaattctttgtatttttagagatgggatttcaccgtgttagccaggatggtctcgatctcctgacctcgtgatctgcctgcctcggtctcccaaagcatttgcactacatatcttaatacttatctatgcatatgatcccataaggagagacaaggagggagacaggattcctgtctcatcagggagctctactata

SEQ ID NO: 130514 - DNA, 2314 bp, Homo sapiens
gttagttcccacctccaagatgaaatagtccatttcaggttgaaagtcggtggagtgtttatttctagacagattattaataatgtagcagggagcagttagtattgtgtgtttggttttagcacaagaaaaatcatgtgtggtctgtgtaacaatccatgttggtttctaagtggagcatgtctagtgttctctactgtcagtattggattcatgcataggaaattgcttctctcctgcttgcagtgcttcgtttaatatacttgccagtttttgtttaggtatagaaattaaaattaaagagagttttaggctcatctgaaaggagattggaagaaataccacaaaatttacacagttttgatgtattaattgattcctttatacatctgctaattttgtagttaggatataacaaaagaatatgacctttgaatttataagattttttctgtgaaaattgtttatatctggggttgtctcattatgtattcaatatggaaatgggattatatacttcactataattcataaagggaaaataataatttgttatacagaggcagacagtttgatttacttagtttattattcagcaaataaatatttgagtaccagccaaatctgtggtaggagaagaaaaatagtcatggctcctcttccagtgtagtgggggtattgagaaataaattatgtaatcacacaaacagatgcaaaatgcaatggtgatgaagacagtgctggaaatatatgcaataccttgagagtataaattaagatttaattttgttgagggagtcggggaaggctttcttgatgcttgaatgagatctgaaagttgagcaagagttaacttggcaaaaggtggactggaagaccattataggcaaagaaagcagtattggcaaagtgatcagcagggtggagtatgacaaatacaaggaacttaaggaaggccaacgtggctaaaatggaaacagcagtaggaaatgcactgcaaaatgggactggagagataggtatggtggatattctccgaagactctctttccccttcaaagaactatgtcttctgatattcagtttcctccccttgaatctgggctgatgccatgacttgattttgacctctagaataaggtagaaaatatgctgaatgactttggagggtaggtcagaagaggttttacagcttttatcttggtcttttgtaaagtacactctggggaaagtaacttgtcatgtaagaagtggaacactctgagactgccatgctttatggaacctgaaactagcctggtagagagaaagatgcctgaccagccctcagacatgtgaagggagatgccatcttggatgccaagctcaattgagccttcacatgactccagccttagccaaattcttactacaaccacatgtggccaacttgttctgcagcaacagatgaccagaataatgaatatgaatcagcccatccaggatattgttggtcatgttaaggaatattgccataagcaaagggatgactggattaaatctttattattagtttttaaaccactctatagattagagaatgaattagaggattggctagagtagacaagaatagatgacttccttgattattgtaataattcgggcaatttaactgaactatttcagtagcttggactcaggtggtggtagagatggagagatgaaggatgatgttaaggaggtggattgaacagggcttgatgatggattgcacatggaagtgagggagaagtgtcaagggtatctcctagaattctggctatgcaacgtcatggtgtgattaccagaacaccagaagacggagaacaccagaagaggaccgagttttggggaacacggataatgaacttagttttagacatgatgtatttcagatgctttcaaatatccaagaagagatgtgacaattggatctacagatcccatttctggcaaaatgggacctgtagtgtagatccggttgtcatatctcttcttagtcctcgtttcttaggactaagaaacggggcctgggctgaatatataaaattgtgtgttatttgcatattggtgatagctaaatacatggatgttgattcagaacttcccagggccctaccataagatgtgctgtgatggaacatacatgtgctaaggtagtgattaaagccttcaggccagaggcctccagtttttttggttttgttttttttttcttgagacaggttcttactctgttgctcaggccggagtgcagtggtatactcatagctcactgcagtcttgacctctc

SEQ ID NO: 130515 - DNA, 1011 bp, Homo sapiens
tcagttgcttttcttagaaacagggaccaaaatcaaagattaaagaggtcctctgaagcagggaatgaaatagacgttgaaaactattcccgttacgccatctctgcgcgcctcacgtcagggccaagagcctagcgcgtagctttatggctgactcggctctggcgctctagccaattccgaggctgcaaactccgcttctccgctcgcagtctggttcctcccctgccgccccgcccatcacggcagggtcacggtagcgcgcacgcgcagcaccccatttaagtttctcgtctttgcagtggctttgcttagatccggtgccgccttgaaggcggggctgggtcccagccgtagccaatggagccccgggtgagggttgaggggtggaaggtgcctactagccggtgcaggtttcttctagcgcgtgtgctggggtacctggtcgtcatggaggcggtattgaccgaagagcttgatgaggaagagcagctgctgagaaggcatcgcaaagagaagaaggagttgcaaggtgaggcggaaggaagtgggaatctggaagccgccgcgactgggggaagggcgcgtggcgggtcgattctggggaatctcaaggcgtgacttatctggatcaccctagacttcccctagtagcaagtggcctcttctctcttcacctaccccggcggccctttaattccccaaccttcagaggcttccccttctgaggcctgcggcgtgccccctaccccgcgccgccgccggggtgcaggtgtctgaaaatacctagaagccgccgtcttggtccgctcccaaacccacgatgcctcccttttctatacctgccccagttaccgatacttgtccctaatgggtgtattttgaatggacccgcctcagtttaggaggttcagaaaggataccggaaagatttaaaactggctacagtcaggtttttttccttctcttatctcgccaaacaaccgaaacatattcaagattttgttaatg

SEQ ID NO: 130516 - DNA, 1049 bp, Homo sapiens
aaaaagcttgataaaaagggtgtctgcctgtacccttttaaaggctgtgtcatattaacacgttactggtggactgataagaagcctggattagcctgggctttaatataataataatgtgctttaaggcctaggataactcagtcttaagagaatactttgaaatcagtaagtaaggtttttagaaacttggcatgtagcctttaagtagactttaaagaaaaattagagggctttcttaatgtccagtatagagcaaggtgctggaaacacacagatgagtaagagagtaaggagctcaccttgtagaaaattcttgagatgatcaatgtgatagtgtttgtgcgagaagggagaataaacaccggaaagttttgagacctttacatttcccttcccttaataaatgagaattagtccaaattattatgaattaactttcatgcattctgcttttcttaggaaaagaaagctgcattggaaaaggagcgagaagaacggatagctgaagctgaaattgaaaacttaacaggagccagacatatggaaagtgagaaacttgctcaaatattggcagctagacagttagaaattaaacagattccatctgatggccactgtatgtataaagccattgaagatcaactgaaagaaaaggattgtgctctgactgtggttgccttgagaagtcagaccgctgagtatatgcaaagccatgtggaagactttctgccatttttaacaaaccctaatacaggagatatgtatactccaggtaatttatttttctttactatgttttattgttgctttgttgtagttgtttttaaataaggtgcttcccagcactgagcgtaagaagaacccagatgatccttatgaggaaaaaacatcacaagatttaggcagaattattttctgtaattttaatagatgttggtgtatttttctctattaagatttcttaattacttagttattttgtaattataatatgctaatcattttatgtaagatagaagtaggaataagagtcatttttgaaaaaa

SEQ ID NO: 130517 - DNA, 1073 bp, Homo sapiens
catatggccagaatgggttgcagagagaaaggttaaaattgactttcctttagtggagtctgtcctccatggaggaaaggtagagagtgatgcagaattgataagaatgagcattggcagtcaagtgtgtctcctttagtgtgcatggcttaaggtatctgttgatagatttcaagaatgacttaagcataatctaattctgtagtgaattaatttcccatagatgtcatattggaaatgttaacttatctcttgctgttttaggtcattgctgttttctacataaacagaatttgctatgggacataaaacacatttttccatatattttgatatatgcataggcaatgtgataaatgactcttctgtcatttatctcccaaatgattactgaatcattgaaactccccaattgcgctagttgtagggcatagaggaggtggcagttcagtatgctgagtcagagaaaaacacaaaagacttaattaattatctccatttattcaaccaatattaattgaaggccgctgtgtgccaagcactactctaggcactgttctgaacgctgaggatttaacagggtatgagacaaacacatgagacatatttttcttctagatgtccataatttctttccttccatctctgtagtaaggataattgttttccattttaacatactgtgtaaaaaggtgtatgcacaaaatatacccattgtaaatttagtgattaggtcttttatttctcagggctgatgtgaaaagccttttccttggttagaactgatacttatgcaagtaatgtaagtgcttccaaaataacaagtggaggcactgtttgacgctatctctggggaaggaatttcaattcatctgtacttttactcgaattctcttcgtatatttcccagagtcttacagtaaacctgattatacaggaactacattttttttgtctttcatggtattcctttggatgcaggtttgggcttcaaaacacatgtcaagatagtgaatatggtggcaatttttggggtcaacgcttggggtagagtgaggtaggtttgttatata

SEQ ID NO: 130518 - DNA, 1099 bp, Homo sapiens
aaatacatatgtgtaagtcttttcatcgtgatagtagtattggcaatacatttgattttctggacttaggaaaatgaaaattttactgaagtaaagtaaaatttagcctagtagctcagctgatcaaagtcactattggaaaaatatcttttttacatcagaaatggaaaaaaaaaattatgtgaaattataggccaaatcctaccacaacatatatattaaaatcgtattttgaattcctaattgatagtgactgacttacttgaaagcagtagttggtgcattaaattcatatgtaagaaaacagtatgttcagtcacttacaggaagttatcaagattactttttagctctaattttaaaaaaatcttactgttaactttgttttgttaaaaacaaacaaacaaacaaaaaaaacaggtaggtaggccagatggtgatgaagcagcctgggtattaaataggataagaaagaaagttctgggttcaggtcctggcattttcttccacccctctgttttgtggccacaggggagtcagccatcctcccaagcttgagtttcttgattactatatggccataataaaccctctctgtgtattcagttgagcatttttgagcattaagtaaggcagagagtacctgcataaaagtttgtaagctgaagtgccagatggatgaacctaggcagtacgattagtaatatataatgatgattaatcatcatgaatagtctgtggctctaaataattcactttaagaactgcttcatttgaagatgcaacatgaatgttgccccaaaatctttttcttagtactgctgtgtatgtgcatttccaccagagggaactgtatccattagttttgtatgcctcggaaactcaggaaatgttcatagtagctttgttactactacattaggaataattaaaaatgcttgaactttcttaaaaggatcattcatatgagtattagagattaaatcaagaaattaagaaaaaccttttaaaacatcttttgagggacacttatacatttttttcatctgtgaattcatttgaagtaagagttgcagttttcacaatagagtaaatttaa

SEQ ID NO: 130519 - DNA, 1012 bp, Homo sapiens
agtaatgctaaaagtttcaacaagtgttaaaagttgaaatacattcatgttgcctgtttattccttagatttatttttcttcattttatgaaaatatcttacatgatttagaaatctcttctgaaatacagcatgcagggtttgctattggctttagtattttttagctaaacctattaagatagtcatcaatggctagatgacaatttaagctgattgaaccttcagcatctcagccttttcgttttaccccagtgattgaaccagatcttgctgactgctgccacttttcaaatggtgttgaactcttaattaatatgtccacatagtctattgagtgaaacccatgtggactgagtcattcagaatcattggtttatatatatatataataagcatatatatatagaaaaattgctttcatcaaaactactcatttctttttttttttaatttcagatatatgagacatgcatatggcttaggagaacattataattcggttacacggttggtaaacatagttactgaaaattgcagctaatttatacaatgttgtacaattatgttttaatacagtgtgctgaactgagtatttctaccaagtgttgggttgttctaaatgctactgaaaaacacaactaccttatatcagttttatggcaaagctactaacaggtgtttttagaaatatgtcagagataaactttaaccagtgtcttcttagtggaattttaaaaatttgttaagttcattgtagagaacaccattcatagaccaagatggtcccctattagctgatattttcatttatgtaagatcctggacattctgttttgtgttggaacaaattttcaatgtttttaattctcccttttctgcctgttcctaaaaactttcaaaataaccatttcaatgtaatttgtcttgaagaagtttacccaatatctttgtcattgcaataatgtagtatggtgatggtcaatttaattattgcttataaaatgaactt

SEQ ID NO: 130520 - DNA, 1057 bp, Homo sapiens
ttattttattagccttattaatgtcacctttccttcaactcaaatatttgagaaattttatgttacatatatgaatgaagttgaaagctactgtttggaagctaagacttgtatagagtagttttgtatatgaatggttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgtcagtcttttcacacgcccagcaggtaacaatgtgggaagctggcagggtcattgatagcaagtaagtacttcctgaaggctttccagttcaaaagattacaagccattctgcctgccaaacaaattatattctgaagatgcctgttttgtaacccttgatgtgaattttttggtgtctgaaatttacaaaagaatgaaattgaaattgtaaaacactaaatgctttgggtttattttgaagtaatctgttactttaaaatgtcaacattaggaagccataaaacaagatattatgaaacccagtattataaatgttatctacatctaaagtattttaaaataacttattggcagctttattctttttttccttacaagatttagaatctttttggttatatgtctatttttcaattttgttatatttttaatttaagtggccaatgtggttatgaacaagatttgtatggtcagcttctgttctttcctaaaacttcagataaatatcattttagctataacctaaaaaagtgtttaaataaaatgacagatgttaatttaaaagcagcatatgctaatttactttttcatatgatgatggtctaatggaagttacatatgctttcttttgtcctaactctgaaaagtatatgtcagagttctggaatatgtctt

SEQ ID NO: 130521 - DNA, 1038 bp, Homo sapiens
ttacttaagaggtggtgattgtcatggattttttttttttaaacaaagccttgtgatcagtttgttttgatagtaacagctttattattcttaggaaacaaataatatcaaagtaaagaagacgaagcataggtttggaagagggaaggcaaacagcagtgattaagaagctgaaaaattatctttctagcaactgaaagtcactattagcatctcttgatttactgttatgatattgatattcattataatccctttaaaaatttaatgatccttttttagaattctggcacttgattttactctcttactggaagaggtcttgtctctaatagcattctctcagtgaggcctttcctggtcatcctatttaaaattgtaaacttctcatttcccacactccctatttctcttttctgcttagattttcccccttggcatcaaatcaccatctaacataatagatttacttatctgattgcttttcttcccctactagaatggaatttccttgagaacagaaatttttatctttttcattcactcctgcaacagtgttgactatgtagtaggtggtcagtaaatatttgttgaataaataaataaagtgatttctgaatgccaaaggaaggattgatttctgttcagatcactttcagtgcagaatgtattttataatgttcaagtttttggaaacccacatctaagtgtgtcacatacatgtgtaatcctaatgcctctaagactcatcctatctgggtgctagtgggcttgtgataataatcaaatgttactggccacaactcccctccctctcctttttgtcaccgtttaaatcttttatttggaaatttttaaacatatgcaaaaataacaagactaatataatgaatgctgatatggtttggatttgtgttccctccaaaatctcatgttcaattataatccccagtgttggagactgggcctggtgggaggtgattagatcctgggggtggagttctcatgaatgcattagcatcctctcagtgctgtttt

SEQ ID NO: 130522 - DNA, 1013 bp, Homo sapiens
taagagatgtagaaatacgacaatgtaagaaacttattgttcttatattgatgaaaaccaaacttatttgcaatgccagtcatttacaacacaattcattagatacactgcagaatcttaatttaacagaatctagataataagccatacactttatctaatgaaatggaaatcaatgtaatgtaaaatagttttgaaaacaatctgaggaactgtattttttttttcaatttaggaaataacatcaagatttgtaatgaatcagctagcagaaaataaccctttcctaatggatgacatagaacggtacccacaagtcaggagcatgatctctcagggaaaaacatgtgcaatatgtggacagtactttataaccgtatggctggaatgtgttcgatttgttcctccaccaaaggtaaatgatgctttttatgcgaatatgagcataatactgattcctatcctttgttcttatctaaatcagttaatactaactagatttgtacctatgattggcttataggatagtatactgtaaattttggatagacaaatttggataagtgtcggtaataatcatcatcacccattctatttacattcatagactcccaaatttatcaaaatacatggattctagcaaaatttcatgaaagttgaaagtttttaatcagtaaatcccttttgttcatgaatattaataataaaaccagaactaaattcttctcagaagaagaattggtcagtagtctgtcatggaattcttggtgtagaaaaggtgaatgtgctggctagtttatatcatgatggtgttctagaacactaaatacgcatgaatgtgcacctgcaacattatgttacccaggagttgtgaatcccagggcagttcacatagcccataaggcgtgttctagaccagagctcagcaaactcctttttctctaagcggccagatagtaaatattttaggccttatagacagtgtgatctgtgtgactactacttgactctcc

SEQ ID NO: 130523 - DNA, 1020 bp, Homo sapiens
taaaatcaaaaacaatccattagctttggggcggggggtggggggagggttaaatgtaggccttggaaacagttttaagtggcttttaagtatctgcatagaggcaatcctaaggtttgctttaagtctcttaaatctaacatttttaaaagcatttcttccctgtattttcatatacaagttggttttaattttgtttgggtggtgttattttttttaaatgactttttagtttagaaagttctgatgagcaaataaatacatctatctacatgttggaagtccatctgccagcacacctgcttaaagtgaaatgaaagcacataaccaggctctgaatgggttatattttatcatggtgctcccagaatcctttgacctcactctgctttctagtctgcttgtgacactggacagtcctttcttacagagctattatatgttctaggctacgaagggttaaataatcccaaaaatgaggtatgtcatacccacacgtctttatctctagaagctgtgatgtatgtgaaacagcactgttattcttaacactagtgtgtaaaataaggattagtacagtacgtctcattactttttaattcagggcaccctgagtgaaaacaaatacaaaaaaaaatccctaactctgagctctatctctgattcctcttcctccttcccctcttcctcctcttcctctcctcctgttttgctacattctcctcagtggcaaaaagtttcactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcagacctcataaacctaaagaagagaaagaaaagaaaacttttgttactttccttttttgcttgtcacttatatacaggctatgtgagaatataatttgtaggtataacacattaagaaaaagttatcttcattggatag

SEQ ID NO: 130524 - DNA, 1638 bp, Homo sapiens
acaacacaaccaacgcgaaaccaattcctcatcctcagatgctcaaagttgttttttttgtttgtttgtttattagatgaattatcctatttcagtacttcagcaagagagaacctaactgtatcttgaggtggtagtaaaacacagagggccagtaacgggtcgtaatgacttattgtggataacaaagatatcttttctttagagaactgaaaagagagcagagaatataacatgaaatgatagatttgacctcctccctgttattttcaagtagctgggattttaaactagatgacctcattaaccgatgctttaccaaacagcaaaccaagagattgctaattgctgttgaaagcaaaaatgctaatattaaaagtcacaatgttctttatatacaataatggaaaaaaaaaaaagaggaaaaccctcaagggcatgagcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagaatgaaaaatgaaagatgatttgcaatgggatgtatgaatacagcagcaagaaaaaaaaatgccataatacaaaaggctccatatatatatatatatatatatatatacacacacacacacgcacatatacacacacacacacacacacacacacacacacacacacacacacacacacacacaagtaagagactcagcctgcagttaattagcattctggcagttttgacatcagccagctgccctaaataacccttcaacgtttcttcacttttgcaaggttccacagagtaagacattgggtctattccagctcattcattttatattgaaaaaaataattttaaaaatggtggcttcagctccagcccctttccaaaatttttcaaccccaccctgtttggatttttaattaaaaactagtagttctcttggtgttaaaacacttctgtcctgtgaggtttcccaatggtgtttttcttgtaaatgtgttggacaaatgtgaagatgcattgtagtttaaccatatgcccacatttagtctctttattcctagttggtgagaaacctgtatctttctatgctgcttttatatctgtatgtattagtgatatttctctagtagttaaaaaaaaaaaaaggaaaaaaagactctttttggttgtcctcaagaaaagaaaagaagaaaagctatctttcggagctgctatttcactctcttataggatttttttttttcctgaaaaccagcatgcttcacggaatgctaacatattggtgtttttgtaagagggatgtacataaatgtattttgcactgtcacaatgactccctaggcatgctttttgtttttttttttttttttttgagcaaattctttttaaatatgctagagccatttcatcaagtttagctgtagcatagagtagtcgtggaatttttcttttttttttttttaaatcattattagggacttttttaaaaaaataaaataacaagatatcctactttaaaaaaaaa

SEQ ID NO: 130525 - DNA, 1908 bp, Homo sapiens
aaaataaaagcttggtgatcctttgaaggcattgtttttcctgctatccttgaaaaaaaaatgagcgagaatatctgaagtagaatataggatttgatttctaaattgatatgaaagtcacttgagagaaatgtttagatcttggaaaggaattctcaaagccagatcggtgggctactgttctattgtgaaaaggtcatttaatttataaagtaatgggattagtatttggagaggtggatttactggctataatgccttcaggtgaaatttcccttctgactcgtgttcataacacttatcttctcattcccattgaattttccatctattggctctgaatttcaaatctagtcatagaaaatactagactgaaaccttcagggataaaattgcttccttcattgtcctgaaatggtttgtttcactactcagcaaaatctttaattgtgatgatttatatgctcttccctattctcccctttcccaaatagctgttaaactgcataatggacatggtagaaaaaacaaggcgatctctcaccgtactaaggcggtgtcaagaagcagaccgggaagaattgaattactggatccggcggtacagtgacgccgaggacttaaaaaaaggtggcggcagtagcagcagccactctaggcagcagagtcccgtcaacccagacccagttgcactaggtaacttttcttcagatgagtatctcgaaaacacatatttcttatgctgttaatgctgacttcatttttatttttaaaattaaaggatatgcaaggaattttaagacaataaacaatttacatatcctccaatatgtcttgtctatctgttaggaatttgggcagattggcatagacagagatagccacaaaacttaaattccttttccaggtgagtgtattgagctgatggcagcgtttcagcactgaaccagattttcatgtgcataactaaaacttgtgctccttcgtaatgcctcaaaacagcaaaaacaatctcagggagtgggcctggggcttaggcacttccgtcaaggtctctagtgaattctgccactgcataccaatgttatcactgcacatggggatgtatgtttcaaattattaattcagaaaacagcctgtaagacaatcttgttagttgaatcatatatatatatatttatattttaaacttttttctcaaccccccgcctccaggaagagagacctagaagctatatattttgcctacagctattttaaaattaatgataaagatgtagcacccttcctgtgatttgatcttaacttagattacttaatcatgattatattaattctagttttatctagttttataataggactcataatatagttgtgccttagaaatggaatgttagtatgtaactatttcttattgatatttgggaattgttggggttacagatagaatataatcccatatatgttgaaagaaatcttcaacctgaaagaatttttgtgtggcctgtgaacttttacctaaattaataatacggttttgtcattgacattgccacccattacgtgtgaatactttttgagtaaacttacgaaggtggatttctgtggattcttgttctctcatattatcttatgcgttggccccatacccatctgctaactcaagttactgtccatgctgcaaaacgtgcagattaagttcataattttggcctcattagtaccatggctgattatccaaagtttaaaacttgaagtatattatctgttgatcacattactgttttcaatttgttcccagccagtgtagtttcctatgcacttaggtttgtagatttctgctgatctctgaatgccgaatgcctattatcataagtattaaataatgaaagagtctaaggcagt

SEQ ID NO: 130526 - DNA, 1049 bp, Homo sapiens
actttctgtgatgatggaaatgttatgtatctgtgcagtccactactgaagccactggccaagcgtacctgttgagcacatgaaatgtggctagtgatactgaagaactgaattttaagctttatttaattttaagtaacttacattttaagttaaacaaccacatgtagctactgtattggacaacacagttcttagatattctctgacacagaagtcagataccaagtggaataggtgtaccttaagtgttcatcaagagagtagtgatgttttaccttgatgaatcttcatcaaatacagtcggtcttagggtaacttgttagaaatcaagcactgttttttgaatgaaaatgttatctacaggagtcttgagtttcctcttgtttgtgacttaaccacatgagcttcaactgaaaagatatttgctaatttgatgagaagtgaaggattttttcctgtctgcaggcttgtgatcatttaggtctcgacacaggtctcagtgaattcccgtatgttttctgggaagctgagtttagaaggtttctggccaataaaaaatattctgtttttattccaagctcaaatatgagtgactgaactgtgctggtttctgaatagatgatgaaacaaactcttgttttttccccctttagaaccaaagaaaatggctttgacagagagcctttgcactcagaacatccaagcaagcgaccatgcactattagcccaggccagcggtacagtccaaataacggcttatcctaccagcccaatggcctgcctcaccctaccccacctccacctcagcattaccgtttggatgatatggccattgcccaccactacagggactcctatcgacaccccagccacagggacctcagggacagaaacagacctatgggtaagactgaaggacctgttcacttcttacgggattgggtgcttgaagacttgcaccattatttctgaacttaacttgaggcttgaaatctgtgatagggatgaagattctcatatcttgctttatattgtctcctttatga

SEQ ID NO: 130527 - DNA, 1038 bp, Homo sapiens
acattctggagtaatctctcattctgctctcacataccacatttgttctgtttttaatggtaccttctgtatacatgtcctgtatgaaagtatagaagtcttgtagctccaattaaatcattttaatggtaaagaattaaagtctgccctaaataataatcttatggaaggttgagggaccatgtttctctcatctttgtactgccactgaagtgcaggatagtgcattacacatactggggacctaaaacaaagcaaaacactacaaacagaacaaaaaccactattgaacaaataattcaaattaaacttaatgcagtcatttttagtagtgtattaaatggtctctcttccaggcatctttatttttttgtttagttaaaaaatgcatctctgaaatacaataaaaacagccacagacagcccaggaaccaaatgctgtgattggttcactgaccagaaaaaactggagggctccaatagaaacatacaggtgacagattcgaataagaaagcagagttccaaacagcaggagcagcaaaaattgaatgcttcagcagtggcagagattagaaaaggcaagggaaacagccagtaacagcctaactgttgagcagatggtcagcttcagacacgtgacggaagcattccaccttctcgctgctggagggaaggctcagatggctcccccaacctgcatattgcaatccttgaaggtctgggcatcacgtttgtgtgtctggagtggcacgtatccatctgcctcttacttacttctaaaggtattagcacactgctcagaaagttctcactgctaggtggttgtttagcaatggagagattaaaggtgcttctctccacctggcccaataatgatggtcctgtggcattcagctctctgttcttcatcatctaaatgtccccctccctctagagtgatagcaaaacagagaaaccactgcaggttgtcatgaagaattaggtttgattttctttttaaggacgctggggaatttgtaatgtattttgtttcaata

SEQ ID NO: 130528 - DNA, 2020 bp, Homo sapiens
cgtcagttgttattttattctttctattactgaagaaacttcggaaccccttctaaagagaataaggagtccaattgttttgctctacctgtaccttcaaatctatatttttaaataggaaatttcttatatatccactgtttactcatactaagtacttggcaatgtgatacgttctgggactgagttgatatgataagaattgatatgtccccatttccttatgggacactactctctggcaggaggtgttagacaaataattatacaattatatacaacagttgtggtaagctctacaaaaacagattaggtagtacgatattgcttataatacagtgggtaggataggggagaggtcaaggacgccttccttgagtaagtgaatttgagctgagatggattttctagggagagggaaaggccctgaggtgagatgaagtttgcagctgattaaaccaatgaggcatgagatgagataagagaggcccatattaaatctatctaggttgttggtcatttgaaggtttggattttatactaagagttatggtaaaccattgaaacactttaaataggggaatgacttgatcggatcattagaatgtaaagttcttgagtgtagtgatttttaagaatttttgttcactgacctgtccatagtgtttaacagtacctagcacattttatatagctcagtaaatatttttgaatgaatgctttttttaaaaaaaatgagtgaaacatttggttttacaagaagttttcatctgttgtttcatgtaaacagattgcagtgtggtgtgagaggttgtaaagtccaagtggaagatagtggtggcttgtatgctagtggtggcagtggaaatggagaggcacatggaggaggcagaataatttgatagtggcaagtgtgggagacgaagctacttgggatattttatacacgaacagcacagtaccattgatgaagttgaacttatcctgtcctttttccaaatacttcttccagctgggttttggcattggtttttaacatcaccatgcacctctcggttcctacttattcgagggcatcttactgagctgtgttaacttgagcaatacttctgaaatatctcctgaattttccccttttctccagtcttacagccatttccatactgaatgcctgtgttctatcttgcctagactattgctatccagtactcctgccctgttgccacttttatcctattcatactgtgctctcagatacactatagaaatgaacatctcatttggctgcctaaaatctcagtgccttttcattgcctataatgtaaagactaaactaacagtactttttttccccctagagtacattcaattaaaatcaagaaatgttcatttaaactcctgctgtttgcttgtctacgatttagccacaggtacataccctgggcaccttcctgattgtctctcttgatttgctaattactatctggatgatcataactgactctactgagtgtctgtgctaccgtttttctgcagcagctctctgaaccttctctataaccttctttatccttgtcaaataagacaaatgttattagagtaataattgtcagttctttagatgataaaaggtttggatcactaatgacttgtttttgttttttgtttgtttttttttactttccagaatgaactacagtttgacaacaaaatgttaacatacatgcttatgttcagttttggggcccttgtgataacatgcatctttctcttctctttggacaaggaggagtgacttctgttatttgggcaacttagttttccttcctaagtattgttaaccttaagtagacatttgctatttgcctgtgccaggggctttaaacttttctttgttaaacaaggacccttatttttaaatgagatcttaaatagaacaccagggtgtaagtcagattaacctggaactagcctatttgaagtgtattgacttcacctatttgaagctatttgaagtgaa

SEQ ID NO: 130529 - DNA, 1037 bp, Homo sapiens
ttgatccctcaaaacagaagttcccaacagtttttcttgctgtcactcaaggaatgttgacattgacgatcacagtggtcttctgtgatagtgttgatcacattccaaaaattctatccctttgccttttagggaagtactagtgatattatcataggaatggttttggatatatcctaacttgagttattgttagtaacaagttaataacacaatgaacttagaaaattgagaacactttcctgtatatttagacatttattgctttcataattaatttatctgacaaataatatcaagaaggttgtgtttctgaaaacaaccttatagatctttagcaagcaacatttttcatttatatgtggaatgctctttgcagttgtccatcaatgtttggtttgattctcgccattataattcttcataagctcagagaagacatctctagtgctatatgaaatataaatgattcctagtaagtggatgggaatttagactgtcatcttaatttaataacatatatacccatatttacagtataaatagaaatgaggctacattaagaacttactaacattaaatttatgtatgtgttcacttgagacacttccctggaacttaaggtggtgtctgaattgtaaaaatgtgtcattcaaattgtaactagccagaattttatggttctaggttccccaatggttttcctggtattaaaaggtatgcttgcttttacattgtctggaaatatggaaggtgaaagtagacttacttagatgcttttgaatatatatatatatatatgcagatatttcctgctaaggcaatcttgattttctgtccttagggaatatttattagcaattaattatttagggtaacttctctgaattactttattaagtaaggtcatgggtttccatgaaaagttgtattatgcaaagtattcactgatgtagaaactctattaagaaatgataaatatgaaattgaaacaaccgtataaaatatatggagttgatctccctttatattgacca

SEQ ID NO: 130530 - DNA, 1055 bp, Homo sapiens
gctcactgcaacctccatctcccgggttcaagcagttcccctgcttcagcctccctagtagctggggctaaaggtaagcgccaccacgcccggctaatttttgttgttgttgttgtattttagtagagagggggtttcaccatgttggccaggatggtctcagtctcctgatctcgtgatccgcccgcctcccaaagtgctgggattataggcatgagccgccgcgcctggccctgtgctgaatgtattttatctttagctttgtgacttgggtttatattatgagcaattaatatattatattttatgaggccatctatcaaaaacacagagcatcgagaatgtcaatgcctgattgtgaatcagtgctcttccatttacagtctgccagagtttcactctctttgtcttaaaagtagaaacagttattctgccttgctaactttcacaggatggcaatagtgattgtagatatgctgtgtacctgtataaagaggttattaaacctctttatagacagcgatgctgtctggagttaaaaaataggagacagtgtttaaccccccacaaaacagtgccaagtgttatgcttgatgcacattgtctaggttagatgaaattttctgagttttgcctatgcttgataggattttctgcctcatctttatgtcagcggtttaccccttctctatcagtgtgccacccttttacacatcccagttatttgcaaatgtggaaaccagataaccaaacttagaatggtgatcacataataaaacacatgcttaagtgagagcctgaaaagcctgtcttttttttttttttttccaggtactaataagtggcacttttaatttgtggcatcaatttacatcactgagtctgtcccccacttcttccccaccccacccctactgattttcatgtttctttgtaggtggttttgctggagagctgaattctgtataaccttttactccacttctgtgttatcccaagatacagcttcttttcttcactgtttaaaatagacattttaaacatcatcaactccc

SEQ ID NO: 130531 - DNA, 1037 bp, Homo sapiens
gagtgtcagctctccatctgtctctgcctggcaggcgcacgcgcccagcaccctgcctccggcgatgccgccccagcccctctgatggccctcctctctgctgccactcattccagaacaggaggcatgagcccggaacgcgcttgcttttaggagacagccactttctgtgtggtacgctggattcaaggatgcctggtgagttagccctgttctgtgttctctctgtttttccaatgaagaaagcttactttctattatgcatggaaaataccttctgccccacagcgtgttgtatctgatgtgggcaggaagaggctgggggtgacagaggtgtgattggaaggtagcataaagagaaccacaaagatcttgatacatggaggggtacagggtgtggagcccttgcttttaaaatttgggagatgtattttaaaggttgagggggtcgtacagccacggatgtttgtcggagtaatttacttgagggttttagctcaagtaagaagtattgtttctgttcagaattttgtgactatcatctgtacttggtgtcctggaaatttcatctgtggagagagttttcagattatggcagaatcctggaataagatctctttaaaaagctgtttatgtcagagaaagtgaaggaagctttggaactacaaggaatttcagtcttgtcctaaatcacagcccttagatgtcatcagacaaataattgaaatcagttaattaaaataaaaagcctgctgaattagtgaagctcttgtcctggaaatttagtgcatgtcagtttcctctgaaaaatattatttttggagcctggagtgtttctgtgatcgttgccagtgaaggctctgcttgtggagaaggctggccggggaaagggttgtttcggctgttctcaagaactgtctaaattgccctgtgcctaatttggagcttcctatcttcagataaaaaagacagggcagatagagatcctccagctggccgatttatgtggattatttgggtaggacaggcagaagagg

SEQ ID NO: 130532 - DNA, 1064 bp, Homo sapiens
tttattaagtaaaattgctgcttttagagagtatctgctcttatttttagtttttcttggtcatgtttgaggggtctgatagcattaatgggctttaccccacatggagctttgagcttattgtagcactgcacactgatcccaggtcagtgtgatgcgtgaaatcaatttatttgaatctctttgcctctataggaatttggcagcatgccagttgttttcatttaatgttctttgtgttgaacacagacaagcaggcatgcttttgtattcttctctcttttggtctctgtctctttcagccaatattttactgtatggattttgagatgaaagaagagtatatcatttatatgattctaatcattgtttaattatatatatgtatataaatataccactttcttatcttttaaaggatatgtttgatattcctgagtttggtgactttgcacacacaaaatattttagagttttgtttaaataaaatttttggtgaaacataataaaccagatcatagatggtatttgcttacattaattaccactatcaaaatttaaaataacaatgttaattatgtaacacaacaaatgtttaatttgtaaactggactatcaaaatcatttatttcttggtgagccttctttgaatttgaagatttacactttaatcaagcatgttaaaaattataattatttgagtacaattttctttgatccatcttgattaagataccagcgttttacacagatttgctgtatatgaatttttatgaagtttctgccattaaggtacttttttgttttttaaaatttggagggtaatgactgggaatagcatagagatttttatgacaaataaaatcagacctttctctggatgtttttataggcaggacttgtttctgggtcagctttaggaagaggtggagaaggaaatgagagagagtgagaggagaatgttctgttgatgctccgggcagttcttgcggaagttgatatgcagaaccatggagccgcagcttcggggtcaggctcatacccagcagccctgcttccttgtt

SEQ ID NO: 130533 - DNA, 1053 bp, Homo sapiens
gggcttctgtgaacagtacctggcaggtaaaaggttgcagagcctgatgtagacccaaagtactatagtataaagaagagaaaaagatcacaggtcacagaagtagccacggaaaggtttgccaaagtcatggggattgaattgggcttttgtggcatttcattgagtgggattcatttgtttttcttttcatttggggctacaactaggttcctagtccagttccaaatgtggagggtagagtaatgagcaccccccagatgagaccctagctctcacagagcttgcagtttgggtgggggagggagaaagataaaaaagaagttactaagattatttcatgtagtgctaaatataattaagacaattaagaaacaatgttagaatgatgcagagggtggggggacatggtagtgagactttatttcaaatggttggggaaatcatctgtcaggtggtgactcttgaactaaagcctgagggttgaggaagaactggccgtgcagcagtctatgggaagggccgtgaagtcagtgaacgaagccaccagcatgagaggaagtgttccatcagggagtttatccagccagagaagagctgcactctggaagggcgtggttggagtggaggctgaaaactgtagatgagtgccaagtgatggagggtcttgtatgtgagattaggcaagaataaggactgtgtgtttctgtgtgtgaatgtaggagatgagtagttagaagagagaaggagaatctggatgagtgtatgcatggaagcttaaggaagcttgtgaaactaggataatgacatttagttcacatgacctgcgatgaggggcacccaaatcacacagtgtctcagttacttcctgttggaagttgagtatagtcctgaagtgaggcatagatggtgctctgttcactactccttcaaattagagggacacacaattgcttacaaagaaatggtgaagctttgacaaaggtaagctacagtccagtgccagaaactgtacttaccaaggtaatatttcctaagtcagatatgctataa

SEQ ID NO: 130534 - DNA, 1059 bp, Homo sapiens
ttttgctgtatgtcctttggtactctgagtcattttacaaatcttttgcctgtgtcgcccaggttgactggtctgggcctctgcccttccagagggaagtgatgctgctcttccctgccagaaggcagtcgagtatagtgatgaagagacctaactcccaagtgctttaccatttatctcctttagctacccttttcatctagaaataattttcatctggataataatggcatggcctcatagggtggtcatgaggatgacgtgatatgtgtgaagcacaaccttcagtaaagggttgctttttcttggcatctgacttgatggctatggaactgttcatcacttccttctctaaaccccagtagtctctctttggctgcttcttcattcagcaaatgcttaatagacgatctggccctgatggacactgggggatatgaggatgttgaagacaaatgacaccctgctttgccaggcctttcctggacctctctctctcagccttctctaaaaccctgggttgcttcacgtttggacacctaagctctttctgcagggaagccaagcttggctcactttgtcctctcctaagcctctggtgacactttcatgacccttcctccccaaagatagaatttattacatccaactctgctatcatccgtgcaattcagacttctctgctggtttgtaagaccttcaaaagtgggagtctggaacagttggggtactttctaatgctttgttaaataattattgagagctcatgccttgaactcaagtgatttacttgaaactgtcctgaaatatttcactgctgagactaaagtgaaatctttggttccaacagcatgttgttttttttctcaacctctttccaccttggtcgctttcattgcgttctcttgtcaaagaatgcacaatttattgctgttatattttggcttataagttttggcaactaaaaaacatacaataaaacaaaagcaaaatccacccccacccccacctcctactccaaacaaaacaccccatcttttatttttatttttattttta

SEQ ID NO: 130535 - DNA, 1430 bp, Homo sapiens
aagctccaatgtgtgtttaatgaatacaaagccgcggtctgggtgccgcctcggccgcggccgctctcccgcgctcctttgccagaaggtaatctccgtgaacaggggagggaggcgagcagggaggaaggaggggtggccaggaggaaggggggcgtggggaggcggcttttctctctccctctctccctttccaaatgattcagaagtcgataagaccaggagaagtgaagatgtaacatgttatctgtcgctcctcttagctggcggagagaatttacatttaaagattagcagagtgagaaagagaaatctgccttttgttgtgtggggtgaggaggaggcatctacccctggccttgacgctatctcccatcacctctgctatccagacaggactcaccgaggtgagaataccggagggccttatctttaattgggtttagttttgccagtctgaataggtttaaagagactcgataaagggggaacaatagattatttattgactggacgctgaagcctttagatgaagaagggagagacaaagctgcttaacaacttgattagttcatttttattttaaggtgagactgtctctcttttggtggaaggaagggctagagaactttggtgcaatttgaatgacttaaaatgtcttatttcctctcccgacaaccccctacccttctcagcaccatgcacctccctgatttaacaggagtttcgtttaccccttgcatttaggattgatgaactgagaaaagagggtaaaggctttgggattgatcattaatgtttggttttgtgtgacttgttttaaatgcgtgataaattgatgctgacggtacttgaatgagtaagaaaagcaaatgaagcctacttttaatatggaattagttgactttatagtatggctcaactcagcctagaggagaaaaaaaaatcactacaagtctgttaggtagatttgtattttggatttgaaccatgaaatcttttggttggagctagtttaaaaaaaggagaaaacatgtcttattgactcacaagtatttgaaacattgtaatatcaactttagaaggttcttaaaatgaagaaaagtggaaaagatggttgttttgccttctacacattgtcaaaataggtgttttcatagatagatagatatgatccagtaactaaaagcctaattaaaatttgtttaaagccaggggggcatgtttccttgttgacagcagcagatcgattgggtaagacaatagagtcccattattttacttccattgactgaacatattgacatttcaggtttgctgttgcctcagtgagcatgatgaaacactgaaattcacagaccaactggccagagtggcacatatattactgtatgtcatttctgccttcaggttaccttatcacccagaca

SEQ ID NO: 130536 - DNA, 1140 bp, Homo sapiens
ggggttggaacattggtgtgtgtgtgtttgggtggggtgggggagagggggcggtgctcaactatacataaaaccgatttttggccaagtgatttggaggggagtgcctgattaaacaatgcttctcctcattttctaaagggcctcttaaaatatggttcccttaaaaggcaggggctagttctcttgctattgtttttttttctactcactagccttacccttcatccccattttattcctttctagggagaccccctgcataaaactattttataacctgaagtttcacagcagctagggctacagtgcacaccatgaacaattgtgtaatttattggctccttcattctgaactcactcttgatgctgtagtgagagcttcttaaccaagcttcagtgccttgaaacacagcacaaccaaatacttcccctcccccaataaaataacctcctttgctgcattatctgcactccattaaggagctgatcagatgttcacattgtctgatgggtgtatttaaaagtgaaaagggactcccaagggactactcaggtgtgtctccttcctgaccctgctggggagggggatgaactctggactgacggacaagcattagcccttgcttgttctctgattgattctctggctctgggtgggtgaagagccatgaggcagctcaagccgagattgattgcctcaatttcagattcccacctccaaaatagactctcagatgcacacataaggagcctcctcccccaacacaatttctggaggtggagcaggtctctaagagtcacctgtggctaccaatcacaagtgttcctccttatcacaatgatgctggctgcaggagtcttcagctgggacacattaaagttcagggacagaagctattttatatctctgagtgtgtgaatgtgcaggggctggaatttaggagtattggggttagcaaagaaagggacaagaactccgacttgaggttggtctggaaggcagcttaactgctctatagactcagtaggtttgttttgcaaaatgtggctgtttggatggaggtgagatggcgactgtctccttaggctctgccaaaagagagctcttgatcctcctctgaccttgacagaatctcg

SEQ ID NO: 130537 - DNA, 1052 bp, Homo sapiens
acatagccccaacctgagtgtttatgtcagctgtgatgtgtatacacagaagcaaatttataattctgtggatttccctctcttttatccttaaagtctagtttgtaatattatgattttcagataataaagatagggttatttgatttcattttcgtttttttcctttactgatttttttgtttgtttcagagaagtctgacaatctcacccaatagtaatcagggaatcttggtttgatccgggctttttttgcagccaggatggatgctgaagaagttgaagtccattatttcttgtgctgtgttcagcattttatattttgttggtttattattttaaaagatgaaattccaacaaaacaaccaatcagtcttatactgggtgcataaaaacggacttttttaatactgaggttaactttttattaaatatttttgttcagtcattaataattttattataaactagatagcagtgactttatttgaaaagctaaatattgcatgggagaatttcaatactcagtttctccagtgtccagtttatacctaataaaagcagtggagaaaacagtctattttttcttttatgtttgtacaactcaaagcagactagaagtctttgaaatgatattttcctttgtggacttagtctctgtggtccgttaatacctgctaataatttgtgttaaaatgatctttaaaaggtcctttctaataaaaatcattctatgtgcaatacaatacattgcactattaaattgcaaggacagtatttttgcagctatgggactgcagctttttaatatttgcacaattttcttttcctgagaggagtaaaatattgctcttgatgttagtatttgatgatgtgctctcccattgaggtgttagtctaaatatttgtagataaaagagcacttcataaattgcaaagaactacacacatttaaggtgccattataatttattttattgtcaaatcgaaccgtagccaaaaaatcttgcatttctttaaacactgaaaaaggatcacaagaaagaaatgct

SEQ ID NO: 130538 - DNA, 1042 bp, Homo sapiens
ctgaaaaatttcagatgaacaaaactcagtctattttgaagatatttgctatgttctagctggaactcagtgggttaactcaaagccatctggaacattcagctgttcagaataactcattttcagggagctctgtatagttgaggacttactatacgtgttttcacataatgtgaatagaaatgtgactatttgtaacatttaaacacccacaatttccacaaatgaaagaaagttcagcatgatatttatcatgactcagttttttctccctcctcagaatggcacttgcatcttttggggagcttttgaataggcgctgctgcaaaatgcagtaggtgacagttaaacatactcttcagcatttgcacaagatgaatcatgttctttcgcagtcatttggcttttcaagatctctgttaaagaggagatgcaaaaactctctcttgcgactctttcatcagtcatcaaacttgtggcttttagagcacattggttttgagaagcttttcatgaagcaccttgaaacagcttgccatggaaatagaaaaaaaaggaaggcagatgcctgaaaaagaaattttttcttttagttaacatatcacaggatgggccctatgcccaaacttgagaattcagaattctcattgacatgaaaaggagttttctatcattttttgtaaagctgctggattagtccttaattttgaataaaattttcgctcttcttgctctctttcttttcttccccacttttgttttataggcattttccttaaaaaaaaaatctggatatctctcttcatgttgaataattatgtctctgtagatggttccagaaaagttagatttaatgggttcctaagaaaacacacgtaatagtaaccttcttatcagacatgaagtggtagaagacagagttagggctgtctttcatcaaggtaatatttatagctaagcaaatcaacatttcaactctgcaaattctaaatttgttgccagacagtatctggagattgttttgtgtgttttgattaaatac

SEQ ID NO: 130539 - DNA, 1018 bp, Homo sapiens
acagccaccctatacatggtacatttagatgaaatgggaaccagatcctaaatttttcaaatgtcattgccaatttatgtgtataattccatcacttcctgatgagtaagtctatttttgttctatatacatcataagttagtatatattcttatttacagaaacatgctcaaatcacattcagaaagaacaaaaagtcatgggaaattttttattttacaacaaagccctgctttctttctggacgtattttacatcattagagagactatctgcacatacatctaccataatctttttccttctttgccaactgttcagtgcacatgtgctgcatcagaaatggcacctggatgacagaagctcaaagagtcacatatgtctctaaaatagagttcttttcctcttgggctgtctgaactggtgtaaatagaagctcagttgatcttggttttaattaacttattactctattaatataaccttggaattctattctaattatgttgttctggctgcttgtagtatcagttcgcccctcttgttagggagatatgtaacaatctgtcatttaattgagcagtctttttcacataacagtaatagcaaaaatcctacctactcagaatcatcttcttaggttgtctcctaaatctgaacaatacagttgttttataaaattacattttgtctcttgagatttaatcaattagaactctttagggagaaaataaataatagaagaaaatatatgcctcatatttcatatgtaattatctgttgatataatttttcaatgtattttgtatttgtgggagcataatgacctgtacattcaatatttttactggtaattcaatttttaaatatgtttttacaatgcttgaacacataaaccttagaaaactggaaaatacgtgtccacagaaagagttattagctactaccttatgtaaagatgcatagaaaatgaaattgttggaaacatgtgcacaaagtgttttatattatatacatt

SEQ ID NO: 130540 - DNA, 1386 bp, Homo sapiens
tttttttttttttttttcctgaggcggagtttcactcttattgcccgggctagaatgcaatggcgcaatctcggctcactgcaacctccgcctcctgcgttcaagtgattctcctgcctcagcctcccgagtagctgggattacaggagtccaccaccatgcctagctaattttttgtatttttagtagagacagggtttcaccatattggccaggttggtctcgaactcccgacctcaggtgatccactcacctcagcctcccaaactgctgggattacaggcgtgagccaccgcgcccggccacgaaagaaggctttaagataaagtccaaacttgagtgtatatatatatatataaacactgttgagagaggcataggaaggatttttgcagaggatagaatctgtattaaaagaaaagtccagtctcttaataactagatttttgtactgttagagataacatggaggtctttagaataggctctaaaaaccttttagaaaaagtagaggtgacacacgtagttaaaaaataaatgagccaggcgcagtggctcacgcctgtaatcccagcactttgggaggccaaggcgggcggatcacgaggtcaggagatcgacaccatcctggctaacacggtgaaaccccatctctactaaaaatacaaaaacaaaaaattagccaggcgtggtggcaggcgcctgcggtcccagctactctgaggctgaggcaggagaatggcgtgaacccagcaggcggagctcgcagtgagccgagattgcaccactgcactccagcctgggcgacagagcgagactccatctcagaaaaaaaaaaaaaagtaaaataaaataaaaaataaaaaataaatggtagggagtatgacacataaaggagaaatatggttcaatcagagattattattatggctagtaatgtgaaaaaattagaaaacaacacttaaaaatattaattgctttaggcagtttattcattgaataaaagttgtttgctttcaaaaaaatctcattttctgatctgagctaaatagggcaattttaaagacaggggttcagagtagttcatcgcctttttattacattcatttttaaatgccttatttgaaagggaatgtcctggtttatgagtttcatactttttccctttaagaaagaggcagatggtatgaaaactggactcccttatttaaagggaatgttgatatttataaccaagcttatctccagcaagatttgttttttgcagctgttccaggttggaaaaaaatattatattaaagctctggcttgtttttctttccatatttagggggggagatcttcaaaatgtgaaaaagtgatgtttgattttaaacatgaatgcaa

SEQ ID NO: 130541 - DNA, 1120 bp, Homo sapiens
aagcctctgtccatggggcctctgcgccgaattccgaccctgagtgggaggctgcacggtccccgctgtgacctggggcctaattccttgggctgcagccaccgccggcggcgaagaggagcccggggcccggccggctgccacccacccacgccaccgggtctcgggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggtcaggaccccatggagagcagtccgcgccgggagacgctgggtcgttgatgggtttacgccttcaaagctgcagaatgcccggggaatgtttgcatgttaaattaacgtgaagccttctcatctctaacgagaatgttttgccttttgtgtcaccttttccctaggaacgctcaaacgaaacaactgcaaacagctgtctcaaatgtggagaagcattttggagaactgtgccaaatcttcgctgcctatgtgcggaaaactgccaggctgagagacaaagcagacctcctggtgaatgaaattaacgcgtatgctgctacagagaccccgcatttaaagctgggcctgatgaactttgcagatgagtttgccaaacttcaggattatcgacaagcagaggtatggagtgagatcacagtgtcattgttatgaatgagccatgaagtagtggatgaaggaaccgtggaaactttcacttgtaatctacctaactgcagaggtggatgcaaacttgataaaacgtacattttcataagactgtgtgagtctattaaagagaagcgttctgtgttttattttacccttttcaagctaacctttagggcatcttgaggtcttgaatttccccactttatttgccaacttttggccaaggggtggctgtttactgggggtagtgggaatagtacccagggggaagaaaataagcataacttaatgtcttgtgtggcacataagtacgttttaaagaatgactggagatggaaatgttgggaatggtaatgtggatggataaa

SEQ ID NO: 130542 - DNA, 1022 bp, Homo sapiens
gatatataactttaattttcaaatggataaacagttctcttacatcctttattgaatatcctatacgctggagagctgtcatttcctctttgcgaaaatgttcttaaaaccttttcgttaaagatctcttttgttaatcaaacaagatggatgctttactgttagtcattacatccaatttagctagttgactttgttgttcttgttgagacagaagtctccaaatgttgcccaagctggtctgggacacctggacccaagggaacctcctccctcagcctgccaagtagctgggattataggcacatgccattgtgcctggctagtttacttcttgagcattaaaaatgggtgtattggcttgtcatcgactcttcgttcagttttccctctaggagtttccacactcaagaaaacctgactcctttctggtttgcaactatcataaggacactaacaactaagagtaggtcccagccctggtcagaagccattcctcctctaaggtattcctgggtatctagagatactttaatatgaaatccaaaattgtattttagcataatgccgtttatccatcagttgccagcctggtatacctgagccctctataacttacatgaagtgacagtaagggtcattgtgaatcatcgttacaagtcttttttacctaggccctgtcctctcagactgacgtatatcactgagtagcaatcagagcctcttaatgctcccttaagtgtttttccaatcatctaggaagaatggggctggaggaaagaatcacaggccactgataagtatctatatggctatcctccaaagtatatgaccactcctttctgggttatcttaggagagcagggatgaaggaaaatgtgtatttgactactgcctactaatataatccatgcttgagtattttctgccttgttcttattcagcccagttctctctacattgcttattttgttataattaacaaaatgataagatcatatttattaaaaacttgcctggtt

SEQ ID NO: 130543 - DNA, 1025 bp, Homo sapiens
ctgggcaagtcaatatttgtaaactagaacgctctatgcaaatatatggtgttatcatcagtggcaggagtgtcattactaccaagtaactcctttatgtttagagaatacaagtagcatacagtgtggaacataattcctgtttaaaaaacgttctcctgtttaaacatcagttggaattgctaaaacaccagcttcataactgaactgctctaatacttaataagcatatggtattaaaattatatagtagcatacattttagtcagatcttatgttattataaatgtcaattactaggtataaagagaactaactaaaataaaaaataagagggaagtggatggtgataaaggaaatactttgtattatttgaaggtttggcagcaaaaggtcttcacaactgtttttcagttatcttttgtactttatttaccctatagaaaaacagatacttctgtattttataaaataccaagactatagtgaggaataaagttactatattcataaagaaatttaaatcattgtttaaattcaattctttggttttttttagactatattttctgaatttatcacaatcgaaatgttatttcacggcaaagctttagaggtctacactgctgcctaccagaatatacaaaacattgatgaagatgaagatttagaggtaggactatgtctatctaagctcagttcttctgttaatgtggaaatatttaaaagagaacattagtatgtgattaatatcttttttttttttgagacagagtctcactctgttgcccaagttggagtgcagtagtgtgatctcagctcactgcaacttccgtctcgtgggtttaagcaattcttctgcctcagcctcctaactagcttggattacaggtgcccgccaccatgcccagctaatttttgtatttttagtagagatgcagtttcaccatgttagccaggctggtcttgaactcctgatctcaagtgatacgcccacctcggcctcccaaagtgctgggattaca

SEQ ID NO: 130544 - DNA, 1065 bp, Homo sapiens
catcatcttctgcttgttgatcctttcttagtcgacaagtggatacctgttaaaagttaacacactttttaaaataaaaatactaacttaaaaaaattttacattcttggtatatttttatgctattaaagggcacacaacaaatatttcaaaaaaatgtccatgtcataatttttagtagtgaaaattccctatgaattttaagctcagaagccagttttttcattcatcacatttttttgaataaaaatgtgtaattagccatttgattttagttggatagccatcaatacttcaaaaacattaaaagtatagactctatattatgaatattaaaaataaattttgggtcacagaaacagcatttgagaatcataaaatggatggcaaaaatagaaggatatttcagctaggcagtgggacagaaatactgatgtaaaagtagtgtgatttaaatggaatgagttgagaatctgaattcaccagttttaagttgcctgactgccgccacgtggggcatattgcttaaaacttctcttgagggtgattatatctaacccaggggacatttgggaatgtctagagacactgttgtttgtcagtattggggctgtgtgtttatgtgtgctactggcatgttgtaggtagaggcgggggatgctaatatctgcttgatgtcgtcacaatatacaggacagtattccgtccccttcttcctccctggtgggcccaattatttgtcccaaagtcagcagtgctgaggttgagaaaccctgggataatgcattctgaagtgctatacaagtgttagctaaggtgacattattagttgtagtcaaaactttatatggactataaaagtaaatttatggaatttatgttcaaggcacttaatgccggaataaaaaaaatacaattgggttgggggagagatacatacatataaaacaaaataaatgcttacaggagaatcaaatgaaaatagaaagtatggtatcaaatttacctaaaagttgtatcttgaaaataagtttgttgaattttatattctgaaggctagatatg

SEQ ID NO: 130545 - DNA, 1063 bp, Homo sapiens
actcattccatttaaatcacactacttttacatcagtatttctgtcccactgcctagctgaaatatccttctatttttgccatccattttatgattctcaaatgctgtttctgtgacccaaaatttatttttaatattcataatatagagtctatacttttaatgtttttgaagtattgatggctatccaactaaaatcaaatggctaattacacatttttattcaaaaaaatgtgatgaatgaaaaaactggcttctgagcttaaaattcatagggaattttcactactaaaaattatgacatggacatttttttgaaatatttgttgtgtgccctttaatagcataaaaatataccaagaatgtaaaatttttttaagttagtatttttattttaaaaagtgtgttaacttttaacaggtatccacttgtcgactaagaaaggatcaacaagcagaagatgatgaggatgacgagttagatgttacagaagaagaaaattttcttaagtaaactacacatttccattttcatcataaatgacttgaaatccacaatgactaaattgtagaactttatactcactttgctatgttaagcctcaaagtgaagtccaactggaaacagaaaaataattaaaggaaacttatgctgaccaaaaatgaaggctttaaaaaatattgcataccagtcatttcaacatcctacctagtgttacatgatttttgtgtaagtgcctttttttttaaagatggtgtatttcaaagtatttcatattaatgtactatatctacttgaagttccaatagtacattatgacagaaaccaaaagatctaacaattctgcttagctttttggttaagactccatgctttcattaccagaaaagggtcttacgtagtcattatgattcatggaattctattccatgaagccttaagaaaaaaaactttttttaactttccctgaaactttatcatttgataagtaaatttacttttcaagaagagtataaccaaagagtaaagataatgtgacactaagttatcaatgttttatgaa

SEQ ID NO: 130546 - DNA, 1401 bp, Homo sapiens
gttctgctggccaggctggagtgcagtggtctgataatggttcactgcagcttctaactcctgggctcaagctgtcttcctgcctcagcctcctgagagctgggactacaggtgtgtgccaccttgtctggctaaattttttattatttgtagagacagagtctcactgtgttgcccaggctgttctcaaatttctggcctcaagcaatcctcactccttggtctcccagaatgtgttgggattacaggtgtgagccactgtgcccagccttgtattttgatttttaaattaatttatatgaatatttccttttaccctataatgtatcagggcttaatatttttaaacttcattataaaaagttgattacagaaagtggtatcttctagttgggagccatctttgcacatctctctccaactctgcctttagtgatatgtcaataacaaattggccatggcaggagtattttacaccatggaaagtgataaatgcagcaaatcaaggaattcccctcctgttgtcccctcagaaagccagcttcccagcacctcatcaatttcaaatataaaaaaagaatagtaaattttcatgtacacatcactcagcttcagtaattgtcgtctcatagccagtttttcctctcctatcctcaaggtataccaggtacactggaggtgtattctctagcctgatacccagtggcatttgtcttaaagccaaacatttttgtctagaaattatctaaaaaaatgtagatcatgtctagaaagtcaatcccacaaccaagagataggtaaaaatcatgttaggagtgcatttctattaatttactgagatcactgttaagagcagtgattcttgatccatatatcacctgttaagtagtgaccttgctgcctctgtttttgcagtaaatattagctgttgtttattgagctgtattagatactatatgatgtataattatgtatgaattaactatcatttaattctgataatcctagtaaatgtactacaggttgagtattcctaatctggtaatctgaaatttcacatgctccgaaaatcacaaactttttgagtgccaacatgatgctcaaagaaaatgctcattgcagcatttaagatttcagatttttgggttaggaatgttgaactggtataatgcaaatactccaaaatctgaagaaatccaaagtcttaaatacttctggtcccaagcacttcagataaaggatactcaatttgtattcctattttggagataagagatggagacttacaggctgggttggttggattggttgcctgttttttgttgttgttgtagtggaagctaggaatggtttttcacattttttaagtgtacttaagtcttacatggttacatagttacc

SEQ ID NO: 130547 - DNA, 1019 bp, Homo sapiens
gagaacagcacgagagttggatataaatatgtactagatttttggattttcatgtggcaaaatgattgaagttcttttttttttttttttttttttgaactttgggtattgagattttacttgtagaacagttttttgaagtagatgtaaaacttgtgtacagcaaaatgtatagaccctaaggatagaattcagtaaaccttgataaatttatacacccatgtaactactgctgcattcaaaatatgtaacatttccatcactcctttcttcgtgctacttccaatcaagagcagttgttaaattttcggcaagtttcaaatttttaaataatttttatatgtctatttggatattgtatctcctttttgcagaaggatgattaatttccccttggaacaaaagaccattttgtaacacccgtaattgtggttccttattctgcttcacttttgataggtaattctgaaatggatatcctactctggcgttgtttaagataaattacagggttcaaggattaattatatttcattttctttccacagttaagttgcttttacagagttaacaggtctccaagaaattttaaaaaaggtaagatatccagagtttaaggctttgaggctcaacaaaaaacatgtgaagtagaatagtacatctaggtatccatggcttctgttcttttttttttaaaaagacagggcctcactctgtcctccaggctggagtgcaatggcacagttgcagcccattgtatcctgaaaatttcaaattgggctcaggcagtcttcctgcctcagcctcctgagtagctgggactacaggtgcatgccaccatgcccggctaattttttctttttagagacgggctctcgctctgttgccaaggctggtcttgaactcctggcctcaagcgatcctcttgccttggccttgcaaagcctggaattacaggcatgagctatcatgctggccctggcttttgttctctgtgtctggccagtggtaggcaattt

SEQ ID NO: 130548 - DNA, 2545 bp, Homo sapiens
actcggcagcagtggtgtgtgtttattgccaagtgcgaagcagttcccctcggggcgccgggggtggggagggctgggcgaccaagccggaagaacggggaaaggcgggaccggcggccgcgccagtatctagcgtagctcctgccgttagggcaccctcttttcttgctaaaacaccgactcttcctttcccgtcagcttccatgtggtggtgtatgtgcgcttcccagggatcttgagagtgaagatctcgaaggatttcataggtatatttttttctttgctatgtcatcgtagtcagtggtggcagaaaagcgctgcaggcccagctcgttaggcttgagaagggcaagtgttttcagttagatctgggggcagttcaccctctggcgagttagggtggaatgtttgcccttgagacggcgtaacggaaaggcacggaggttgggcggtccaggttaatttgaaggctgattttggctgaaagtctggcgacaacatcggatcccacgtagcaactttggcctggcgcgaaagaaggaagctctgacccctgggagttgtggacaaaggctttgggctgtagaatcgatgccttcggatgattcccgtttgaggatgttgggagaaatcctgtgccatgtggattcgtcttcatttacagttcttcctagggactgtggctctcattggtcattcctttggtttttattttaaacatctacattataaaaggtggatcatcgtaaagaataattatgggttggtgtagattattttctgcaggggaaactcacgtttagagtgtgaatatgctacatcatgaccttgggctttacgaagtagtcgcagagttaaaaaaaattctctccctcaccatatctggaaaatgactttttcttcgctagttaaaaatcaaatggatctgatgagatattacttatttaaattctgtctccctcccgtttccctctctgtatccccttaagtcttgattagaagaggcacgttacgtattgtttagttataatggtgattaagtgggatgaatcgttggataaaaatagcagttatttaaaatgcgctttaaatttcactgacttaagtgatcttttagggacccactcttcttttcatagaaattttaacagattattgtcttcaaatgaacacaaaggcacaaaaatactttttgcattcataactagaaaaacgcaaaattttaattgcagactacttgagggtaattttcgtgttttgcttttgtgtaatttagtgtgttaagagttgaatttctggagaatttgcttaaggaaatatagcatgttggaaccacagaagtgcccattttgagagctggtctcttacagttggtctccaaggtgtgttattgtagaggcataaatggtacattaccctactgtctcaagggtagagaagtttaagcattagttttgtttaactgtggcaaatgagaataaactttctaaatagtctgcttgaattggaattcatgagatttgtgctcatgaaactacttggttaaaagatagtttttaagtgaggtaggataaattactagagtttttttgaatttgagatataattattccttgaaacgtctctaatttctcttgtagatgaatttatgttcccagggtaaatcccgttaaaatttttttaaaagcttaggagagacaagaatatgtatagcttatggtgctttctaaaatatcttaaaaagagtagctaagccaatttgcataggagggagtcttgggactttaatatggataaagtaagtattccagaagccatttgtagtttttgttgaagtgttagtatggatattggtttgttgaagaaaataggctttttttctttttttgttactgtgcaaatactttaatagcaaacctgattaatatttttcagatgtagaatgtgtgaagtaatttgatgtctttgctagtttagcttctggttaatctacgtacccttttttaaaggaaaacagacctcagtgaatgtatcttcagacccccactttggggaacagtggtacttaagtgtaagtactggattctggattaacgcaacatttatttgtacattaaagacatgtaaattactccaggcgcagtggctcatacctgtaaatcctagcactgtgggaggctgaggtgagctgattgcttgagcccatgagttccctaccagcctgggcaacatggtgaaaccctggctctacaaaaaatacaaaaattagccgggtgtggtggtgcacacctgtagtcccagctactggggaggctgaggtgggagcattgcctgagcctgggtaagtcgaggctgtagtgagccaagatcgcaccagtgcactccagcctgggtagcagagcaagagagaccctgtctcccccaccaaagaaagtgagtgtaaattataattatttatttggcaagtcttcatgaaatagtttgggtatccctgaaagtattaaacgcaaacttctttaaaaaattacattgagatttttcagta

SEQ ID NO: 130549 - DNA, 1338 bp, Homo sapiens
caatacttaaactttttttttttttttaatcatgaagggcacggtagaattcaacagtgaataaatgaaacctgaattttatttaaaaacctcacttccataagcataaaggcatgaatcctagaagagccttagatagcatctgctctgttgatgttcctttacaggttagaagagtgagactcaaagatgtgagctgacttttccaagattatttgggagttggtggcagacctatgcccgttagcctggcaaattgccacagtggactagagaagcaagttttgcaagaccatctactggggtacaggagagaaatactggaatttctttttttatttaattatgtagaaatttttctatatatgttacaatgcatattactgtagtcatatatgtatatgatgtacacgtaattcataaatacacatatgtttggctgcctcttaacatttttggtcatagccatgtgtaatcatgccaaaaattgaccacaggtctatgtaaagggtcttcataaatggaagaagtccctgtgtaaaatgggagatttcaaggcattttttaagaatagggagggagaaggatgattggtcaggtagacggctactgcataatgttatataaccttcatctcctcagctttccccagccaaatctgttgtacattctgcacagtttgtactgcacaaaggacgacaaagaaaagagaaaattgaagtttgagtataggagccaggagttcagtcgtggttccacgaatgattgggagttgtgcctgccagaatataccctgtagaaatagtacatgatgtgtgtataaaatgtagtaccttctagcaaaggcttaacatgtagattgacttgcttaatatttgttataaaggcaaagctagattaagtatcctgaaatgtaactctttcctttgtgtacatctgtctaatttgctgtctaggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttga

SEQ ID NO: 130550 - DNA, 1013 bp, Homo sapiens
ttgggaatgtgatgcagctttggaatcactgaatagggaatgggtttgggaactgaccagaaacttgtaaggtgacaagcaaaagtacacgcctaagcattgtacacgactcagctctaaattggcatcctcttcctttccccctgtttccagtccctgccagggaacctgggggatagggaagggagaagatcaagctgttttctattaagcctcatccactcaaagtaaatatggtccaatcggtaaatcagataacatgtagcaagttgtgcaatttggttatatttgtctaggaattgaagttttagtcatgtgtttcaagcttattttagaattaaactctgttccttgtacaatgtggacacttaataaatggtgaatgattagccaaacgcaagcaattgaggcttttatagctgtccaagttctgcagaagtcattgtttagaagaaaatttgtcaggggacattgtctgcaggcactcagaatagtccagcatttggcatagcgacgtaggctttcctacaatacagcttctaacaaaactaggctgtcctgaacccctggtaatagaattgttcacctttataccaagaaggttgggaaagcaccaaaatctgcatgtggtgtgtacccaggccgacttcgaggggttcgtgctgtaagacctaaagttcttatgagattgtccaaaacaaagaaacatgtcagcagggcctatggtggttccatgtgtgctaaacgtgttcgtgacagggtcaagcgtgctttccttatcaaggagcagaaaatcgttgtgaaagtattgaaggcataagcacagagtcggaaagctaaataaatacgaaacttttttgagtaataaaaatgaaaaaaaaggagaaaatttgccaagaagaaagagtcctttaaatggcaacaaattcacctgtaccccacctgtgaagacctctaggatccgaggtccctgttgttgctgtttcttctctcttctgaggtcataccctcct

SEQ ID NO: 130551 - DNA, 1015 bp, Homo sapiens
tgtttggggaggaaaatcaatcaagaatgccttttttcaaatattttatttcttttattataagacatataggtaaaaacttgcatattttgaaaaagatagaaaatggtaataaaatggatatttttcttattaagaaatatgttcataaatatgctttatcaaatgttaaaatggttattttgcaaaataataataaatagagcagagctgtgacatacaagggtcaaccaaagtactggaagtttttatgctatatgttttataaaaattcagacttctgattatacattaaaaattgacattttgcactacagggtatcaataattctgattttaaaaatatttttatgatggctccatgaattcaaaaataataaaacataaaaggtggtttgactaaatagaatctgattcaaataatttccccctaaataagaaattgtaagatataatttttgagcctataagggacacatgtatcagttcccaattctatatgtcttggtgggcattgaacaaaaattgtttgctaagcctttgtttccagcaaggtccacatcatttcttttcacagtttgatggagcaataatagtcacgattctgatgagcctagttctacaattctagctccatggatcttagattcgtagaaagttttccctcctttgaagaaactcattgacagctttcttatatttgtttatgactcattggcctcaaagtcacatatcagaacactgggaaaaatttttaatgatgaaaagttcttgttctaggcattctttgtaagctttacttctctactatccaaaatagaagaaacacatgtgaacaccaaacacatcctctaaagagtcttgggtgttcaaatagcaaggtcaggcttttcctggaaataaatactgactttttacaaaaatctttcatttcccatgcatcatgttgcccacaaggctaatacgctagctccctgctacaatgggggaaaccacatctaacttaagtattcaa

SEQ ID NO: 130552 - DNA, 1063 bp, Homo sapiens
gaatatgtgaccccatcagactgatgcctcaaatgaaatttcagaagccagggatggggagtaggagagtaggacagtgtttctagggctcacaggaaccagagtcagccagagtagaattctttttcctcaatgaaactctttctcacagttcccctaaatcagagttccctatcctccttgcatgaagatgctactttcatttccctgtactcttgggaattccaggaaactccttaaaagcgggaggattagtatcctgcaggtagaccagatggacaagggagaacaactagtgtggaggagacccactgggactgtaggagtctgagaaacacacctaaaatttcatatagcatcttaatgagttcctagatccagcctcgtggaaggagggaagaacccgtgtctgaaggaaaacacatgtgatccagcgattgtttctacagtattggctctgctcctcttacctgatacagacacttctcggcaccgcactaagtcacttttgttgccaaccaaaattatgggaatgtcctctgtctgccgggccctgcggagctggattcgcagctcagatgccttctcgaagctcgctcggtctgtgattgagtagacaatcaggtatgcgtccccgacctgcatgcagtggtcatggagccattcattttccccctaatgaaacaataagatcttctgtgagttcagttaggcctggggaataaagcatcagtttgcaaagaaacaatatgtgtatcctaaagtacacttgctgataggaaaaataggaaaaaggaagaaaatcgcttccaactccctaaaagcattggtcttctatgcctataagatgtctggtggctgtaaagattgctagcctgtccagtatttatgccaaaaagttttcacttttcagtatcttctacagcttgatttgataaattacacaacttctctgccaaacagcatttccaatttctatttaatctaccaaaaatgagccttttctgacttcccaaaaactcccttttgccttttccaagtgatgagattaagaacacttttg

SEQ ID NO: 130553 - DNA, 1052 bp, Homo sapiens
ggtgaagaaatggaggcttacaaagtcaagtgactttcccagggtgaaaaaactagtacatggtatgaccaggattcaaatctagttgtgattgaacccaaatcctgtgtcttttcatagccccctgcagccccaggatttagcttccaaatactaagtatgacagcacattgggcatcagccacacacctggctctggcctaagctctgggatacaaggcgatggatgaggtataccatgccccctagtaatgagctaagtgttagttgctatgttgcagagcagggtcacattaactaatattttaagcagtaacgatacagtgctttgggcgttgacataaggaagagatggactgggagttgttttttgtttttaagagggaagaattgaaaaaagttagtggatagtagactttcaaaaatgtttgtccattagaatggagttgtatgtatccagagggtaatattcccataggcataaaatgttaagaagactgactcatacctggaatttggaaaggtagccttcccagatattttgggaacttctttgttgagagagagagagagagatgcccaatatgacagcacattgggcatcaggcatatggctgatcctggggccgcaggggaccatgaaaagacacaggatttgggttcaatcatgagagaaagggaatcctttccctagcttcttacacagagaatctgtaggacctgctggaatcactagttggttttgtttcccaagaggaaggttttctaaggcacacccctacatttttttttttttaaatcagcattcactgtaagaaaaaaaatcgacataatattctcataatgatttctcctaataaagatggatattgttacagttacactacagtaatcttatgactctctgtatacactgaatgccattcattcattcattcattcctaagaagttactgaatgtatagcacagagcttggtgaggcactctggggacatgcaaagagtcatggggcttcttctgcggagatgctcacagtatgcaatggagcata

SEQ ID NO: 130554 - DNA, 1052 bp, Homo sapiens
ctttcaagtcctggtgtaatggctttggagttagagttttttttttttttttttttttttttttttttttttccaagacagggtctggctctgttgctctgttgcccaggctggagtgcagtggtgcaatcatggctcactgcaacctccgcctcctgggttcaagcagtcttccagcttcagcctcctgagtagctgggactacaggtgtgcaccaccacacctggctaatttttgtattttttgtagagacgagatttcttcatgttgcccacactggtctcgaactcctgggctccagcgatctgcccgcctcagcctctcaaagtgctgggattacaggtgtgagccaccgcatccagccagaaaaatggttttaatccctatttctctttcgcaaaaaaacatacagttgacagaataatcctgttgtttatgttgtacagaatttattcataatggggtcatattttctgaggcacttagaagcataggtcaccatacttctcagtacttgatgtaagtgctagtgctgcttaagtaaagctgaaaatttaccctccagaatagacaccattcaaaaaggaactagatcaggagtaggacttgagcaatcaatgtctagtagctgaaagttacttgatgaattatattaagataggttgaagaagttagactatataagactgagatggaagaatttagattttatataaacataaatatattttatataaatgtttctcttctatggaaatgtttctttatataaatgtttctctttaggtacaatagaagcttattagtttattagttatttgtcatataaattatatatgattatatttattagttatatgtcatatataaatatataactaataactaaatataataaatataatcatgcacaatatataattataacaatatataatatttatggtagttaaaatatgtatatatttttattttttagtgggtagaatttaaacttcatagaaatgttttcagattttcttcatagccattttggtaattaaaaatattaa

SEQ ID NO: 130555 - DNA, 3148 bp, Homo sapiens
ccttccttctcaggtaccttagcaagattctgtggtgcaaatgaactttcatttgtttcttactggaatctccctctttgggcatgtaggcatcaccttatgtatactcctaagcaggtgactgcttcactatggtttttgttttcaaatatcttcagagttagtttctgttcatttttgtattttgctcattctcttgctgtttttagagtgaacctcagagagatgaagaaggcagaaaggtctttgccgcactgtcttaaaactggaagtttagatattgactttaaaatggaatatgcaggaatacctatgttttaattgtacaaggtcattgttgcatgttctctcaatgtcagtgataatattattgtggtattttctttcaactaagaaaatctaatgctgcctttaaatttatctaaagaatctttctttttgattgacagggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggtaggaatatttatgcattaaatagatattattgaatgcctgaggatacaatgcctattgaggatacaaagataatgatgatatataatatccactgcataaagagcccttattttgcgtgaggcactctcctaagtgctttccatctgtttaatcctcctaacaagcctacaaggatggatattagtagtcccattttacagatgaagatatagaagcttgttctagatcccacagcttgtaagatgcagagccaggattcagacctaaacctgtatgtctccaggttctagtttactgcagagttggcctttagggtgttcatgaccatcaggtgaagacaataaagttacagatgctatgattagtgtttatgcaggctatagtaagggtataaaagtaacatatttaggaaaatgtttgagaagcctttggttttctttagagtacagcccatctttttgtatcttgagttttctacctgtaggtttgcacctcagttggtatgtgcattgggggatcccaagacaaccctcaggtttaatgattcactagaaggactcaactgagaaaagcagctatactcacagttatgttacattatagtaaagaatactcaaagcggtaaggaaaaggtactgagtccagggcagagtccaagagagaccaggcacaagcttccagttgttctctgccagtggagttttatggacaacacttaattctgtcggcattggtgagtgacagtgcatatagaatattgtccaccagggaagttcatccacgtcttggtgtccagaattttgtttggggtcagttctgtagtcatggaacacctgcatgactgaccttagttaatcagtctttagcctccagaaatcaaactacatgatccaaggccccaccatataacattgttagcataaactatctggtgtggcccaagtgtctggtaaacagacactcatatcaggcaggacattccaaaggcctagagatgatctcttagaagttggttgaaggccagatttttatttgaaatgtgcagggtttgaacatcaacactttaatgcacagtatcattgataaatctttaaaccacagggatccacctagagccttagctgattacatgtatcctaggtagttctcaggggcaaatctttagctatttggactgagaatgaacctccaagcccatgctacacttggttctttccattcttgctgtccatactcactgtcccattgatgaagatctattctctcactcttgcatgatactcttgtagttattttacagtaccatagtaagtgttcactcatccctttctttctgccaagaaaaagctatgaagtagggcatgcttcacacacctgagatttgttttctgaagctgtatgtaaaatatagaattccgaattttaaaacatatttctgcaaattgcatgtgtggaaggggccattagtttctactgtactctcagaattctcacttattttctataggcaatgtctagagtatggagagatggtcagaaatatcctgtacatatttacagactcctaactacaggtaacaacccttcagtgtgacaaaaatgtatactctttgaataattaaaattattttttgttagcctgtgcttcagtgtcaggaatatattgttattttattaactagtatgttactaaacattatacccaacaaaaataatgaacataaagatctgaaggaaatctaattaatgttttctctttaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggttagttatattttaattctgttactatgtagtaaagttaatttatttcttgttagcagttgaaaatatttaaagaataactttataatatttaccatttgcatatgttagttttatttttttctcagctcatagggcagctgccagatagagatatttgagaaaatattcagtagaatcttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagcc

SEQ ID NO: 130556 - DNA, 1134 bp, Homo sapiens
atcattattttgttatttaggagactgtgacttcacttaattaaatggttatgctaaacatataaatagatcatggttggtttttctgtccctatactcatattttatttcttttaaaatttgttgggaagcaatgagtaaatggtttatcattatgaaatctttaatgttcattttaagtgtatttttgtctataacactttcatttaagtctgctatttttccataggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggtaagtgcatagtatctgaaactgtgtcagggatatgagggttctatagtatatgaatctaagagggcagacagggctaatttctgaggttgcatttgtgggttttcaaaaagctctgctggctatctagtatggttctgctgtagagcttatccagcctttcatttgttcttcagagcatgtccacactcctagagctgaagtagggaagagatgagtttgaggtactgccttctatagtttgtgcccaatcccctttggcaccttatctaatacttggcgatcgtctcccttcctattttatgttaatatagtctgtcagttttgtttgtttggtgctgacaaatacaaaatgtgccattaaaaataatttatttttttctcattttgaaagtgatacatgattgtgcataaaatttagaaaattcagaaaatcacaaagaaaataaaaatcatcttaagctcaacccatggaaaatcacattttggtattaataatattagctaacagttattaagcactaattatatacaggttgagcattcctaatctggaaattagaaattcaaaatgctccaaaattcaaaactttttgagtgccaacatgacatca

SEQ ID NO: 130557 - DNA, 2799 bp, Homo sapiens
ctggatcaaattaagaatataaaatttgatcttctaatctgtgacgaggggcatcgtttgaagaacagtgccattaagacaactacagccctcattagcctttcttgtgagaaaagaataattctaactggtcagtattcagtttggggaagatattttggaatttttgcctagtgaacatacagacttgtactatgatgcttaacattcaaataactggtggtgttggatggaatttatactaataaacctgtgttaattaactcttggtaggattctgaatcttcaaatccatgtgtaattttctgtagcccagactttggagttttttaggaataaacacaatgatatcatgataaggaatttaggagatcagactggattgcttgtgcttggttcccgagtctgacatagctgtacaacttggagcaaattatttagtgtctctgtgcctcagtttttttaaatctctaaaataggaatgataataccatctaactttgtagagttctcatgagggtcagaggagttaatcaatgtaaagttcttgggaaactacctgacacgtggtaagtgtttaatatcagttatttataactacctgacatgtggtaagtgtttaatataaatatcagttatttttatatgtatatgctacatatgcatggtttattgttggacagagcttctggacccaactgtctggaaaggtggaatggatggtaaatacgagaatcctcttctacctttttatttaaggcctagactggagtatgatctaagtagctcaatgtagcttttctcccatatctcatcttggtcttgtatggcccttccactttgccgttgtgtcagcagaataaagaagagaattgtattcattactaatatttacaattcccctattttctacttggggcttcattttccctaccatcttcagcccttttggaaggaatggtcaggatatgattattcttactgtgtcatcgtcattttttccttcatgtgtcgtttatgcatgtcacagctctctgaagttaaatgaagagagagaaggagtatgaccaaaaacttgtacctccttcctatactgatagggtggaaatatgccccagaacaacagagaggagaaaactcctcctcttctgttcttactgtgttggggtggggaagactatccacctttaagaaattcctcatgatttgacttccaatttgtataggaggattgtattaaccattatcaaaagcgatttttaaaatgatctgtgctttaaaaaaatgattttgggaaatgctaaatgacctttttattttttgaatttaatcacgatgataaagacaaaaggactagggtcaaatttcatagttatacccccaagattttctggatgcccaatgaatgtttgtcagtaatagtgaagtggaaaccaaagaataggaaaactagtgttgaatatttataaaatgccatttttaaaggaaaaaatgagtcagggaaataggaaccatactctgaatgattttcatatctttggctgtttgagaagctgagtggattcgttatacttgatttccagtgctgcagttcagatttctttactggcctttgatcttgagatcactggagccagaaaagtaatgaaaaaaaaaatgagttagctgaatttagtaacactgagttagaagagaaaaagactgtttcttcttactgcttaaggatgggggtcagtattgcttatttaaagaatagttgcagatataaagtaaaaatgtttagcactagaagggagaagaaaaataaataaaaaagaagagtgagaaataaaatatactgaaaagtactgaagataagaaataaaagtagttcccttcctcacttgaaaatcataattttctgtagcaaaaatatataattttattgatatactcaatgataagcaaatactaatttaacattccaaattaaatttaatctgcagtagaaaattgatctaggatttcattcaacaagaatgtcttgatagcaaccagtgagattgtttcatttgaggcattagtattgtcctctgtatcctttgtcaatcttagcttgtttctgttttgctgtccttatcactcttatcccctgagctatgaatttaggtaaaaactagccctaactaacctttttaatttagaaatactcatagttggtttctgtattcttagaattgcctgaatgaagtctttgcttttatgggcaggacgttttaccccaagatgatttgttccttattatgaaagtacatgtttgtataggagtatgtacagtgatatatacatgataggtgctcaataactaagaatcaaatgaaaataattttgattttgtttcctcatattatctagcccagtgctgtggagttaatatttactggaaaatggttaggattcagtttgattgatagaggggtattagtcttgtagcactgccatagcaaaagaccacagactaaacaacagacatttattttctcacagttctcgagactggaagtccaagatcaagatgtcagcaggtttggtttctattgaggtctccctgcttggcttgcagagagctgccttctccctatgtcctcatgtactctatcctctctgcaaatgtattcgtggagtatctctctctcttcttagaaggacaccagtcatattggattagggccccatccttaggacctcatttaaccttaactgccttcttaaaggtcctatctccaaaaacagtcacattgggggttagagcttcaacat

SEQ ID NO: 130558 - DNA, 1056 bp, Homo sapiens
cattgctttcgaagcacttttgggtatatgaagtttggaaggctcttcgtaattctttgcatgaaatcgttcatcagtaaggcatgagattttctttttaaattttgtgcccttgggtaacattactgtgactaaattttggacttttttggccacaaatgatggcaaacatttctatcttagggtaatgaaaacaagataatgttggttgctgaaaaagtgaaattacaatacttgtacttttatcattttttaagattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgaggtaggaaaataaatcatttgtttaatctaatctgaattttgatttaacctgtaacacaataatggttttctaagaagatcctaatataatgagtcctgagggtacactatgaatttcaattggtaggaaaggtgaatagtgcttactgtgtgcatttattccaaaagtggttcttgatagatgccacgtgccaaacatactgctaggaggtgggcatatgggaatcaggaccacggtccttacttttaagtggcttttaaagtatttgagtaaacagataaatgcaattgaccttaatgtggtataataaaagcttaccgactgctagtgtggtaaagggtcataagagcaagtgaaagaggcttttaattctggttataagaatttttttttttttttggagacggagtcttactatgttgcccagactggagtgcaatggcgttatcttggctcactgcaatctccatctcccaagttcaagtgattcttgcatctcagcctcctgagtagctaggattacaggcgtgctccaccatgcctggctaatttttgtatttttagtagagacggggtttcaccatgttggccaggctggtcttgaactcttgacctcaagagatccacccacctcag

SEQ ID NO: 130559 - DNA, 1656 bp, Homo sapiens
gctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggcatggttatagtttttattgtcttcttttttttttccctaagtttaattgttgaccttacaaaagatattttattctgatcactaagatatacacaaatgcatatacaaacacatattctttcaaagttctgagtcttcaacatttttagttagaactttgaaagctataattagagatttttaagtcagtctaatttaggagctatactaacctaataccaagaagcttgtctgtatgacattggtttttatgcttttatcttttgaaggagtaaatcctaggattttagagatggaagatatttggagaacactttttttccatctctgcagtttaggggtaatgaaacaggtccagggagaactcaatgacttacttagggtaacaaagctatttatggcagagcagagaccagcacttagtttttctttgtgtaatttccatcccgctattcgatagaagtaaatatccactaaaacattctctagatttaaatattagaagcatttctttcattaaaattgcctttaaagattgttaggttgtgaaatcaggataattacatcaattacccccattctctctctatttttgttccagcaaaatagataaggtattccattgaagctattatatattttggctgtgtgatttaaagacatgtcttaattcattttgaatgtcctgttctggaaaaaatttctttcacagtaaaaatcagaatgaacaaaattaaaattttatgtattttataagtattgttattttagtattcatggaaataaaacctcaattcttaaagcatacatattaaatttatattaaatctctaatatgtatgttacttaagaatttctatttttgctggggttttgttgagaagggatttttaagccaagttgtagaatggggtgggtgtaatttcagcagtgaaggggaccatgggtgtttgaagtcaagagtgagacgctggaaaaaagacaaaagaatgggaaaaagtggattgagtatataagcacaaatgcagtgctaagccattgattttaagtgaatgtagagagagtcaatttgggctgtagtatcctggactaggaaggacatctccctggactaggtagggtagctgctgtttagctccagcagaattttcacatgcggggataaaccagaaatctgcattttttaatgaggaatcttccaattttaaaatgtttgcaaataacacaaaatgcttttaaaacattatacagacaacatgtgagtgggcctcactgagccattgggcttccactttgtggcctttggagtagaccaatggttttccaagtatgggtcctgaccagcagcatcagcatcacttgagaacttgttagaaatgtaaatccatttccaagtgaattagaaaccctgggggtgtca

SEQ ID NO: 130560 - DNA, 1475 bp, Homo sapiens
acacaactaaagggagttaatgcctaattagggattcagtttacttaataaaattaaaagttttttgttgttgttgtttttattccttaatagtctagtttcactttgatcttgggtcgtataggaaagagtaagctttctcttactgctttgcaaggatatcaaattatgaattttaaaatacccctaagagcaactgggtttttttagagttagaagcaattttttggttaaacttgtcttctatgtaactatttgccttggaattttcaaaagtattatcttgccactaattcagattgtaacctctggcaaaatataaaaatggcagctacattcttattctgaaccatttagggtaatttaaacaaattgtaaactccttgttagtttgaggagcctttcaaacaaagctttacacaatgtgcttttctattggtggaagaggcattatataagcaaattattgattactatgaaatccctttgaaattaggagagaagcagaaaaaaaccactttgtagccaagtgcatatgttattttggtaatttactaggaaagtatttttgagcctagcttcttaccagatactgcttatttctacttgatagcacagtaaaaaaaatatcaccagtgggaatccaggacatgaatacacagtggattaattcttggggccactggttaaaatgttcactgtgatgacaaatgatgaaatcccaatagctagatatccagaaaactacgcagtaaaattgttttatactgtgctacttatgcagaattttctctcccttgaaccatggagaaaagtgttttttgcatcgcaggtataaaactgtaccctttggttagtaggtataggtttttataatttgaaaacgacatgtagaaactgtaattttagttagttgcatattttaaaaataacagtgagtagaagaaaaataatatataaatatacaagtatctggttacattttgactatttgtgtgtgtgaatatttacaatattcacacacaaaaaatcttttgggatatgaacatttctctgataaaaatgagttgatttgtacatttctatacctatggcttaaataataccaatttgttaggttttaaagggaagaatataagaaacatgccttttaaattcttatgttactgtgtctacattgacattttctctgtattagcttatttctttaatatatatatttaatgtgcttatatttatttgattgatatcatccttgaatcttaataatctcagaagtttataattattctataatcttaactatacttctacataaatatgcctgttaatcttaccaaactcttcctttttaataaggaaaatactagtgtttgcgttaacatacttaaaaatatatacctgttttgtaaggctatttattttctgtaactcacattgacttatgtctttatttttacctcttcctaatatca

SEQ ID NO: 130561 - DNA, 1475 bp, Homo sapiens; identical to SEQ ID NO: 130560

SEQ ID NO: 130562 - DNA, 1060 bp, Homo sapiens
aaaataggtttgtcttgcttacattattatgtatcatatattttcatactggggttaacaaatatattctaagcaccgaaactggtggccttgaaaatggctagactagctgtttcctttcatagtccaaactgtgtgaatatagctaaataaaaaatctggctctattataatagcaaatgtgattttgtatgtggagtcttaaggcgtgattatactgtttctcaccatgaacagtgattttttacacatgataaggcaggctagcaaattcacatacattacggctagaataatccattgctttaaaaacatgatttttacctgctttttagattgagtgttctataaaaattttttcttaagtgaaaaaaatatgcagaggctaatgtagactgtaaaatgaaggagaagcttagctttactgtggagtctgggtctgggtgtaacctaactagctagaggatatgcaattcctgattgacagcagatccagcattatgcagattttgtaagggagaacactcagctcagaaacagtgatgagaggctctgttaggaattactacattcactactcatatcttttagttttctgtctactggatttgtaaataaatagcacaaaacagttcctcttttgtttttattaaagtgatactgcaatgcagttcagtctgtcagctaggcatacatgtgtgaaatttgatattctcactaaattagctaatttttagctgtgttccatgcttatctctagacctttgtgtattaaatcctgtctcgagctgttccctttatacacaagtgtgttttgcttgtgccttcctgtcttcttcagtgagaagctttatgtaggtcaggcttggcttaagcagatttcctgaacctgcgtcagcttaagctggaggaattttaataaaccctcccctgtaggcgtgggcctaaatgaggctagcctagttaagcctgatctttttctgtttgtgaaaagagctgagcagagctgaaggctgcatggtggtttcagaaactgcctacttaatttgaaaagaacaat

SEQ ID NO: 130563 - DNA, 1041 bp, Homo sapiens
aattcacccgcctcggcctcccaaagtgttgggattacaggcatgagccaccatgcccagcagatattaatttatttttaaatatctagttctagtttatatatataaccagtatgtcctgttttaaattagaatcttttatgtaaaaatacagaaaatacagaaaattaggtttgagttctgatttaaatatatatttgtttcttttagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacaggtaagactgctttttattgataaggtttatgcttgaccaatagtattacagtattctttaaatgatgttttaagaatgaatatgttatattagaaaattgttgatgtaataccactacattgttggtagttcaggttttttgttgtcataatttatctttagtgattggattaataactgtgtgattaaagtgctttatagtagatgtatgcttaagactgttgattataaacttggtcaaatgtgatcttttcctcaagaaccaagattgtgtttaaagataggatttatacattttttttctaaaaagcatgttaataggactaaaattggagagttgaacttgaaagtagttacttgttaattcattagagtctggagtacttcaaatcagagttgaattattatgatacatacttgcatgaaaaccaagcatttaacaaatgctccatccctctattgttgaactgagttaaaataatgattatggttctttttgtatatgtaagagaacactatttgttaggtaactaaaaaaataattaagatggttcatagatgtttatttggtcttgtgaaagccatcattagactgtatttttccaaattacattttattcatgttttggttgaatgaacagattcagccagccggccccatc

SEQ ID NO: 130564 - DNA, 1046 bp, Homo sapiens
ttagagttcagtcctgtttcccctaatctgaggtctgtgtgccagtagacagtattttccatttggtggtggtctggatttctgaaaaacaactcaaggacatatgttaagatgttacctttagtttctagagggaaccaaacattttgtcaatctaacttccctcaccattattttaagctattaccttcttgctaatcatattgctcatgtacttttcagggctagctaagtgcctggaatttcctttgaaggaactgaagattttccttttgtttctatgcttggggggccaggcaggcccataagaggggtttctgttccatcttagttgtagttttgagctatttttatatttgggggtgattgtaattagattcgtggatagttaactgttttgggtatttttcaggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgaggtaaggcaaaaaaagactcatgatatagataatatagagaagcatgtatgtttaagaaaatgccatttaaagagttaacagtattttctgcctgtaggaattttcagtatctctgaaaacatcttctaaaaaccttggaaatgaagattacataatttttttttaaaaggaataacaggctgggcacagtggctcatgcctataatcccagcaccttgggaggcagaggcgggaggatcacttgagctaaggacgtcaagacctgcctgggtaacatagtgagaccctgtctctacaaaaaataaaaatttagtggggtgtggtggtgtgcacctggagtatcagctactcgggaggctgaggtgggaggatgacttgagcctgggaggtcaaagctgcagtgagctgtgattgtgccactgcactccatccagcctgggcaacacagcaagaccctgtctcattcaatcaatcaatggaata

SEQ ID NO: 130565 - DNA, 1022 bp, Homo sapiens
acaataaaaataagacattgaaggaccaatttagacttagcagttatctggagacatctgagagaatatttttatctgaagaaagcagaatttgtttgatacctaacaagatttcaataaaaatccaaactttgtatgtacgtttgtatatattttcccttttttgtatgactatttatttagaaaatttctaggtgaaaaactaaatgatgttttgtatttttcttgcctatagcacagatattctcaaactttctcagctcatgacactatttagtgcctcagtacttttttcacagcatacctggtccaaaagaaatatctaatacttgtgtttattaagcagttagatccaacagcttaataagaatgtacatcatcaccactagtaactgtggacactgcatgtctcaaaccttggaatcagtatcattttcttttcctctctgcttcttgcacagtactttttatcaaactgctgaaaacccagttttgtaaagatatgttgttatagaaaggaatataatgctatttaatgttgaaaatgtaaactacctcaaagtagtagtttatgtgatgtccaacaggtgttgctatgtttttctcaaaaattttaaaatattgtgtggcacccatgttaatttgctaaggtgccctgctacacagtttgggaaccatggctgtaccaaaagaaacaaaatactcctctcctttgtattagaaatctgaactttgcatttcagctttggacctactgacactattttattatacaaattatttaaagcctaaaataaggaatatcctaatactattattttgggaatcagaaacatctaataaagctggactttatacatagaaataaagcttacaactttgagaaagtagccatattttccccaagatacgtcttaacacactgagtctatataagtggcgtaaaatacagagttatcttaatcagaaaaggagtgtatgagtctcattccatccttttatcaatctctgttttggagaac

SEQ ID NO: 130566 - DNA, 1025 bp, Homo sapiens
agtaggtttacagacataagttttacctgcaccttcttattctgcctttatttgtatctaggaacattcaaaagatgatgacaatctggattctttgttggacagtgtagttggacttaagcagatgctggagtcatcaggtgaccctttacctctcagtgaccaggatgtagaaccagtactttcagctccagaatctcttcagaatctgtttaacaataggtaaaatacacaatgttttatgattgaatagctgttggttttaaaatggctgtagtctagggggtgccagcaaacgtttttttctataaagggccagatagtaagaattctaggctttgcaggccatacagcctctgttgtgtattcttctttagttttttttttttttttttaatttatacaaactatgctagcttgcaggctgtacagaaacaaactagcagataaaatcagggcattgttttattttactgaaaggtcaaaacttgttacagcagaattagttttcaagttatttgtttttgaggatacttaatttttaattgcttttgggagtttcttttttaggtactacttttaataatactttagaaagtaataattttaattgtaccttccacagattttacttgaagataagctaaaagactgggcatattggctcacgactataatcccagcacttcggaaggctgaggcaggaagatagcttgagctcaggagtttgagactagcctgggcaacatagggagaccctctctctacaaaaaaattttttttaattagctgggtgtggtggtacacacctgtggtctcagctactagggaggctaaggtgggaggatcacttgagcccaggagatcaaggctgcagtgaactgtgatcgtgccactgcgctccagctgggtaacagcaagactgtgtctcaaaaaaaaaaaattgaaatttgattttagaattctgcttttcaccagatacttttcttgttccaggactgcctatgtgcttgctgatgtcatgg

SEQ ID NO: 130567 - DNA, 1050 bp, Homo sapiens
ctcgctgcaacctctgcctcccaatcgtttaagtgattcttctgcctcacctcctcccgagtagctgggattgcaggtgtgtgctgccaccccccgttaatttttgtatttttttttagtagagaccgggttaccctatgttggccaggctgctcttaaactcctgacctcaagtgatccaccaccttcggcctcccaaagcgcccggattacaggcgtgagccaccacacccagcctcttgtgttaaattttataaaatgattatttgggggaatttttttttaagatcttgaagcttagctttaaaaggagttggtaactattgacggttctttgttatatttgtgtacaaagacacaccaaagtacttcttagcatttttaaaaatgatggagtaagttttattctgtctgaagtgagttcatttatcataccagttttatatgctcatattttaagataatatcttctctttattttctttatttacagttctttaaggaaaaacagtagtgctctgcatagtttactgaaacgagtggtcagcacatttagtaaggacacaggagagcttgcatcttcatttttagaatttatgagacaaattcttaactctgacacaattgtaagtatgtgtgtgtttgtgtttgtgtatatatgtatgtatgtatttggtgtttcttaaatttgaaatctttggccaagtacgatggctcacatctgtaatctcagcactctggtgggctgaggtgggaggatctcttggggccaggagtttgagaccagcctgggcaaaatagtgagaccctgtcttgaaaaaaagagaaatactttgccgtaagttaaatcactttatatattaaatatccaacataaaaaagatcactttagttcattttattttattttattttattttagatagagtctcactctgtcatccagactggagtgcagtagcacaatctcggctcactgcaacctccacatactgggttcaagtgattctcctgcctcagtctcctgagtagctgggattacaggcacct

SEQ ID NO: 130568 - DNA, 1109 bp, Homo sapiens
tctcaaaaaaaaaaaaaaagaaaaactttatttctctgaaaagtttctttataaaccaaaaaagatacaaatgaataaataatacagtaagttaattattttagtacaaaatactttttacctttaacctattgaaaacagaaactatacttactgcaatactgaaagaaaaaaaatttgaaagatgttgttttaaagtaaaagtaaatcaaaatatttaaatatttattcctttaggtgtgtatccttgtattaacttttttaaaagggaaaagtaatttcattattcttaatgtgtttatatgtttgggatgggacagtagcaacaatattttaatgagatagttattgaatattaattgctatgtatttctcaaaagtgctaagtgatggtgataattatttaaaaaatcgatttttttttccctgctccccacaggacattgcacttatcttaccaagctcttctgaaggttctatttctgaactggagcagctctccaattctctaccaaataaagaattgatgacctcaatctgtgactgtctgttggctacgctagctaactctgagagcagttacaactgtttactgacatgtgtcagaacaatgatgtttcttgcagagcatgattatggattatttcatttaaaaaggtaatgatttgtctaatttaatatactctcagatttaattttttcattctgtcactgctccttcaccccacattaattcatacctattgtagaaagttgaagaaatgatttctttcgtgggagaaattttgtgtgtatggaaaagattaattagcaatgaaaggtcatgctaataatagaatcttttggattaaagatataaaatgaatagatacacaaattactgtgggcatggtacagtatctggaaggaaatctcactgttccagggatggtaattcatgccttaaggtctttgtttcgttgttgtatcctcagaagtgatggatgctagagggattttatagaccttaaagctaaaatgcagattctgtgtacagttcctcagtatctatggggaattggataccaaaatctacagatgctcaagtccattatataaaacggtacagt

SEQ ID NO: 130569 - DNA, 1625 bp, Homo sapiens
ttcttaaaactatgttaacggaactcctgagaggtggatcctttgagtttaaggacatgcgtgttccttcagcgcttgttactttacatatgctcctgtgctctatccccctctcaggtcgtttggatagtgatgaacagaaaattcagaatgatatcattgatattttactgacttttacacaaggagttaatgaaaaactcacaatctcagaagagactctggccaataatacttggtctttaatgttaaaagaagttctttcttcaatcttgaaggttcctgaaggatttttttctggactcatactcctttcagagctgctgcctcttccattgcccatgcaaacaactcaggtatcacttccatataacatgcatcttataaatgactgcagtaacactttttaaaaagccagtgattttgttaaaaaacaaaaaccctcatctcccttcctcccaaaaagacataaaataaccggatgagggggagataaaactgaaacaagttggtcattgaggaaatatgggggtaacattttaaataaatttttgttaaagtgagttttattttgctgttatgtatgtttgtacttacatttttctgttattttaaatcctttcccccacaccttaccatgtgttagaatttgccaataactagattgcttcaccaatggactctgctcaactaactgctaacctgagaacaataagattttttagactcattgaattcaagcaaatgtttaactgtataatagaaaattaaatgttttaagcatgcagtaaaaatgttcttttcataacatttcttcctgaacagtttttgtgactataaataaatattaaaaaatctacgtacacacacattatacttttttaacaggttattgagccacatgatatatcagtggcactcaacacccgaaaattgtggagcatgcaccttcatgttcaagcaaagttgctccaagaaatagttcgctctttctctggcacaacctgccagcccattcaacatatgttacggcgtatttgtgttcaattgtgtgaccttgcctcaccaactgcacttctgattatgagaactgtgttggatttgattgtagaagacttgcaaaggtattttcattttgcattaaaaattttttcctcaaattatttttgacacatatattttttcccttacaatttggaaactagggtttggaatgcccagataacatatatacatgtaaatatacacatatacctacatatgcacacatatgaatatatgaatacttgtagacttttaaaattagaaagctttatttcatcatttcatgtgcaagatatcttgaaggtcttgatttgggattttcaaatggtgaatcctaaagaagtactctgatttaagaaaatatattattagaaacctgaatttataaaatttttgcagtcattgtaaaattccagagaatttgtcattatacccaaggaattaaatgttttatgcaaaatttgtgtaagttgatgtgtattgagaaataaatactagttaaacaatgccttaaggtcaagaactttgtttactaaatgtatcgattttatttcagcacttcagaagataaagaaaaacag

SEQ ID NO: 130570 - DNA, 1039 bp, Homo sapiens
gagaagacttgccactcacattatgttttcagttaaagcagtatattactgaggataaggattatggtcattaaaaatttttatcagtgtcttgtctgaatattgagtaaatgaagaatgctttgcactgacttgacatgtatcaattaactcttccacagatatcttcacagtcatcacttcttggagttggttaccttgcttctgtcaattccagtaacaagtgctcaccctggtgtgctgcaagccacaaaagatgttttgaagtttcttgcacagtcacagaagggtcttcttttttttatgtcggaatatgaagcaacaaatttattgatccgagctctgtgtcacttttatgatcaagatgaggaggaaggtctccaatctgatggtgttattgatgatgcatttgccttgtggctacaggactcaacacagacattgcaatgtattacagaactgttcagccattttcagcgttgtacagccagtgaagaaacagaccattcagatctcttgggaaccctgcacaatctttatttgattacttttaatcctgtgggaagatcagctgttggccatgtttttagtctggagaaaaatctccaaagtcttattactctaatggagtactattccaaagaagccttggggtaatttcctacttactccttaaattttctatgatgttagaaaatcagattaactaatggtctagtttcttaaaagaaggtgttattttgagagggaaaaactatagttttgatataacacaaaacttgttaattaaaggttagagtgacagaaatctctaaaatataagatgtggctataaagtaatacagtggactctttagcaccttccttcagttaacccatggtgttaaagattgcaactgtagtaccccctgctgttttatgcagaggggaattctaaggcacaggaatacgtaccttaaggtatatattccttttattcctcttacactttcttgctggctcctgcccttgcattctaaaccatgctctggattcagaa

SEQ ID NO: 130571 - DNA, 1064 bp, Homo sapiens
gatgaggacaagagtacaagtgtaggagtttggttttgggcaggagaaagggaatcttgtaagtatgcaaatataatacatttgtagtcttggagattgtaaagaaatttaaatacttcttactaacaactttatttttagtagaataggtgatgttttcagtcactgagaagaagctagtaattaaatacttactgagtgtttttttcccaccatatggaggaggtatatttgggtatcagacaagaggaaataaagggcccagaatggttgtgctaaggaatttggattttatttgtagaatatggaaaggtattgaatattttggagtagcagatctgatatgatcagagtaatattctcagattttgtgttgcaagatgtattgcaatggaaaagaaattagagttactaggaagataagatagtctgaggtttctaggtactgggttttaagtactttgcccttaacaggtaatggaaaggcaaatattgtgcttatagtgacagagattgtgaaatagccattatattatataatagtactaggacttggcaacaggacctagtaggcgaagggaagtgagaagaagctagagatttctagccagggtagcaattggagctgtggttttattgacagaaactggtaaattaggaaggagagtgaattttgaaaggaaaaataattgtactttggagggtttgtttttgaagtggtggcaaggctctattgtcctatgtcaggttccccaagagcaccaagattctctaggaggactcacaaaactcagcatataatactcagcaaaggaaaaaggtacctgggaggaagttgggaaaaccagttgcaagcttccagagtcctctcacagtggagtcacatagtgcctgcctaattctcacagcaacaggttgtgacatgtgtgaagtgttgcctgttgaggaagctctttagaaactcggcacccaggcttttttattttttatttttaaatagcaacagtgacatgttttgatacatgtatacattgtggaataattatatcaagctaattggcatg

SEQ ID NO: 130572 - DNA, 1055 bp, Homo sapiens
cctttcaggaaaaaaagaagtttgtccataattctattagaaattataaaatgttgtaaaattgtgggtaagatgttggggcagaagttggttttgttgaggaaatcatttttaatgttttattaaaactatttcttgttcaatcagaatttatgtattagacaaagatgatgtaatacttaaatattattcatactaattttcaggggatgatggttatgaacaaatttccagtgatgaagatggaattgctgacttggaacgtgaaacatttaagtatccaaactttgatgttgaatacactgctgaagacttagcttcagttcctcctatgacatatgatccatatgacagggagcttgtaccactcttatacttcagttgtccatacaagactacttttgaaattgaaatcagtagaatgaaggatcaaggtccagataaagaaaattcaggggcaatcgaagcctcagtgaagttaacagaactcttagatttgtatagagaagatagaggtgcaaaatgggtaacagctttagaagaaattccaagtttaataataaaagggttaagctatttgcaattgaaaaacacaaaacaagactcccttggccagttggtagactggaccatgcaagctttaaatttacaagtagcgcttcgccaacctatcgccttaaatgttcgacagctcaaagctgggaccaaattagtgtcctcactagcagaatgtggggctcaaggagttacaggactgctacaagcaggagtgatcagtggattatttgaacttctgtttgctgatcacgtatcatcttctcttaagttaaatgcttttaaagctttggacagtgtcattagtatgacagaaggaatggaagcttttttaagaggtaggcagaatgaaaaaagtggttatcaaaagcttctggaactcatacttttagatcagactgtgagggttgttactgctggttcagctattctccaaaaatgccatttctatgaagtcttgtcagagattaaaagacttggtgaccatttagcagagaaga

SEQ ID NO: 130573 - DNA, 1885 bp, Homo sapiens
agtgagactcttgtctcaaaaaaagaaaataaataaaaataataaataaaataaaataaaaataagtatgtactggaaaagacaaaaacgtgtatagttacttaaaagctaaaaagaaagggaatggcttaacagtatactttattattgctcactgtagaagttgtacagtgtatactcaatattttttaaacagtgagtaattctttttttttaagggtatttataaactatatcaaccaaaatattaagtagttgccatatccagtcttgctgccttttgtcatttaaaccattaaaatagtctgtgccttaaatctcaatttttcagtgtctggtgacaaggaagaggatgctcctcatagagaagattactttgagcccatttctcctgatcggaattctgttccccaggaagggcaatattctgatgaaggagaagtagaagaggaacaacaagaagaaggagaagaagatgaagatgatgtggatgtagaggaagaagaggatgaggatgaggatgatcgacgaacagtagacagtattcctgaggaggaagaggaagatgaagaggaagaaggtgaagaggatgaagaaggtgaaggtgggttatgttagctaggactttggggtttaagtactagaaactaactcgatacagctttgaaaaatgcaaaagaatttctagcaaagataaatgggttccaagaaacccagggtcagaatgtagctaggcctcaaggcatgactagaaatgagatttccatctctcctctgctttgtgtgtttactttaatctcccctgtttaaccagccagcctaaactgcctgactgtatctcagttttctgtttgacttgctacagtatgagtttccctttgacagcatcagcttttgccaggaaaacagggtcatgtaacaaatacatgttggttagggatttggtggctgttttcagagtaaggagtggtaaagctaggtggaattcctaaagatgtctgccacctagatattttagcaaatgctacattatttttaaaaattcaagggaaaaatctcaattacacaagtacatgtggcagtatgatacagtcctttaattaggctttatttttcctttgaaagcaaaaagtgagagatactcaagctaattggctcttaatttgcccaagaaatggcatttaatgttaaagcatttatgcagaataacagataatctgccttggcttttttctacagatagtaaaaatgaatgtcatttcagaatcataggggctcttttaaaaaatatcaaatagctagattatcatgtgatttttttttaactttccccattcacagattatcaaataattatttctagatttattgtatttggcaaaagtagttaaatgttaggcaggcagttttctttttttctttctttttttttttttttttttgagacaaagtctcattccatgacccagactggagcgcagtggtgcgatcttgtttcactgcaaccttcacctccagggttcaagtgatttgtccctcagccatctgagtagctgggcttacaggcacgcacccctacgctcaggtaatttttgtatttttagtagagatcagggtttcaccatgttggccaggctggtctcggactcctgacctcaagtgatctgcccggcttggcctcccaaagtgctgggattacaggcatgagccactgtgcacagccatattttaaatggacacattttctatcaaaatataatggagacctacaaaactgtgtgataggtaaatgcagagaaataaaaattctggaatgtgaaattgttataaaacgaatctacaatggttttgctgaaagtatttggtttaacctgatgatattagt

SEQ ID NO: 130574 - DNA, 1035 bp, Homo sapiens
gaaactctgtaacaccgtctcaaaaaaaaatgaatagtgatagcatgcaaaaagtacttgattaaaatttgatattcagtaatacttaaaatcagctgttggctacttgagattggatgtgaataaaattacatacaatatcatagttaactatatttttgttatttaaatcttaggaacatcatattctaattctagaattgctcttaactttgtacttactatgttatttgttttaatttaggaagtgtttgttacaaaggctgatgtttcaactttgtttcatttacagagagacatctccccatacatttcaattagacttattcttcaacaatgtaagcaaaccaagtgcccctgttttcgataggttgggaaggtatgtacctgctaggtaatttcaccagaaactcatgagttagtaagcaacaccttttgattgattctttagatagaagaaaaggatgtatctgctggtagacccaagaacacagggtttaattgtgtcatggtggtattaaagaaatgtcaaactcctaaggagatgctaaatttataaaataaaaatttaaatgtgtgaaatagccattgtttgttaacttgtgactcgtgcatgtgtttcttatatacatgatactttcacacatgatagtaaccttctaatttggaaaatatctttgattcttaaattatatagacacattgagagctaatattttatgtgtgtctttcatatcacactactgtgcaatttataattccatagccacattttgtaaaatgaaacttttgttagtagatacccccttttttgattatttagtacatgctaggtagtttttttcaggttaggtattattaaacctgttgttgtgatgtctgcaaacaaatgaccattcaatgggtttacttagaactcataaaataaaaaaaactaaaggcagcttaaaaatgagaaaatgtctgtttctgtcaggaattaacagtttcttagacatcacttattctgttattgacccctctcttatttattat

SEQ ID NO: 130575 - DNA, 1063 bp, Homo sapiens
aaaaaacacttaacattacaaatcaagaatgcaagataagccaggtgtggtggcatgtgtgcctgtagccccagcctgggaggctgaagtgggaggatcacttgagcccaggagttgggaggacagcctgggcaacatagcaaacgcggtggctcatgcctgtaataccagcactttgggaggctgaggcagggggatcacgaggtcaggagattgagaccatcctggctaacctggtgaaaccctgtctctactaaaaatacaaaaaaaattagccaggcgtgatggtatgcgcctgtagtcccagctactcaggaggctgaggtaggagaatggcgtgaacctgggaggtgggacttgcagtgaggctagatcgtgccactgcactccagcctgggcgacagagcgagactctgtctcaaaataaataaataaataataaaaaaatataaaaaagcacactatatctctaatgttaacatatacaatattagaaaaagttgtttaagttaaaatcagatttaagcaaggttatttggtaaacaagtatatgagtggaaagctattgtatttgtatattcctgttgatgagtgaattaatttcctttctgtatctctccctattgtaatcagcttttactttgtattttacactgtaattaacagctgtctttatattaatatttttccaaatcctctagtgaatattatgcttaaatgtatacacccgttgcccacgttaatattacaatactgtaatactgttttgtggtttcgtttttcacctaacaatgtgttgtacatctttgtgaatcaagaagtaatacacctatataatatttcaaaagtaagcttatttttttaaattttctttttttttttgactaggtaatacatgtatgaggtacaaatacaaaaggtacaaaagagtatgtggtaaaaagtaagtctcatcactgtcccctaaccatcttgtttctctccttagatattctatataatatccttttttattggctgtgtaatattctttaagtggtaatgctatatatattttttgaaa

SEQ ID NO: 130576 - DNA, 1067 bp, Homo sapiens
cctactgaaggacatcttggttgctctcaagttcttgcaaatatgaatagtgctgttataaacatcacgtgcaggttttcatatggacataggttttttaaatcatttttatttttttttgagacggagtcttgctgtattgcccaggctggagtgcaggggcgcgatcttggctaactgcaagcaccgcctccaggttcacaccattctcctgcctcagcctcccgagtagctgggactacaggcgcccgcccatggctaattttttgtatttttagtagagacggagtttcaccatgttagccaggatggtctcgatctcctgacctcgtgatccgcccgccttggcctcttaaagtgctgagattataggcgtgagccaccactcctagcctaggttttttatttattttggtaagtaccaaggagtgtgactgctggatcatatgggaagagtgtcattttttatatctcactgcaatttttgtgtttaaggcagacttttttccagggggaatggtgagggaaagcaatgaggccttgcatttaaaaaaacagtatgtggaacttgaataatatgcagtatttcaaggcatttatggaagatgaaagaaaattatagtgtggtcttttttttttttttttttttttgggcaaagtctcacttttgctcaggctggagtgcattggtgctgtaatgctatcgtggctcactgtggcctcaaactcctgcaccctaggcaagtagttgggactgcaggcctgcaccactgtgccaggccaatgttgtgtatttctaatggaagaggacactaaaacccaagttgtagagtcacaaagtctgagctgagtataccctgctacacagcagctttgctttcctgggagttacttgtgtctaccgagccaaactttaatcttgagtattccaaaatgaaagctttgtaagtgaagtgctatgtaaatgaaaaagtaggaccattttgatgacaaaagggtttaggaatttttttttcttttttttgagatggagtcttactctgttgcccaggctggagtgcaatgat

SEQ ID NO: 130577 - DNA, 1027 bp, Homo sapiens
ttagaaaattcagtttttagttagaagactaataaacttttctctttttttcttgctgtattttatcagctactcctttgttcattagcataggtattataagtctggcagcatgaaattgtgttactatacaataaatgaaagtaaacaaaaggaatggatttaatgtcttgtgacatttttcttatggcaaggaaaaatggctttcagatgacacttcaaattggagtaattataaaatagtttaaacttgtctgagttaatgtattaccttattaaaaacttagtttaaaaagatatttacaagtaaaaattggatgttctgaaaccagatgtgaccatttttaggtaattgggaaggataactttttaaagtagataagctaatattgataaaccataaaatttctctctgaattatatcctcagctaatgtaagtgtggattaaatcctcaagcctgtttcaccagtggtggtcataaggaaagtgtccctcctgttaatatatagaccaagtctctctagactcctctaacatgcatataaagttttacttgctcagttgcagcctgaaatgatgagttttgttcccactgcctctgcctgtacccttcctcatttccttgaggcatttctcatttgtgaagctggctaagcctgtttgtactgttgtgactgccttgagggcagaatgagtaagttgcatgaggagctataaattaggaggcacagactcatctttcctttcctcaagatcagacgtgcagcaagtaatccaatatatacttataaattgataagggaaagaattgctactaaaactttttttctcattcctctctgttactcgttttcagtgatgctaaggatcatagattgaagaaactggcctattgaggctgtgtgcgtgtgtgtgtgtgtgtgtgtgtgtgtgtgtgtaaggagatggcttgggcattcaggaggttgggtgacttttacaagttgttacacagctcagcaccactcatcctggtgtgacgctga

SEQ ID NO: 130578 - DNA, 1044 bp, Homo sapiens
acataacttttatatgtagtgggaaacacaaaaaattgtgtgacttgctttattgtgatattcactttaatgcagtggtgtagaaccaagcctaccatattttcaaggtatgcctctatttgatggaaatacatccttattttagagagattcgcaaaacttcatgtgaattcctggtttcaccctcaaaccaagtttgagctatgtgtttcaaagagtatacttttggtaaagaagcacattggcctgtgttggctctgagtgcttgaattgtttccaaaatttgctgtctagaactagcatctgctgtcatcaaaggtggactatcctacagggctccaaaagtgttctataatagaatttctaagcaaaagtggcattgtggaagtaatgtcacatcaataatctgtggtgtccatttcaaacattaggccaaaaaaaaagtcatttaataccttgtagtgttgataatgtcaccatatcatgaagtcggcatggtcattgccttgtgtgtgctgtaaagattcagaggatgaaatattctaattaactttgttgcatactttgattcaaaatgaaatgaaaatgctcagtattcatttgctacaactgggtaaataaaaattgtattcctggtaatatctcagcactggattgatttgcctcttttacccaaaagggcagttggagcctaagttgaatgactgactgatgggaggcagccattctgagatttctaaaggaagctcagctagatccatcttcttcctcttggcttggtataggtttaattttgatttagaagtaacctgattttacctttccaaagtgtttccttaatttaatctcacagatttaaattttgagaagagtagttcagtctctcgatatggagcctctcaagttgaagatatggggaatataattttagcaatgatttcagagccttatagtaagtattgcttttatagtagtgcagtcccagaattcatactatttttctcttacctatactcaaatttcctcctacaactttgtctccct

SEQ ID NO: 130579 - DNA, 2243 bp, Homo sapiens
cattctataagtacatttatttatttatttattttagttttgagacacttgctctgttgcccagctggaatatcgcggtgtgatctctgctcactgcaacctccgcctcccgggttcaagcgattcttgtgcctcagccttcccagtagctgggattacagatgtgtaccatcatgcctggctaagttttgtatttttagtagagatggggttttgccgtgttgaccaggctggtctcaaactcctggcctcatgtgatctacccaccttgacatcccaaagtgctgggattacaggtgtgagccattgtgcctggctatataggtttctactttaaagccaaggaaatagctggggagaagtatgaagtggtgtctgttagtgatcgcaggtagacctgtttgtaaatcactctaatgaattgagtgtgtgcttggtctctgaagtgaatagaaacttctgacagctttgcccatagagagagactttgaggccgattagttgtggagaaagtgacttattaagaaaatgtcctaggagaactgaaaatgtgaacgtgggagggataagacatcaaaaggtgtcaaaatatataataagtgatttgcaaatgagtcattaaggtgtagggactcacaggcatttctatggacattctctgggatggctccctggtttgatctgggggatattttaatggcagacttcctaccatgcacacacattcctcatgtgggttaattgtcagctttattctgatcctaaattcggctgctaaactggatttaaaccccacatgtatactgtctagatttgagaatgaattcaaacctatcttttggggttctaggaactttcaggacatgagggtgccaagcaaacatttcctcagctttttttttttttttttttttgagagggagtcttgctctattgcccaggctggagtgcagtggcacaatctcagctcactgcagcctccacctcccaggttcaagtgattttcctgccttggcctcccaagtaactgggattataagcgtacaccaccatgcccggctaatttctgtaattttagtagagacggggttttaccatgttggccaggctggtcgcaaactcctgacctcgggtgatccacctacctcagcctcccaaagtgctgggattacagacataagccaccacgcctggccttcctcagctttgatagatagatggtttgctgagtgagctagctgtgttgggcctgcacaggcagccatgtttctataatgaaccacctaaacagtactttgagttgtacccacataatttttgaggttataaggaaaatcaagtagtattgctagtctgtctgaacaccaaataatacatcctgtgtaactaggcagttgtcttgcagggggtaataggtgtctgacttgctagcatttatcatgcaacctgaagttttgcttcatccacagcagcaagatggaacttattgatgataacaccgtagtcagggcacgaggtttaccatggcagtcttcagatcaagatattgcaagattcttcaaaggactcaatattgccaagttggttttcttaaatatctattttacttaacaatcccaaagggataatggattttctatcttttttttcctcactgtatttttttttctacctgctgtctgttttattattctcaaaggggaggtgcagcactttgtctgaatgctcagggtcgaaggaacggagaagctctggttaggtttgtaagtgaggagcaccgagacctagcactacagaggcacaaacatcacatggggacccggtatattgaggtatgtcctcaaaacctgaacccctggacatcgtgaatgagaattaacataggacggaaggctcagaaacactaacttctctgtcttttctcaggtttacaaagcaacaggtgaagatttccttaaaattgctggtggtaagtgccttttacataatgtggctttagttaataagaatctaaaaattttgcatacttaaatttagcaagagtaggtgaatagggtcatgaatggtttttattttctaatggaacatgggaatagattttcttccccagaggtagaagcttccgataataacagtgagcttaatgtataacacttgtcctaaggcttgagccaacttactatagttaaatagccattaaaaatagtactatacaaaggtgaaaaggtgatatgaagttgtat

SEQ ID NO: 130580 - DNA, 1048 bp, Homo sapiens
ttgtctaaaattcgcctaacctatcatcatccatttccaagatagctgaattccatgaatctagaagatattcaagatcttttgtcttaccactgtctcaaattcacagggaaactaaactactattcatctttacggtcaacaaatgattcttttcaggtctttatacccacccattctgtcttgtgctattattcagcattatattttaatataatccaaagtgattgtttggcctgtgattcttttactgggtcattctctatttctttggtttggaggtggagtatgaaggtaatgaggggaatactgtgtacttagtgaaatgatatatttctacttttgctacaaaagtccacatttagtgatatgttcagaattgtataaaagtggcagctttagggataatatccctcacagatagtgatacattgttacaggtagacactaactgtttaagtgttttgtgttgtgtgtggtgtacacctcacagtgtatttgacaaaaatgagtatcatgctttccctgctggaatgcatgaatccctttctccattacttctcaaacttgcatgtacttctgaatcacttgaagattcagttcagatgaagattcatatttattaggtctggggtgagctggattctgcatttctaacgagcttcccagtgatgccattgctgatctgcagaaagcaggggagtagcacagctctaaattacttctgttttgctttgagtacaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccaggtaagaaagatacttagtggaaaacttatttgctttttctcactacatatgagaaatatctaatattagatattagataatctat

SEQ ID NO: 130581 - DNA, 1462 bp, Homo sapiens
agctgtaaggagtgagagaagggctcccaagcaaggctgatgatacatacagctctcacaaatcatcactgggccttgcacctcccaaattccttgcccccaagccacattccaacctaggtctcagggatgagggaagattgaaagggatatggcaggtcagtgatggactggaactgagagccaaaaaagaataccggttcagtttcctgtaggagggtacctaaagctccagtgctggttctgttactagcttttctcaattgaatgagatttaatcgaatttttcagaagagaaaaaaactagtatacgatcctatattttgaagcagcagtcacaaggagaccctttcaaacccttgtaaatctgatactaattaacagaagtgaaaaaggctcattttcagctatgagctctcaaaactgtttcttaaaggttttgttggccattctggtgatcaggtgatgaaatgcaagtcaggttccagcagatcacaccatcacccggattttgtggctaaaatatctgtattatgggtgattgtcactttgcatgttttgtaagcaaccatttccttgttgaaggagacagtctccttttgtttttattcttcccccacacactcagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgtaagtttttcttgggtcttggcgctattctacgctatatgctggtaggtgcttaagctgctttcgtaactttctgtgcccctggttctttctgaggcaggtgaggtggttatataaggctctcccatctgtaatcagtagtacctggtaatcatttaagaccttggttgtggacacccataattagagatgctacaaatacctcctttcaaattatattcctgcttttccagtgataagcacttgatttctgaagcttagtgtgctccagataagcactgactctgggaggcaacctggctatatagataattttagtacgcatttaaaggcaaaataaaagtatggctggattctttttattttattttttaaaacgtattaacctttaagaagggcagtttgatgcacatgttgcatttaactttttgagcatcaagtatttttttaacatttttgagcatttctgttgctctccaggatatctggaatgagcaagtgagcaaaaacaaaaaacaaaaacaaaaaaaaccacatagattaattagccaaagtttccattggatcacaggatcagtgcttaattttaagccatgctctcgctcattggcacctgggtgcaagccatctggaat

SEQ ID NO: 130582 - DNA, 1032 bp, Homo sapiens
tcctgtaatgaaccgcttgatagttttgaaatcagaatatgaaccgggcgcggtggcttacgcctgtaatcccagcactttgggaggccaaggcgggcagatcacccgaagtcaggagttcgagaccagcctgaccaacatggcgaaaccctgtttctactaaaaaaaaattcaagaaatcagaatatgagcacaggctgtataactttctgtgagacttaggtgcctcaatttgtattgttggtcttttgcacagtttttgatgagtatgaaagaggcactcaagttaaatatgagatcaatatgttagtcttttttctatacgcccatatttagcttgctgtcttattcatctccatggaaatgtagaaactcataagaacaaaagacaatttgaagtcagcttggagatttttatgggaaaaagttatttcttgggcctctgctgattgcaaaatgtggtggttctaggtatgaagcttaaagtcagggaccccatattcattcagcatctcaacttaactcttctattgggtataaatggcccggatagttgtgttcattccacaagtgaaagctagtgaccagccactggtcttctgtttctaaacctagaagatgtttgataaccagaagacaatgcagttggggcccattttttaatttaatctgagccagctttttattagttgattcccaggaagacttaggcatcaattcctttgggactatttcccaggttggatttttttctttttaaaggtctgaagatataaattagcttcaaagcccatcatgtggctagcctttaggtgagaataatgcagaattgatctgcttgtttcttttaggtcagttccttctggcacagtctatgctttgacctaatatgtggtagtggccaagagaggtttatcataacacttctcatttgatgctgtactgacgggtaggtagcaagagggagtagaagcataacttaaaatttaaaatatttagtagcctctagtatgaaacttaaacatcagttcc

SEQ ID NO: 130583 - DNA, 1041 bp, Homo sapiens
ttacaggcatgagccaccatgcccggctccttattgcttcttattaagtgtcttagaaattatttggaatttcttatactagaatttaactttaaaattttgtctaaattgttttgtttattttggtaatgatattgaacctctaaggaatgaatgaaatagtctctccagaaaggagctgagctgagcagggagtcggaaaccatacatgttaaactaaacacatgatactacaaagggtaggagtggtgcagaacgccaactactgtgtaaaccatggaaacttccttggctagtgctgtactcccaaagcccttgccatgtaaatgccaactatgtctgtgtgaaataataacttggaccatcttaaggctttttttccacaaagtccttgtggaatttgaaatcatttttgtggctgctgagaatgacatttagagactataacatttccttttattcacttttttttttttttttttcagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaat

SEQ ID NO: 130584 - DNA, 1028 bp, Homo sapiens
cgatggcagttctggagcaccgggttccacttctgcctctgaccggctttgtgacttccaccacattagatctgagtttcctccatgtaaaatggggcgggaatggaggctggacctgggaggtgtcgctgatgatcgtctctgactcgctaagtcgcggagtcacaaaagtggcggaaagcatgccctcactttttgggaagagtaggacgaggggcggggctgcagcgagacccaccagtctcgctttccagggcaggcggcggccaggagctacagctgtgggctgcactcccggcgtggagtctccttcctgcccgcgcaggccccggcgccccagcgaaacgctccggccgctcccctctcccaacactctggttcccgggccgcctgcggggacgcggttggcggcgacaccggaggggggtgggtcaggaagtgggggcgcggcggccaggagcgggcccccggaggccgaggggttcggcgacgcggagggagggagagtctgggccgcgcgggagccgcagggcgccctagccttcgcagaaacgatggcggaggaagaaggtgattgccgcggggtccagcgcgccaacggctgccagtggtctcgggaaggaggggcgggggcgctggaggtctgggttggagctgctggtggccgcggtcgcggtggcggccgcgcgggcagggcgggaaggagcgcggcgcccaggagaggactgcggagaaattcaggagagcggagcaaatggcccgaagttttgtcggccgaattgggaagcaaaggtggagctgaaagttgggaatccgtagcaagagagaaagctgtgccgggagtggttgggaaagagggagggtcctgatcagattcttggtgaagtgggaggcgcagtttggtttcgaagatcaggtttaggtactcagtgcatatttggaatgcgatttttaaagggctgtggatattgacaaacccagaggcacagggggcgagggaacattcaccacggggataaagaggcagg

SEQ ID NO: 130585 - DNA, 1026 bp, Homo sapiens
agggtagatacaacaagaattgaatactccattcctttaagagaaaactgggcactaccatattttgcatgccaaattgctgcacttacaggctatttaaaaagcaacttaaatacttatggagaggtaagatacaaatctgttttatctgttgcagctaattctgatgtattgcaaatgtggcacataatagcaaataaattttagtcctagtaagaattaaatcatatttaatgaagcctggttactacataataaaagatatagttaggtagttttcttacaacactgttactctgtaatctgattaacagtaaattaggagaaaggagatgttttatcattttaatatagttaacttgacaaatatatgaaacatatcttattttgaaaatctgttccactgttattttatcacttctcggacttctggaacattgatggccttcaatcaccatgatttaaagatatattaaacaagatgtaaagagtgaccacaaatgacaggagtgttaacttgaatggcagcactgcgtattctgtttcttctcatgttttctgtgactgaggtataggtaggttggtaaaaatttcaggagactgtccctggtagtttagattcttacattgttattgttattgttgttgccacagcccttttggcagttggaagaagcctgtggagtctgtctcaggataatgattttaggccagacatggtggctcatgcctgtaatcccagcactgtgggaggctgagaggggcggacccacctgaggtcaggagtttgagaccagcctggccaacatggtgaaacctcatctctaataaaaattcaaaaattagccaggtgtggtggcacacgcctgtaatcccagctacttgggaggctgaggtgggaggatcccttgaacctgggaggcggaggttgtagtgagctgagatcacgccactgccttctagcctgggcgacagagagaccctgtctccaaaaagaaaaagaataatgatttaaaatacataaaa

SEQ ID NO: 130586 - DNA, 1012 bp, Homo sapiens
tcaggagtttgaggccagcttggccaacatagtgaaacctcgtctctactaaaaatacaaaaaattagctgggcgtggtggcttgcgcctgtaatcccagctacttgggaggctgaggcaggagaattgcttgaacccgggaggcagaggttgcagtgagccaagatcgtgccattgcactccagcctgggcaacaagagtgaaactctgtctcaaaaaaaaagaaaaaagaaatgttcttactacgccattgtagtttatgcttcagcataaggtcatgggattgatttatgtcagtaaatctccttgcttcatagtcataccgtatattatttattcatatttttgttttgtagtcttgttgtgttttctgtctctagtattggggaaagcatatgtttgtaagcatagctaatatttctttgtttaactggtgtttttctcttctagatgtttgtcccacacaaagaaaatgggcacatgctgaaattccttgaagtaaaatttggactaaatatgaccaagtaagttttagattatgtaagtttacctaaatcgataccacttagaaaataaagataaaaaatactcgatggccgggcatagtggctcacatctgtaatcccagcactttaggaggccgaggtgggtggattgtgaccacttgagtccaggagtttgagaccagtctgggcaacatggcaaaaccccatctctaaaaaaaagacaaccaaacaaacaaacaaaaaacaaaaaaaattagctgggtgtggtggtgcatgcctgtggttccagctattcaggaagctgaggtgggaggaccacctgagcctgggaggtggaggtcatagtgagccaagatcacgccagtgcaccccagcctgggcaacggtgagaccctgtctaaaaaaaaaaaaaaaaaaataccacttagaatgtatttgccatattgttaaattttaacattttgttctaaacccagtgatttgaagtagacattctcagtccatca

SEQ ID NO: 130587 - DNA, 1050 bp, Homo sapiens
aaatctcagtattttcaggacaaatagtatatgatactatgggcctaatatttgtggttttactactttttgaaggatatcaagagttgatccaatattaacatttcagaaagactgaaaagctttattatctaataagatccagagcttattatctaataagttcagaaaaattatagtaaaaagcaccacataatccaaacatgagttttgatatatagatgaatatttacatttatttataaaaataaatatatttttcatatataatcgtacttagaacacagtagatgcttgatgtatagtttcaatttactgaagttttaaatgtcctttaaattttattttaattatattctttcagttttattttaattatattctttcagatctaccaaatctattcaaagcgatctgctgaggatatttataaaatactgacatcttacaaagctaattacctaattgtagaggatgctatctgcaatgaggtgggacccatgagaggctgtagggttaaagatttattagacattgcaaatggccacgtaagtaaccatttggaaagttatatatatgtatatatatatattttttttttagaaaaatgactttaaacttataatctttaaactttatttttagaacttaactaagaatataattgagttatgtaataatggggaaagcttcttaaaagtagtttggagtattttttcaacatacaaaagaaaatctgggcatttttgcaaaaataataaaaaataataatggtattaccaatactggaattccttattcattgcctgtacttattcaggtttcaacattcataaacaaaagatggcataatttgatttgaatgatgattttattttattataataatctaaagagcaactggttaccttgttatattcttatgttgagaaatttcttgtaatttgattcatatctagaaaaattgcatgctaaattaacacagtgcctgtacattgagtccctattatccacaaaaacgaatgtattaaaagccatgttagttgttag

SEQ ID NO: 130588 - DNA, 1249 bp, Homo sapiens
agtaattggtgctgtcttgctatctgctctctgaagcctttctattctgctctgatacccacttttctgctgttttgaagatcagcttacttctcctttcatgtcatgcctggcatggacttaagctaatccatccttttaaagttggctatctgacatctttcatagccattaaaatattacttaattttttttataaaaacttcttcaagctaactaagctatcttagtgaacatcattcggtgaaattgtaaaggtctgcactaagtcacgaaagtttccttgcttactaaataattctacacgagaagagtgaatatatttaggaatataatatgttcatttctcagccttggtagggtgcatgataaggtcttcggagcgatgataatggattatggaaacactgccttctaaattttaggattaaatcttttaaaaattggaaacctttgtgctggtttctcagtgtcaatgagaagttcaggagtatagtgggcatggtgactcacttatgaagaaggcttctatttgctaacagtgagatgttttatagacaatgtttagcaataatgtgttttttcatataaatatactcatttgtatattgattgcatttctgctataagcttaataagctttttaatattatgttttatatcttttaatagatggtttgtgaagaaggtgacaagctaacctactcaaaatatgggcgattttgtcatgaggtcaaaattaactattctccatatgtgaattatttcactagagtatactggaacagatcctactttgtatataaaatcaacactgtgatatccttccagtcttgaaaaataacagagccttcatttcaaagactacctgaagtaaaatgcagttttcttctacctactcggtgtcttttgcagatcagagtatggacatttgaaatattgctgcttctttcccccttctgctgttaactggatccagagttctgtgggaaatagaagatcaagcattactgtcctttgattaaatgtgatatctaccactctgcaatattccagacaggtgtcttccttaccgttacatggtctttaacacttttactgattgcaatattttccccataaaatcttcattctattataatattgatcttgaatttgaatatgtgcaaggtcagatacatttctcaaacataacatttaataaataatgtgatataattatttaatagaaagaataattccgaccttc

SEQ ID NO: 130589 - DNA, 1111 bp, Homo sapiens
aatttaaaaaatacgtagtctctattgttgctgtttactaatagttttagatcccaatgtgtattagaattatagctacaaaaagttgcaagtaaaatttagcaatttcctattcaaacaggatctcattagtatgttttttaatgtgtagaattaacactttaaaataaacaggtgtgaaaattataaaggaatatatatgacaattattttctgtacattaatgtctaaacattatacttactttttcataataaaggaaattttggaaccaaatttgctgagtttagcataaaggcgtctttgaattatttctgagtttcctaaaatgtgcaacattttaatcttggcatatctaatcctatgtgctgttctgtaagaggtacactggacttctaaccactatatgtatttagtagaataatggtatcacaaaggaacaagaattccaaacttatagtttgaaatgtctcataaacaaccctttcgtattttaagttagtagctttgtatagctatttaacacagatgagtatagttagctttatatatattatcctctgagtcttatctgtgacaatgtgtatttagattaaatatgttcctcctgtaactaaagttgcatctttgcaaaggatcaaagttcatttcagcagacacaaattctttgaaagatttgggctataaactaacacttcaaattttgtaataatcaatatacttttatcaagaaggaaattatttcatgcttaattaccctccttattttgtttccataataaaactattttcagaattttaagttattttatttatacatgagcttttttggtgacagcttcgctgagatataattcatataccgtacaattcacccgtttaaaatgtataattcagccgggtgcagtggctcatgcccgtaatcccaacactttgggaggctaaggtgggcagattgcttgaacccaagagtttgagaccagcctgggcaacatggagaaaccccatctctacaaaaaaatacaaaaatgtagccggacgtggtggcgcacacccgtagtcccagctacctgggaggctgaggcaggaggatcacttaggtcagggaggt

SEQ ID NO: 130590 - DNA, 1074 bp, Homo sapiens
agggtcaaagaaaagctcgaaacaaaggctctcctacccccggaggggagggcttggtgctgtcatcctaaaccctttggtcctttttacgatttacctttttactgttggggttttagaggctgcgaggcgggtcttgtggttgcttgggtcggggaggctgaccagacgcctccttcaaccccaagctgaataaattcagggagctggggagaaaccagctgttgggtgttgatcgtgacgctagttattatcttaggttttatttaaacatttttttcttcagtgagggaattttattgactcttattccaaagttgggctgtaagttaaaagaaaatctttgaaagtaggaactgctgcacatttgcaagatggctttgtatagtgatgataatgattaatagcccagttaaatgggtgtgattgatgggggaggaggaaaactccaggcattctcaaaaaaggtattggcacaaaaaggtaagttcctcggatagcatttctctaaattcaaatctagatatggcttgttcagtctcagactggccttcactgatagagaccactgtgtaagaagttagtgtacttaggcagttttggcacctgtataatgcccttaattcattccttttgaaagataatttgttgagtgctttccgggtgccatgcactgtgcttaattgctcacatccgttacctcctttaatttaatcttcaaaatgatcctctattttgcattggaagaagcaggtacggagaggtcacttgatggaggtccccctaattaagtgtcaaaataatagttctaatatttatatctcattcttctaattggcagtggttatttgcagaaccagaaatctatgactgttatgttcttccccgtaaggtgcttttttttgctttcttccactctaatctgttacccttcctccttaccactcttccgcatctcctttaacccccaggcacacttcttacatacgtattccttagtcattttaacagcgcagctgtttggattccttttgtggcaaaaaaaaaacccaaactccccccccccccacccac

SEQ ID NO: 130591 - DNA, 1034 bp, Homo sapiens
tcagcttcctgagtagctgggattacaggcgtctgcccccatgcccggctaatttttgtatttttagtagagatgaggtttcaccctattggtcaggctggtctcgaactcctgatctcgtgatctgcccgcctcggcctcccaaagtgctgggattataggcgtgagccaccatgcctggccctcctgtttttcatattttctaacctcacaataggaacttatttcccttcatttaaggtaactttatttcaacaaatgtaattgtactcttgctgtgttaaaaatttttttaatagcttagtgtactgagttactaaatagactgtaaatatttttggttattataatcagttgctatttttgtatttttatttgtttattgatttctgtagctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtattcatttgatacttaatttacgtagggcaattttttggaaaatcttaatatgagatcatcctcctatttttaattagaatttatttctgcctttgtctcttaagatgctattaaaactgcattgtatttaatttatacatttataagatttgacatttttctaaaagaaatggaagagaaattttatgtcatctgttgtctctgaaatagtttccggattgtatttaggagacagagtttaagtactgagaatacagttatatgtaattgatttacagttctttcatattatcagaaatctgatcagaccaaaagaagataaaaactaatattatgctagactttgaaaaatctagacctcaagagagagtgtctagcttttcagggatcttaagtttgccctctttctataactctgggccccttgttcctttcacagttttcagttgatgc

SEQ ID NO: 130592 - DNA, 2172 bp, Homo sapiens
tgcttaaatctttgactaggcattataaatgtatcatattatgtggaagtactctgatttacttcatttcccttatgtttgggcatttaggtttattatacagctgcaatatttgtatctgcaagcctaaatttttcttcagatttcagatatgtttaagttcctacaattattgccatgtcaatggttatgtatttttctaaggctataatttatcaaaccacattactttccaggtacatttctcacagagcacttcagttagcagtgagtgtttaacaaatttttatttttatttttttgctaacttgattggtgaaatatagtatcttttataaacttggctttcattaattcctaatatgggtaaacatttttactgtgtttatcatttgcatttttcttttttatgattcagatgactgaattgtaaacctagtatatctataactaggtttttatatggctggtgcctggaaaaattcccacttcaatctgctgtccttagtagagatattgattaaatgccctagaggtttaaatgctctgactattctagatagacccattagaaatactcattttactttgctaggaaattaatctgctttctaattttatggtatttcaggtatagtaatttaaaacaaatattttttcaaactttttttttttaatcctgtttgggtagaagcatttctattctttccaattgagtgatgattatgctctttgctcgctcctttaaatctctgctggtatgtgtcttttaaaacctttaagcttgtttttaattttaacactgtttgctctttgttaatgtcttgtcatacatacttggtatgataatgatgtccaccttttgtatgttggcctgaaaactctaagcttcagcaaactttctttgtaaagggtcagttagcaaatatcttaggctttctgggccacattcagtctctattgcatattcttaccatttttttggtcccctttgcatagtttacggcccacaaaaattgttcttagctcaagggacgaacaaaaacagaccataggctggatctggcctatgagcaatagttttttgacccctgttctaaacctttaacctttttgttttttgattcttccagttttaaatttttcttttctttttttttttttttttcctgggacggagtctcgctttgtcacccaggctggagtgcagtggcgccttctcggctcactgcaacctccacctctcctcccgggctcaagccattctcctacctcagcctcccgagtagctgggactacaggtgcccgccaccatgcctggctaatttttgtatttttagtagagacagggtttcatcatcttggccaggctagtctcgaactcccgaccttgtgatccgccagtctcggcctcccaaagtgctgggattacaggcgtgaaccgctgtgcccagcccggcttgaatttttcgttagcatttccttgtactgttaaaacatgctaagggggtgctagactattgtttatattacatgaatggataatggtgtatacctcttactttacagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggtaaggtgtatgagggggatgcagtgaagttttggaagccagacaaaactaagttcaaatcctcgcaccatccatttaccagttacgcgttttggggcaagtcatttacactgtcatactggcctgtaacataatggtaataattatcccatttcctaagattcttatgagaatctagtgagaagttatagtgcacaaattctaaggcaaagcattatacagatgttacttcatcattgctgttatcttaaaggtatagagttggtctatcttaaataaattttgtaagaaatgcttgtaagcagaacttttaacatttaaaaattgcaggtagacagcttttagttgtgtgtgtgtgcatttgtttagcagctgggattgttggctgctaagatattaatagcttttagttttacaaaacattaagtcttgtgtcttttggatgtg

SEQ ID NO: 130593 - DNA, 1888 bp, Homo sapiens
tacatgcaagtgccatgatacccggctaatttttgtatttttagtagagacgggatttcaccatgttggccaggctggttttaaattccttacctcatgatccacctgccttggcctcccaaagtgctcagattacaagcgtgagccaccatgcctggcctaaaatttttttctaataacatagctggattgcctctcattgactgattcctttcttacctctcatttttggtctgtgatcttcagttttaaaaaaggggtagcagggctgtttttgcccttaatcaaattttagaattttaggaagaaaaggttttcatagtaagatatttttgtgattgtttttcaacttgtattttccattatagaaagacttgtttaaagtaaaaaaactttaccatgatttttgaaatgggtgcaactttatgtgtgtgttctaggaggtaatacagattttcattgaagacaacttaaccttgagtttacctgtccagttccgacagtcagtcctaagagaactctttaagaaagctcaacaggggtaagtaagttgaaaaattacttcttgatttttgaataaaacagcaagtgcattctggtttatcaaaaccacattttcaaatttcctatggctctgtgacattattttcatgttgttaatataagggaaattaacatagggtggaggaacactctggtgttcctccgtctagtctgttttaaaagtgcttgcagggccgggcgaggtgtctcatgcctataatcccagcactttgagaggccgaggtgggtggatcacttgaggtcaggagtttgagactagtctggccaacatggtgaaaccccgtctctaccaaaaaatagaaaaattagctgggcatggtggtgcacacctgtagtcccagccactcaggaggctgaggcacgagaatcgcttgaacccaggaggtggaggttgcagtgagccgagattgcaccactgtactccagcctgggtgacaaagcaagactccgtctcaaaagaaaaaaaaaaaaaaactgcttgggagaaaaattatacatagcaaaattccattctgttgtctaatatgtaactacattgtcccttgataaattcaaaacctattctgctttctttctccccatgatttggtatatatttattggtatgcttgaatattctaaaatcttacctcttaagaataaatggctcattcttgtgaatatagttgtataatatacacctttcttttgtagtaaaaataacattagttgatctacttttgtattctacagaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgacatgtttttctttccccttttgatttataatttgctttaagcttaccagtgacctcttaattgccaaatccagttccttttttcctgtctgccttgcgtttctgtgcctgacaattggcacttttgacagactatgcccttccgcctggtcttctgctgtagctctttttctagttcgctccatgtttcttcagcatctttattggattctccttagtccttcattgacttctctattgctcttcctttagtatttctgttcatagaacttttgtccttggctcactcatcattttttatttacttccaaagcttcactcatctgtttcatcacctgtttactaagaactcccaaatcaagcctcttgtctgtcatgtgtgctgtggaatctgtgtttctactggatcactctacttctttcttaacagtcttaatgttagaga

SEQ ID NO: 130594 - DNA, 1756 bp, Homo sapiens
attgtttactttttaaaccttggttacctttttaactattcatgaatagctcatgaatatagaaccattagttctatattcatgataaatcacttactcttttcaattattttctttttggttttaaaaattttttatttttttaactcttttctgacaggagctactgatttctatggtttatcacttaatataatttggcaacatagttgataaattctgtgagaactgtatagcatggtaactaggttattctttgctacatgtatacacctgcacttattaaaatggtcacattccattccctctttgtgatggattgttattccttggtctggtctcttctgttaagttacttaactaaatctgtgattggtacattgttgaaaaaggaaaattcagttgtttttaaatccagccttttcaaattataatttacatttttataagtacccatattcaaatgaaaattactcaaattcctaggtatgttcaagatcagtaaatttagaaaaagcttcagagtctttgaaaggaaacatggctgcttttctaaagtaagtacctttcttttcttttttctttttttttttaactttgaacttagtcctgtgaacaaaatatctgtattatcttttgtttttgtcttgggtatcttttaaccaggcagtaactggtgtttgagaacccattaagttcaaatttgtatagccacgtgagacattaggattatatagttacctttttttaatattgtggcattgacatcacaattttaaataaggaccaaagggaaattttaaaatctattttaaaatatcattatacagtttatgtaatggtggctttttaaatggcttattaaaattggttgatatgattgtttttctcaaactaaattatacacttttttgttttacaatatttcttactgatctaggaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccaggttagctctctagtcggccagccaaaatgttggcatgttttgcccctctattcaaattaaccttgaaatatatttgaggattctctcttgttttaattaacacttgtgttggtaattaatagaaattcacctgtcttccgtatcagatttctgtataagcagttatgctctggagctctgccaagccaatgattagtacagattcagtcctagatacataaaagattttagctggggaaggctgggcgtggtggctcacgcctgtaatcccagcactttgggaggccaagacgggcggatcacgaggtcagcagatagagaccatcctggctaacacggtgaaaccccgcctctactaaaaatacaaaaaattagccaggcatggtggtgggcgcctgtagtcccagctactctggaggctgaggtaggagaatggcgtgaacccaggaggcggagcttgcagtgagccaagattgcgccactgcactccagcctgggtgacagagcgagactccgactcaaaaaaaaaaaaaaaaaaaagattttcaccggagaaatagaccaaggtaacactgctgccagtatgttcatggaggtaaaaacagaaagcaggagaggagtggtgagaaatgctgggacc

SEQ ID NO: 130595 - DNA, 1008 bp, Homo sapiens
ttttatatatgcttctgttaacacattatattcaaaagtagtgtataagttgtgtataagtctgtaagttaattattttcatatattccacatagttctttgcatgaaatattgatttttatcttgtttatattttcattatctttatttttaaaatgcattcatttattaaatgtagatatagtaaaattttgttaggttttctgtgtgaggataaagttaatgtgtaatttatacaatgttgaatgcatcagttctcaagatgatagcagcttttaatttatagatataatacaaaatacataattttaagtaaattgttattctcgtgtatatctttgaattaaatcattgaaatataaatctttttttagcttcagcaagtgtcaacattggtcagttagagcatcaacttatattgtcagtggatccttggaggattagacaaattttaattgaattacatggtatgacttcagagcgccagttctggacagtgtctaataaggtaaaccctatgtcaagaacagataagaaaattgcccttgttttctgaggtaatttaatagaaaagctgttccctgacctttttgataataaggacctcttacttaacagttttaagaccttcatatgaacataattgcatttttaacatccattgacagagaaaataggaaatgtcagaaacaaaaagataccattaaatgagtaacatctaaaaatgagtttttccatttgttgacaaaatatacgcattttatttcattcatttgttttttgagacagaatctcactctgtcgctcaggctggagtgcagtggtgcaatcttggttcactgcaacctctgtctcccagattcaagtgattctcctgcctcagcctccctggtagctgggattacaggtacctgtcaccatgcccggctaatttatgtatttttagtagagatggggtttcaccatgttggccaggatgatctcgaactcctgaccaccagtgatcta

SEQ ID NO: 130596 - DNA, 1026 bp, Homo sapiens
ctatctcaaaaatcaagaacaaaccaaaaatttttaagatgaacaagtatagcatgatagttatgataggggattctgggactaaccgcgtgcttaagcttgaatgccagcttcatacttaaatagccgtataatcttgaacaagttatttaacttctttgtgttgcagttttctcatttgcaaaatgacagtagtagcataatagtacttaccttgatattgttgtgaggattacctgaattaatatatataaaactcctagtctttgtgtgcctttttttcctaatagtaatcccagtccattatttattacttgttgattgtagcgaatgtgttcattttcgttagtgttatattatggctgtcattttcctttctctttaagagacgacccgtgagttatttgttttaaatgcgattgaagattgttgaaagattcttatctagatttggcttcctctatgtgtgcatatatatatgtattttttgtttcttttagtgggaagtaccttctgtctatagtggtgttatcctgggaattaaagacaatttaacaagagatttggtttatattcttatggccaaaggtttgcactgcagtactgttaaggtgagtaaaagtgtgtatcaaacacttgttaagaatatgctttatggtcaggtgccgtggctcatacctgtaataccagcactttgggagtctgaggtgggcagatcaactgaggtcaagaccagcctggccaacatggtgaaaccttctctctactaaaaatacaaaaattagccgggtgactataatctcagctactcggagtctgaggcaggagaatctcatgggaggtggaggttggagttgcatcattgcactccggcctgggtgacagagtgatagtccatctcggaaaaaaaaaaaaaaaaagaaaagaatatgctttactaattttagcaggaagtcaggaaccagaacttaccttttcctaatcttttcctaatctttaaagtcacagtcataggcctaaaaggat

SEQ ID NO: 130597 - DNA, 1071 bp, Homo sapiens
tgaccccattaggcccctgaagcatctcgaggggagtcagtaactcttgcaagaaggcttaaggtggatgtaaggccacaaggcaacattgtcagtgtctgagtccttgatttttatgtaacttctcatagataacagaacttaaaaatcatttgggggccaggtgtggtggctcaggactgtaatccccagcaccgggaggctgagatgggcagattggctgaggccaggagtttgagaccagcctggccaacatggtgaaaccccgtctctactaaaaatacaaaaaaaaaaaaaaaattagctgggtgtggtggtgagcgcctgtaatcccagctactcaggaggccgaggcagaggaatcacttgaacccgggaggcggaggttgcagtgagctgagatcgtgccaccgcactccaacctgggcgacagagtgagactccgtctcaaaaaaaaaaaaatgataataataatttggggaaattttatgagtctcttttgttgcccataaattgtgctaagcagaggtaagggttttatctcactacttctgtatgctttaaacatttgtaaaagaggcaaatacactttcttggtgcagccttgtctacctttgacattctgaagaaaagagaacaaaaatcagattgttttcaacccctcataaaaagcccatcacactttcttagacttagttgtgttgatagttcttataatacatttactcctagtatttagcattatatttatgttcacctaaatcttggctgagtttttgtttttaataaatacatgcatggaatttaaagttgacttttaaaatagagattaatgttgtgtgtctttccttttagcctccagtctgtggactttgaagctgtggcaatcacagtgaaagagctagttcgatatacactcagtataaatccaaataaccattcttggttaattatccaggcagatatttactttggtaagtgagatgtttagttgctttgtgttttgtttttatagcactttttgaagtgaaagtaaatatataacctattttatttcaatacttaagtttt

SEQ ID NO: 130598 - DNA, 1057 bp, Homo sapiens
cctattgctgtcttgattcccccaaaacacctcaaattcaacttgtccaaactgatttgtgtctgtctttaccataaagtaataaactcctaatacactcctaataaattcacctgtcctttcaaaaacaaaaacaaaaaacctgcaaaataccaaacatttttgtttaaccatttgagtagttcaagcccaaaccctgactatcatttttggcttttttctttactgaccctcctgccaccatccagttagctctcacatcttgtggattctatctcctaaatccctatttttttttcctaatttctttggtatatatttaagatatacagaataatgttttaatatacacagtgagatgattactacagtcaaacaaaaaaacatatccattgccttccttagttacccattttttgtgataagagcacctaaaatctactctcagcaattttttagtatacattatggtataatgaattctagtcctcatactgtatatcagtttgctagactttttctatctaattgcaaatttgtgccatttgacctacttcttcccatttcctccccattcctgcacctggtgtcaaattttgtccgtttttttttttgatatgcattgccatttcctctgatgtaggctaccagtaccataacttaaatgatattttaaaaatacttataatggctttcaaaataagattgaacatttattagatttttggtttattttttacagcacttttaagttcacagcaaaattgaataaaaggtacagagttcccatatatcccccgttcctccacacacagcttcctcttttgacatcccataccagagtgacacatttgttagaatccatgttagctggtttttgaaaataatgagaattttgcttttgtaggtaataaaacgaatgataaaatgttgttctttgctgaattgccacacacaggttagtttataatattatgaagttgttttatttttacatatgttagagtttataataaatataaagcattgaactggaaattagcttttattttccata

SEQ ID NO: 130599 - DNA, 1323 bp, Homo sapiens
tcccatgtataggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaagaaattataaacaagataaatgctgtggctccttcctaactggggctttcttgacatgtaggttgcttggtaataacctttttgtatatcacaatttgggtgaaaaacttaagtaccctttcaaactatttatatgaggaagtcactttactactctaagatatccctaaggaatttttttttttaatttagtgtgactaaggctttatttatgtttgtgaaactgttaaggtcctttctaaattcctccattgtgagataaggacagtgtcaaagtgataaagcttaacacttgacctaaacttctattttcttaaggaagaagagtattaaatatatactgactcctagaaatctatttattaaaaaaagacatgaaaacttgctgtacataggctagctatttctaaatattttaaattagcttttctaaaaaaaaaatccagcctcataaagtagattagaaaactagattgctagtttattttgttatcagatatgtgaatctcttctcc

SEQ ID NO: 130600 - DNA, 1469 bp, Homo sapiens
tcccagctcttctcccatttctcctaccttctggaccaatgaggacaaacagaattgaagtttaattccactgcacaagtatcttctcaaatctgtgaaatctaccccttttacactataccattccactgctactagttcagctcttattgcctagattatacagccttttaactaatctcactgcttaataaacatgttttcttctagtctgtctgcttcactgcattctaaggtatctttcttaaaatggaactttgatttaaaaatcttccagtagcttcaagaatcagcctataaaattctgacttcttaaagaccctttgtgatccaatctagaccatgcctctttctagccaccacccctcatctttcttgataagaaatgaaggtactccttatttatttttcaccttaggagttctgaactgtgaactgagttccaagtaatgtccctatacctagaacattctctgcctcctactcttcctggctcccttatcttttaagacccatttatggcaatttgaggccatcactatcttttccaatctggattaggtgcccttcctgctagtacatgtcacactgtattgcaacagtccttccttgtctacttccttcaggttggtggcttgttttttttttttttgagacggagtctcgctctttcgcccaggctggagtgcagtggcgcgatctctgctcactgcaagctctgcatcccgggttcacgccattctcctgcctcagcctcccgagtagctgggactacaggcgcgtgccaccaagcccagctaattttttgtattttttagtagaggcggggtttcaccgtgttagccaggatggtctcgatctcgtgaccttgtgatccacccgcctcggcctcccaaagtgctgggattacaggcgtgagccaccgcgcctggccgggtggtggcttatttatctctagatccctaaggttttagcaagagacatttagtactcatctttctcctaaattgcttgtacttttgtttttcctgttagcttttagatctgtgtattctagccattgattcattagagttccagtacagaatactgactgctgctgccttgtgccattttacctccattgaagtggttaagaaagcctcaggtaagactctctatttgttgtcttcttaccttttcacaacttctaatgggactacagtctctgaactttaacattctgctaaacatgcatttaaaactttggcaaaaaaaaaattagctgttcagtaattatctttctgttagaagtactttccaatcctgaatgtgtatcaacaaaaagaccaaatggaatttaaatacagttgaaatgaatcaacattatagttctgctttaagagttctttgggatttgaccatttcaatttcatatgtagaaggtactggttaagaagttctgaagtcctttttcccttcaacatagt

SEQ ID NO: 130601 - DNA, 1141 bp, Homo sapiens
gtctctgtatgatggaaacatatttagctgtaaatgtgctttctatgtactctcaagagtttattgttcatccccaggaagctgtcttttttgaggtacttactgtagttgattgcacccaaagtggaaagtgactctataagagtaaaaccatgacaaagctactacatataactaaacccaattcagaattcctgttacctgtggatactgctgtgtaccaaccactttctgggtgccacagatactcaaggtgaatggaatgtatagttgattaggttttgaattatgctatacaaagtgaagaactagaactaggcttcagggccctctgaagtctttttctgtattaacaaaatcatgatgatgaggaatcctgatttctatatcctaaaccataatgagactatggatatctggaagctctacgccctctattgtccagataccttctctttattatattcttctattcttttccgaaatataccattaatttaaaggaatagtgatcctgaagcccctatagatttgtgccagatttttctctcttgtttaggtccattccctttcctctggataatagctctaaaaaagtttctaaaattattattaaggaaatcattacttatgttgatgacaaactgatttttcctccaactcttggatatttgctctgtagtctgtctttaagacaagagatgaagcattctaagggaaaaagaccatagactttttggaggaggaacacatggcagaatagatctcagaagctatcagaacagtttttaagactaaaatgttatccttttgcatcaggtcatctttttccttattctgactagaaggaaagattgtattttaattgtgggcacaagaaggcattgggttttgactttttctgactgtctagtgatcatggaatcaacttaagcacaattatgttaatttttaatttgtttcctttttgttatactgatattcatccagtggttatccaattcaatttgttcctgtttttacctaaatatgattatgtatgcaacagcatacagaatatatcaaatccagcagtgttaaactctatcttagtgtattcttcagtctaggaatgcaaacttgattcaacatttgaaaatct

SEQ ID NO: 130602 - DNA, 1057 bp, Homo sapiens
gttggccaggctggtctcgaactcctgaccttaagtgatccacccaccttggcctcccaaagtgcagggattacaggtgtgagccactgtgccggccactttgtggtttttcatatatgcatacccttgatagcctgggcagtttcacgagtgttcttacagtgaacacaaagatttgaacctcttgatttgcatgattttgtggggttttccaggtaaagtgaatagccagctattttcacagattacttcagaccacttatgggaaaagcaacgtggttatcttttaacagcaacctttgtaaagtataaataagtggaactagaaagcactcccttgaaatctgcaggtttggatgatcatagtccaggttcccactgtgttacttcaggcttctatttattcatgcaaaggaaattgtttccaaaaattaaggcagaagttttttttcttatttactttaagagcttcttccaagttctaattaaaagttgcatttcaatgtctgaaagttgaattttatctatgtgaaacagagtttgtatattacatggattgcacaatttaaattatgttttttagccgggcatggtgggtcacgcctgtaatcccagcactttgagaggctgaggcaggtcgatcacttgaggccaggagttcgagactagcccagccaacatggtgaaaccccatctctactaaaaatacaaaaactagccaggcttggtggcaggcacctgtaactcccagctacttgggaggctgaggcacaagaatcgcttgaacccaggaggtggagattacagtgagccaagattgtgccgctgcactctagcctgggccacagagcgagactctgtctcaaaaaaaaaaaaaaaaaaatatatatatatatatatggtttttttcctctctttccatagctggggatgttcaaaagaagtctggctaaacatgttaaaaaaggagagcagatatgttcatgacaaacattttgaagttctgcattctgacttggaaccacagatgaggtccatacttctagactggctttta

SEQ ID NO: 130603 - DNA, 1015 bp, Homo sapiens
tatgttagctaaaattatgattctttagacatattagctttcatttatgaaagatccattacaaaaactaaggttttccttgcacaaattgatatttttctttttttttatgacagaattgttggccacctgtattatctggggggatcagtccttgcattatcattgaaacacctcacaaagaaataggaacaagtgatttctccagatttacaaattacagatttaaaaatctttttattaatccttcacctttgcctgatttaaggtaagaaaaatttcagtaattttatttcaaagatataaagttgtgctgatttaatacatggcactattttgtcttttgctttcataaagtagaaaaacgtgtaaaaattgtttactaatatttaatcatatgtcattttatctgagagtagtgctggttgcaaatgatatgggtatttaaaacactgattctataaaattattttcatttgcttgctgagtactataaagacttaacaggactgaattagttttttgttaagatagaaacatttttacatgtacagctttttcctttaaaatttttattcgtgtttcttgcagcttcaactcaaaggaagcttttccaattgatgtatcaaccctatttatttcttaccaaacttaataaggtctatacttaattcttttttctagtccatgagtgtaactaagaggtacagcttatacaaaacatgtactgtattaatttatgattggccttaataagcaatttaatggaatcagacacttaaactcaccaatccccctttccctgcattctgtcccaccttacccaccccataggtgatcctgctgtagatgatctatttagaggtgattgagacttctcttgactgtgatcacatgccttatgtgtttaacttttttgtattgctcttgagaaaacattttttttcacttttaattgcatttattttagtgctgaatttactcctgtgccataagtttttgtttcttcagtttc

SEQ ID NO: 130604 - DNA, 1030 bp, Homo sapiens
gaaatttttcttaccttaaatcaggcaaaggtgaaggattaataaaaagatttttaaatctgtaatttgtaaatctggagaaatcacttgttcctatttctttgtgaggtgtttcaatgataatgcaaggactgatccccccagataatacaggtggccaacaattctgtcataaaaaaaaagaaaaatatcaatttgtgcaaggaaaaccttagtttttgtaatggatctttcataaatgaaagctaatatgtctaaagaatcataattttagctaacatagatggcaatatagctaatttgacattcacattttataaacaagccatatagctcatattgatttttataaagagtaataggatgttttagacaacaaaatgcaattctggtaatagaagacaccaggtgtcgaagaaggacagtaataacaaaatgcatctgcagtctaaaatactaatcactttcaagatcacagaatcgttctctgtatctagcaatagtagcagggacctttttttttttttttcaaataagctctttttaaaaaaagtgtgctctgatacttttgaatatttgaaagcaaaaccttaaaaatggaatcgattacttaaacgattcttttcccaataatgctggtttcaaacgcaatcactatctccaaagtgctgctttctgtaaaacacataggaagaagaggtaccaaagggctgcgtgccaggctgtcagtgatctcacatcctatttatgcccaagaagcagctattaggaccgtctactagagtctgcgagggaacaaagagcagtatattggacagattaggcgggccctggtgcaccaggcagttccaagagggagggatttacaaaaaggaaccagctgcttgaaggcacttattctgcagctgtagtaggattcgggcacatagaaaccacccaaagataggcgccttcctgctgacctctaggggcattaaaagtaaaagtgtcagaggaatctatcgcaaagcaataaacacataattctatt

SEQ ID NO: 130605 - DNA, 1039 bp, Homo sapiens
ggcgcgcccctggacggtcacttcccagccaccctatggtcgcccgagtcgtgtccccctgttatgcgcccgggctgagccgcaggctgacacccccgaaatccaggagttgcagtgggaggaagcaaaagcaaactggcgggagatgcgcgagccaggcggcggggagaacagccgcggagaaggagcccctgagagtttccctaccgccgccggccgcgccgtggagcgcggtggacgcgggcagaaggcccggtagagtggaccccacggccgctccgggtggcgggcgcgcactgagagcagggcgcggcgcgcgggcacgcgggcggacgggcgggagaggggagcgcgctgtccggaggtgtcagtctgaggcgcatgcgtgcggggcgggaccggcccggcctatatattgggttggcgccggcgccagctgagccgagcggtagctggtctggcggtgaggagttgctgcgcgtaggggggatgtgggaggaaagaaagcccagttgggccgatcacttaccacaggcgggagcctcagggaggaaaatcgggagggctgagaactagacgactgggggtcatgggttcccgcgttccgtccctgtcaggaaccttggcaggggaccgggaagcggctgggcatggagagccgcccctcattctaggggcttctctatcccaccctcatttggggagctatcccgtgggagagaggatgggaggccgggtcccctccatggggagaaaagttcccagccagcccagtctcccctttctttagctccttttcctgccctcccccacgccctccgcttcccatctggagttggggtcccggcgcccctccgagcggcggtagggcggcagggccgggaaggagggaaaggagactggaggccgtgacaccagtcttggttcctccgccccctgcttccccgccaccgccgctctccaaattggcgcggaaccggcttctccacagcatttcgcctccacaaccccctctccccgctggtccaggagggaggcg

SEQ ID NO: 130606 - DNA, 1024 bp, Homo sapiens
cttcccggccctgccgccctaccgccgctcggaggggcgccgggaccccaactccagatgggaagcggagggcgtgggggagggcaggaaaaggagctaaagaaaggggagactgggctggctgggaacttttctccccatggaggggacccggcctcccatcctctctcccacgggatagctccccaaatgagggtgggatagagaagcccctagaatgaggggcggctctccatgcccagccgcttcccggtcccctgccaaggttcctgacagggacggaacgcgggaacccatgacccccagtcgtctagttctcagccctcccgattttcctccctgaggctcccgcctgtggtaagtgatcggcccaactgggctttctttcctcccacatcccccctacgcgcagcaactcctcaccgccagaccagctaccgctcggctcagctggcgccggcgccaacccaatatataggccgggccggtcccgccccgcacgcatgcgcctcagactgacacctccggacagcgcgctcccctctcccgcccgtccgcccgcgtgcccgcgcgccgcgccctgctctcagtgcgcgcccgccacccggagcggccgtggggtccactctaccgggccttctgcccgcgtccaccgcgctccacggcgcggccggcggcggtagggaaactctcaggggctccttctccgcggctgttctccccgccgcctggctcgcgcatctcccgccagtttgcttttgcttcctcccactgcaactcctggatttcgggggtgtcagcctgcggctcagcccgggcgcataacagggggacacgactcgggcgaccatagggtggctgggaagtgaccgtccaggggcgcgccctagctgtcccgccaaggcctcagggaacccaggtctttcctgagcgacgcggggacccgagggcccgcccctcggggaggagcaaagcgttggctgaagagctggccaatgggaggcacgggcggcagcacaacgtg

SEQ ID NO: 130607 - DNA, 1579 bp, Homo sapiens
cgcgccggggagacggagcctcgcgggcgggagcccttcccgagatgcaccgggaggcggcgcccggcgacccccgctcccgcccggccttttgtgctgcgccgctcgagcgcgcttgaggcccgggaaatagccgccgccggatgggcgctttggggcgggcgaagtcctttttcacactttttcgattcttcgtctcgtgacgccggcaaaataattctctccctaatttacctgtaggagctttgcccaaggtgacagcatcaggagaagcccatgccttgtcagtcccaagaaactttctgccatttctaacgcttaggatggctctcggcggggcagaagttgcctcccttttgcagtcactcaaaacgcagttagcggtatagctagcttaaaggtctaacagcatgatgtcaagaaaaggggtcaggggtctcccaacaagggtcacctgatcgtaagcagaactggtggccctcgtggttgaatttgataaaatatactgaaaaccagtatgtcgagtaacgtttgtgggaatcatctttgaatgatgaatgtatgctcagtactgagttaactagtaaattgattttaaaagacactgctcttataaatgttctttccatacccttgactattatgtgaacagaatgcaatcatagtaaaggagaaattagaaaattccaagacgtctttgtgtggaaaggaatagagtgaattctcccatattacagatacctggtcaatagacaagtgggtctgttaaaaaaagagaaaataaagggtagggggcgggtatgtttgtttttagcttgctcttttcctacttatccgttttaaaattcacctaaagtatatttcccctattgtacatgtaaagttaaaacaccatggtaaataaactgttggcctctaccatgcttctctggggtaactattttgattgctccgacattcattttcaggaggaaaaaaccccagaagatgcttggaggcacaggcttaaaaaaaaaaattcaggcttagcccacccatttctttattctgtgccttttttttttttttttgtatatctcctctgtcgaagcttcacagatccttttccctgtgctacagttatgctcatcttacaggacaaaaattacttatttaaatgtcttttatttccaactcgacctcggaaattgttttgttcatctttttatagccagtattcagcagttcaaaggcatatatagtaggacttgggtaaatgctgatttgaattgtatgtaggatatcccattatagaattttaggtctctaggttaccatgatggatgatagacggatggtggaattattcccaataaataccaggcttttaaaaacattaatagactttattttttagaacagttttaaagaaaaattgagcaggtggaacaggacttccatatactcactcccctctcccacccaccacacatgcacagtttcccctgttattgacatcttatagtatggcatatttattaccctatgatgtgtttgctatttaatgaatcaatgtcgatgtgttattattaactaaagt

SEQ ID NO: 130608 - DNA, 6439 bp, Homo sapiens
cacagagtaagtatattcactttgagactgtgtgatatatgtatgcatagggaggcaaaggacccaaatgctgaccttttaaaaatgactttctttctttttttgagatggagtctcactctgtcactcaggctggagtgcaatggtgtgatattggctcacagcagcctccaccccccagattcaagtgattctcttgtttcagcctcccaagtagctgggattacaggcttgcatcaccacacctggctaatttttgtatttttagtagagatggggtttcaccatgttggccaggctggtcttgaactctattaaggtgatccacctgcctcagcctcccaaagtgttgggattacaagagcgagccacagcgcctggcctaaaaataattttctttatattaacttttttctattagtttcttattgtggcctcttaaaattctactttaaaaaaattttatgtgtgtgtgtgtgtgtgtgtgtaataaatatgtgtgtttcctcaagtgattttaggcagaatgtgtcactgcccttcctgtgtaaaataactcttaaaaatcatacagctcttcatgttacgtgttgacatagtttacagcaatcctacttgattagcttttttatatggaaaacataatcatactgtgtgtagccaattttaagattgtgttattcaagagtcttatattgccatgtaaataccatctcaaaatgtgccctgttgtgagataaagaaaaacttaagagatttattctattaagctatagctttttatctagaaaaatggcaaatgagtagaatttccatatgcaaatttctattaaataaagatttaaagcatgtttcctggaacattttacttatagacaggaaatgtcttgtgaaggtattgtgagcacactgctttctgatcagtaaaatttgggaattaaaatattttccttttaagattatggtgagaattaaaatatatatttgcaaaagaattggcaaatgcagatattcaataaatgttagctcccctcccagacaagcttatataaatgtgtgtgctccgtaaatgaaattcaaagtttaaagtgtatttttagaaaacagtctacttagtgagccatctggggcttatatggcatctttctagtaacagttggctctcctttccaccactatcagtcagtggggtcacagaataataaacttgtctgtcagccatgaaacacaagctctcattcagccataaacaaattagcgtggcaaattgaattgctaagtaacttttccagttttgttaataacatactctgttatttaatacatccccacttttttctgtttcagagtggaagctcaaaatgaaatggggcagcatattcattgttatgttgcagctcttgctgctcatacaacttttctggaacaacccaagagctttcgcccttcccagtggataaaagaacacagtgaaagacagcctcttaacagaaatagccttcgtcgccaaaatcttaccagggattgccaccctcggcaagtcaagcacaatggctgggttgttcatcagccctgcccgcgtcagtacaattactaatagtttcaagttttgttggttggtttctcttggtttgtgcttacatgtatggatgtgtgtatatgtacagtgaaaatgttgtctctttacaaccaattgataaccaatcacatagttttatcagtgtatttagacactatcttgaaaatcagatttatatgctgtgtatcacataatgccttgcctttaacatttactttttttgtacactttttcagattatttctggaaacatatcaatataattacagtgtttgggggtgtctttaaatatattaggttatacattagtcagcattttaaagacatttcttcccaagtacgagaataggcatctttcattttcattttattttgtattacttaatcttttaagcaagcaaaaatttattctcagggtcagctgtacactttattgaccagtacttgataatctctctgtatatgatgaatacatttttacacactaacattagcattaacaggtgatagttgccatggatataatggaattatggctggactttcttttgaaagaaaacttgatgtattctgtgtgtatggtttttccccagattagtcatacagttcatttggaattcaggtacattaagctttagtgaagagtgcatgcagtaattccaatgtgactgcatgacgtggtacagacattacaggtgttgtagacagaggcacttgtctcgtgcagagggattaaattagacctgtgagattatatttggaaaaattcatgtctgtaactaacccattagtgcagtatttaatttgttactattccttcccgccaattctgtccactcctcacctcgcatcagctataaatttggaagtacttgtccaggcactcaagtgacttcatatttctctctgcccatgggaaaagagataggctttatatttccacagagtgaaaaatcctctgtcatggagcctgtcctgccaagtggcaagagtgtggggactgtctggtgatgatgtctttcatggcatctgagtgaagagtgacaggttggctcaacttttttctttttttttttttaattgccttgtattgtaagtattcttccctgcagtccaagtgacttttcattttttgttttaacttcaggcaaaatctttaaccactctggcctctgtttcccccaccaacggggagcagtgacatttacctccctcacagagtcactgtgaggattctatactgatttgaagtggagctgttcagaactgaaccttgtaggaaattccaagggcctttctactgaatctggtgatggggtggggccgtggcactttctctgccacagctgttcttcacagtgttggtgctaatgaggccagggtgcagggttcgattcacacgtaggccagttaacttagagaaaatctatttccttacctctagccagtcacttcctttttccgcagttgtgatgggttttgctgagccatccactctgactgatttcctctgaagtaaacatatttacaatccaaagcaattctactgacagaagtgttgccttcataatcaaacagcttgtttttccatctcctctgcaaccctaattaaatgagtacaggtctacaaaatgttttcaaggagaaaagcagcatatccttaagtgaagtattatatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgttgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggcctttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattgtttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgttttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccacggtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttcacacttgtcagattcttttatctttatactcattaatattaaaaggaggtacaacttactgtttagtttttttgtccaaaagatgtatttaatacacattttatatatgtttttaaaagcttgtatatattaaggctgggcgcagtggctcatgcctgtaatcccagcaatttggaaggccaaggcaggcacatcgcttgaggccagaagttcgagatcagcctggccaacatggcaaaaccctgtctctactaaaaatatgaaaataagctgagcgtggtggtgtgcacttgtagtttcagctacttgggaggctgaggcaggagaatcccttga

SEQ ID NO: 130609 - DNA, 1140 bp, Homo sapiens
ttttggcaaagtgctgtattgttcagtctgtgtacaaaactgaccatctatgaaccaatcagtataaaaaatttctataaaaacaaaatttagaccgtggctcaagaaaacaagctgccatttatgcatagattgatgtacagtaacctaaccaaatgtcccttttgaattttcaagttactgaaaaaaaatgtgtcgagaaacacattaagaaggcacatgtacagtctacaatactcttcagtctccctaactcatgccctgcccctataaaggaaatatgttcacaattttacttgagaaaaaaaaacaaagccacttaaaaaaaaaaaaaacacacgcaattattaaagttcaaaatctctggaggaaaatacaagcaaaaccactcatacactccaagcctgaaacacacatctaacctccccaggtactggtttggttttcagaggtccacctagaaaacaaatactaaaacttcaggcaaaacagagcaaaactggacatttaacaattacacaatttttaaaagtgtcgtaaaattctcaactatatacaaaacattgtccacttaagctgcctgcctttcaagagtaactctcctcccatgcaaaggatactgttgcacataaaagatatcctcatctgcatgttttccagtacctctttctccaccctaaacagttgaaatttaattggtctcaaatttcaagtgaaactgatacatggcaaggctgacaccactgtatcatgtaggttttctaaataaagcattttatgtataattttaagcattaaagtaagtagatagggatgccatttctaatatatcagcatggctgatggcagtgaaaccatccaagatagaaggcccacttttaacagagtttaaccagtatttatgggccttataaaataaaaagataattttaaagtaacattacaaacatatactactagtgtctcccagtacaaggagcagtctcttgactcaaaaaatgaaaactaatatgtggaaactcttaaagttttcccactaatctatttaaatgtaaatatctgtcttctagttggagtccttcatgtttttgtttccaactcagagaaaatgagaataatgaagatactcttccttgctcg

SEQ ID NO: 130610 - DNA, 1026 bp, Homo sapiens
tgtcagtcattatcttgattaatcaatctgtctattgccccaagcaattgttggtcacttttcttgtaatctctgccttctggctttttaagtttccccgaatttacagacatcatatgacctttgtccagagaatatagctaggaaatatctgagattgctcccacccactaaagtaaaccccattacccagttaattagctgaaagtcacactgttctatcgtgtaccttagtggaatgtttcctgttaaagtattttgggaatgttggcattccctctcttaggttgagggtccaggtggatttggatccttggagcagttcagaatatccctattgttagtgttgtcatgtccaggctctgactctaagaaaagtattgtattatatctatctatctatctatctatctatctatctatctatctatctatatctatctacctatgtacctacctacctacctacctaccgtttcctgttttccagatataaacaaaccctaggcagcacattaatttattaactttaccagagtttgccatactctcaagtctcaatattgtagatgattttttatgaggctaaacatatttcattttgcttgtaccaaaatgaaaacaactttcttatgttacatgatgccaggctatatcctaggtaaggtcatgggtggggaatgttactttaactggcactttattcagtgctacaagtttattaagaggtgtttcaggcattccaacaaaaatttaaaatataactttgtggagttgctattgatttaattgctttagagttgcttcagattcatttcttgaaaattcttcccttctgattatgattttacctctgaggaatgccactcaagaatttataattaggccaggtgcagtggcttacacctgtaatccaagcactttgggaggctggggtgggtggatcacgaggtcaggagttcaagaccagcctggacaacatggcaaaaccccatcttaaaaatacaaaaattagccaggcttgct

SEQ ID NO: 130611 - DNA, 3948 bp, Homo sapiens
acctggctaattttttaaaatttttttgtagaaacaggttattttgttgcctaggctggtctccaactcctaggctcaagcattcctgtggcctcagcctcccaaaatgctaggattgcagacatgagcctccacacctagcctcatccattcctatgctttttatcactgtctttgtgtcatcagctcccaaatctatgcccctagctgagaccacactcctgagctccaaagctctatatcctgctgcctgctggacatctccaactgcattattttgcatatccccccaatttaccatattcgaaatgcctaacctgtactttctgcaggattcattcctgtttccctaaatggttccaccatcctctcagttggccaagccagaaacctgggtctttgacttttcccttccccttttccaggcttacaaggccctgcaggacctggttcctgctcagctcccctagcctgctattgtgaccctccctctggaccttgagcggtactgaaggtgccacattctcactcatccacaggcttccatagtgttcctttgcccccttcctccattactgacctcagccactcaagagtaaagtcattgcaggagtccacccaggtagcctggagaacaccaaatacttcttccatggcattcatcacactggattgttaaacttgtgggagggccctgttcacagccatctcccctgtgcccagcactgcacctgatgcataacaggtgctcagtaaatacatgtagaataatagttgacctggactgaggactttattcgaagtattttgctaagtccattgcctttaacaagagtaggatcagggagactgtctagtagacagttttggcaaagtctcagagacaacagtttggcttaaactaggatgagagtggtggatggaagcaggcagattcgagctgcctgtgctcctggggttgacgggacttggtggttgggatgaggggtgagtaggagggagcaaaaggcatgcgggtgcggcagctcacgcctgtaatcctagcactttgggaggctgaggtgggcggatcatgaggtcaggagatcgagaccatcctggctaacatggtgaaaccctgtctccactaaataaaaaaaaaagaaattagccggatgtggtggtgggcgcctgtagtcccagctacttgggaggctgaggcaggagaatggcgtgaacccgggaggcagagcttggaatgagccaagatcgcctcactgcatgcactccagcctgggcaacagacaaagactccgtctcaaaaaaaaaaaagcgtgaagggtgactgctagggtgttggcctgaataactgccagctgctgctgcttcctgagaaagggatgaagggcagtgtatatgaataagtttgtgggggaaaaaaacctatctttggtatgtgtttggtttgatacgcccatcaggtagccaggtagaaatggataaatattccaagatcaagcaagcctggagttcttcatttagaactcaccagaactccctaaggtaggagctgttgccagctgaagtcacataacttcctaactcacacagcaagtgagcagctagccagggtttgaatgcaggtggctgacccagcacccacctgctgagctgctacacaggaagggtgtttccagttctaggtttggccaagctcagtttcctacagtgtaaatttcttcatgccagctgtaggaattgtttagaaggtcaaagtatgcttgctgggcttacagattttaagtgtaatcaggtgtgcttacagttatagacaagaagtacagagtagaagagaaaatgagccagaggaggatgagggcctggcataatggtggtcaccaggcactgttgctgggacttctgagcagttgaataacatatagcaagactgttactatctagaatttgctcatctgcttgcagaaaagtttgaaggatattattcaaattcaccttattataaaagcataaatatgaaaaagaaccaactctttcccttttatttcacattttaagatatttataggttgaatttgagtaagagtatttacaaaacattatgttgcatttcttgtgtttgactcctgcagaaagggaatagctgtagaatgtaggccaaggcatatgctttcttctaagggtatgtgtgtatgtgtatgtacttatgtatatatgtgcatgctgatttgaaataacttcctttttctgttttattttaggtacaatgactcttcttgcttttcacctaagttgaataagcaccctgtgcactttaatctcctgtcggtaccattgggccaactaaagacaaggttttgaaatctcagctataaaagacatccagccaaactctcagtcttgccttaacaatgttccagaggctgaataaaatgtttgtgggtgaagtcagttcttcctccaaccaagaaccagaattcaatgagaaagaagatgatgaatggattcttgttgacttcataggtaaggtacacttggttacttggtggttcatcttcacagtaaaaatggaaacttgcatctcagtttttgcataaggaaaccaataactgaggggttttcagccttaaaagtaagcaggagtttgtctttaaaaaattgcaggaaaccatctgtgctagataatgtcagtgaaattgactgacatcagactttttagttttgcaactctcacagattgattagatcaagggcacttcattagaagccccttttattagacaagtagtaaccaatatgtctcattacatagttatccagcagaatagaaacagtcttaaaatcactcctgcaaagccaacataaatctatcccatatagtgacacacacacacacacacacacacagaatttctgtgctcagaaataaatttatagtcatatagatgaatataaatggttttctgaactaaataaaagaagatacgtgagcatcagctaatagtatcatctcttctttttctgtgctgtgaatttgatgggtgactttataatgactgcccaatgtgataatcatcctcctgtgggactcttcaacaacacatgtggactgcaatgtggactacgatctagatacttgcactggtttctcagcagaagaagaagaagaagaggaggacatcagtgaagagtcacctactgagcacccttcagtcttttcctgtttaccggcatctcttgagtgcttggctgatacaagtgattcctgctttctccagtttgagtcatgtccaatggaggagagctggtttatcaccccacccccatgttttactgcaggtggattaaccactatcaaggtggaaacaagtcctatggaaaaccttctcattgaacatcccagcatgtctgtctatgctgtgcataactcctgccctggtctcagtgaggccacccgtgggactgatgaattacatagcccaagtagtcccaggtacgttacaagtatttaactctctgtaggcagtccactgagcatgcattttgtctctactgtaattcaaagctaagttattagaagatgcaaaactaattttgttagagatttatgaaagcatgtgcatagtacacaagatggtccgtaagataacttgttgaccagtcacagtgtctcacacctgtaatcccagcactttgggaggccaaggcaggcagatcacttaagctcaggagttcaagaccaccctgggcaacatggtgaaaccccgtctgtacaaaaaataacaaaaaattagccaggtgtggtggtgcacacctgtagtcccagctactcaggaggctgaggtgggaggatggcttgaaccaggaggcagaggttgcattgagtcaagattgtgccactgcacatcagcctgggtgacagagcaagactctgtctcaaaaacaaaaact

SEQ ID NO: 130612 - DNA, 1035 bp, Homo sapiens
gcacatatatacataagtacatacacatacacacatacccttagaagaaagcatatgccttggcctacattctacagctattccctttctgcaggagtcaaacacaagaaatgcaacataatgttttgtaaatactcttactcaaattcaacctataaatatcttaaaatgtgaaataaaagggaaagagttggttctttttcatatttatgcttttataataaggtgaatttgaataatatccttcaaacttttctgcaagcagatgagcaaattctagatagtaacagtcttgctatatgttattcaactgctcagaagtcccagcaacagtgcctggtgaccaccattatgccaggccctcatcctcctctggctcattttctcttctactctgtacttcttgtctataactgtaagcacacctgattacacttaaaatctgtaagcccagcaagcatactttgaccttctaaacaattcctacagctggcatgaagaaatttacactgtaggaaactgagcttggccaaacctagaactggaaacacccttcctgtgtagcagctcagcaggtgggtgctgggtcagccacctgcattcaaaccctggctagctgctcacttgctgtgtgagttaggaagttatgtgacttcagctggcaacagctcctaccttagggagttctggtgagttctaaatgaagaactccaggcttgcttgatcttggaatatttatccatttctacctggctacctgatgggcgtatcaaaccaaacacataccaaagataggtttttttcccccacaaacttattcatatacactgcccttcatccctttctcaggaagcagcagcagctggcagttattcaggccaacaccctagcagtcacccttcacgcttttttttttttgagacggagtctttgtctgttgcccaggctggagtgcatgcagtgaggcgatcttggctcattccaagctctgcctcccgggttcacgccattctcctgcctcagcctcccaagtag

SEQ ID NO: 130613 - DNA, 1047 bp, Homo sapiens
cgaggtgattcagcgcagtctccccattttcccaacagtgagactgaagctcagaagggccaatttagctccagccacctgtagtagagccacagccagaactgctgctgtggatggccaggcccctttaaccctccccaggaactccattctgtgttcttcccacgggtgtcagcagatgtgccatgtaaacaccagcagtggcttgagtgagatgaaggatgagctcctccctcacttggctgggcttctgagcactctgtcgcccaaggttggttgtccttgcagagatatgggacatctggaggcagcctctgactttgggaaaccaaaagagcactgacttgtactgctccctagaaagctcctccagagaagcctttcctgtatcttacttgctacttgcatatattccaggcagaagctgccttcctgggtttggacctgtggccagagggggcaatttgcatgtgggaacccagcagctgtcacaactgcagtggccccagcaatgttttttggccttacagctgccagttatctgacctgggccccagtgccttactctcatgcagcatcacaggttggggacaaggcattcgttcaggacaagcaaaggttcccctgtgtggttctcccctcccagtggctttagctgattcagggctagagtccagcaccatgctctgcagaattgggcttattctctcaactggttcagcagacacagaattgtacgtggggccaatatctgcctccacaatttaaaataaatggaggaaggattttgaaaatatgtttttccctctaagcatgtatcctcaaaaatctttatttacatcagaccttatgataacttattttggaatataactatcacaccacagcaggtcaaacaaactacacttttcttctgattgttcttacatagagcataaagctgactttgaattctgctacagctccagccttcatgatttggccgtgctgctttccagaaggtttcaggaagactggttatgcaagtgacacttcctgtttacctat

SEQ ID NO: 130614 - DNA, 1028 bp, Homo sapiens
tagactttttataatgtggttttgttcagtttataattgaaaagacataatttattttttaaagggagggatggaggtcttttgagccaagcagaacaaggacaaagctgccttcttgaaatgctagggcccagacactttgtttcttttctgtattgaggggttcttttctcttgtcggggaaactgctggactgacgctggttaaagctgttcaaagaacaacagcgctacttcacctaaccttctttgcttcacctctttgctgaattccagaactgtatttgtaagtttgtcctcttaggacacatgctttctctggaatttttattttcgttctatgattgccctagcattgtgaatattagtggtgatctggggaggagaggagtctaaagctctacttttccatttacctccatgtagaaccagcccagttgagagcctccatccctgggcaggagccaaggtcaacagtagcagtgactgggcagggacagtctctgggtcatcagtaggagggtaggcctttaagactttttctagaacagtcctgttcaacagaaatagataatgtgagccacatgtatgtttgaattttctagtagccatatttaaaaaggaaaaagaaactggtgaagttaattttattaatgtatttaatatactaaaattattttttcaacatgtaatcaatataaaaactgttttgcattttggggggtactaagtctttgaaatacactctagtgtgtactttacatatacagcacatctcaattcagatacaaagttttcatttgaagtacttgatctatatttagacttcgtaaaatttataggtgaaaaagtagattcataccctaactgttccaaacatacttgaaagttttcaaaaaactaaattatcagcttttaagtttaactggattaaacttagtaaatggattaaatagtaaaatgaaaaatgcagtttctcgatgatactagtcacatttcaagtgttcatgtgcacagtgtgcctggtgg

SEQ ID NO: 130615 - DNA, 1140 bp, Homo sapiens
cgccgccgccgggcccggccgcccacccagtgggtcggtcctcggcggcccccggggcccagggcgcggacagaggctgacagaggcggcggcggcgcggacaagggcccggcctggccccggcgctgggcggcggttgggagtttggtctctgcctcctcccccgagcgtggcttgttttcttggccgcggcgggacctcctcctctcacccctcctcactcccctccactcctcctcctccgcctgctctcggccgttggatggggccgccccttcgggactcggcgtcggggctcccgcggccacccccgggacgcatctccgaagacagcggcgcttgggcttgtggcccggcgctctgtccccgccctgcgatcccgtcccctgcgcctgccctccgagttccggaggccctgcggctatggggaacctgctccgtgacccggccaccggcccccgcctgtccgcggcctgtcccttgcttgacctggcttgaactcagtcttcgctacctgactttgcacctgtggaaagagcgctctccttggcccttaacatttagatcctttggatcgctcacgcttactgagcgctgagtatgtgccatatactatgctgggggctttgctttatcgccccagttgattctcataataaccttatatgaaataggcccggctatcttacacataggaaacccgaggcacagagagattaagttgctcaaggccacacagccaattaataaaaggaaatggtgtttgtatttcaaagtggcagctgaattttacctggagagtctgttttgcttgtattttctgattatatctgctcagtaggttaattccaatacagagtggattaaggaagagcctctttacaactgtgactcccaaggacttgggcatctattgctaaaaaagccttttctcaatgcacaatagttttgggaaaagggggaacaatgtgacccttggggtcactgaacagaagtcataatgagttcccccacgatactgaaatcaccagcctggtaattgaaatacattttcatttgcagatgtgaaaagcactgggaagcttttaagtcgcaatcagtgtaattctgaactggcagcataattttaaaaggcccctg

SEQ ID NO: 130616 - DNA, 1080 bp, Homo sapiens
ctcctgagtagctgggattacaggcacccaccaccacacccggctaattttttgtatttttagtagagacggggtttcatcatgttagccaggctggtcttgaactcctgacctcaggtgatccaccctccttggcctcccaaagtttaaggtttacagatgtgagtcaccgtgcctgaccagaaggccattcttagtagtgagtgagggagacaatctaataatcttctttttaaaaattacttaaagaatgaatgaatgaatttatttaaaagtacatgcagtaaaattctctctttgttgtgttctataggttccaaaaaatgtagtcatgtatttatcaccatagtcataatacagaacagttacattaactcaaaaaattccctcaaagatactgattttttagacagtagacaatgcatttgctaaagtttttaaaccctgtttataggttaaagactcagtctctgagaaaacaattggactgatgcgaatgcagttttggaaaaaaactgtggaagatatatactgtgacaatccaccacatcagcctgtggccattgaactatggaaggtaaaaaaaaaaaaataccacttttaatttgtatgaatattattcgagtctactttttgatggatataatttgggtactggtgattatagtggaatctattctgaaaatattcttaggcttatgtattcagagctgttatagttttggcacagaaatttaaaatcacccactgataatttacacacatcttttgtatatttgtttattaaaggaaaaaggaagaattagtctctacataataacttgtattttccacatttccatatttgcctgcagaatttaaatcctacacattttgatataatagcaagtaaaatgttctgttctctctgcctagcagcagctccttataccagtgttttaatccaggttttgggcataccagtgttttaatccaggttctgggctgtagaacatgtattaatcttttgtgatgggagacttgctctcagtgttgtccagatacaaatctaaaactgccttgtctagtttgatagaatta

SEQ ID NO: 130617 - DNA, 1032 bp, Homo sapiens
caagtgtctgggcactaggtgagctctttcctactggagtgtctttacttgctaaggtaacaatttaccatgtggattatttttgttggagttttagttactctatttttcgaggagtggttatttttgctaaatagaatctttatcctgtggaaaacaatttgcgtataatgagtaagtatagaagtcagggtggctaggcacagtggctcatgcctataataccagcactttgggaggttgaggcaggaagataatttgaacacagaagttcaagaccagcaacatagggagaccctgtctctacaatttaaaaaaataaaaaagtcagggtatatcacttaatagagaagctcagtacttaatgcttaattctggttttgttttgtttgaaagtggaattgttaaattattagcagtataggaaaaaaagacaagttagtagaaaagtattagaagtatagtcttataaatgttttgaaatattttctagggacattttctttttccctgatacttctttaacatagctgtctatatggtgatgttattacaaatgttcccttacttagttttgtatttggtttgttcattttattcagatctacagaagtcatttctagtactttctaaaaacttataatgctctttgttttttaggctgttaaaagacataatctgactaaaagatggcttatgaaaatcgtcgatgaaagagtgagtcaaaattgttcaagtcttaagttttttcttcctgtttaattcttaagctaattcttcaagaaggacattttttgactgtatattaatattttggaggaaggaaacttttagagaattatgccattttattcatactttacccttgcatgctaccccccataccctcacattgagacagacaagcaccaaggcagaggcatgtgtatgcacaaccacactccactattttggttttttcaaaaggaaattttcatacttacataaaagtagagagactactctacatgtgtagagtatctggtgacatgt

SEQ ID NO: 130618 - DNA, 1339 bp, Homo sapiens
taaaaggagaaagggccatttattaggaggaaagagaaggaaagaatgttcagaggaatagaactgagagccagtgtcttgaaaatcaagggaggagaagatttaagaaagaggagtatcagagttttacatgctacagagagattgaagagaaaagatagatgtggtgattagtaaatcatggatgatcatagagtaatttcagtagatggttgggggtcaaactggagtataatgggttaagaagtaagtcaggaagtagagggcttttcctggtgttagggacaatataaatgaagacatggagacaggagtgggcttggcgaacacaggatgatgggcatcagcctgagtgaccaggtgttcgtagctcagagtggtagggagttaggttggatggacgaggttagagtcaagatgtggaggcctttgaattccaggatgaattgttgaaacttgacctatcagggaattaaagaaggtaaaaatgaaatgatgatgtgaggacattaatttgtccggctgcgtggaacgaattaaaggtcagggaacacaggcaagatcacctaggagggtcttactcatttaaacaggagagaaagtcagtctaagctaggggtgcacaggacttggtaatgcaagtatttcttcattttccccttaccacagagctggggagtcaaaattattatgagatattgtaaggtcgctggaaaatgctaaagccaatctgtaagaaaggatggaatttttactacagtagttactttttcctgagtcctttaggcctaggaaactaatcttaatctgcaggagatgagctgttttcttgcatttgagagaggccctatcagtattgttaaactgctggtgttgctttcagagggagagtgtttatttgcttaattttgaacgagcttcctctcctcttcctttttaggctaggtcctttcacaaaactgttcctgtgaaagcatttcctgcttttcttcagacggtaagtagattaacagagaaggctgtataattagtgaagcagatgtgtatgatctgtttttatattttataaagttcccaatgaacttctttagttcggagcctttgtttttgtttccctccctcatggcggctttcattagttactgatgcttttgctgagggccatttctgtatttctcagaggcaggtgagctgagtttttagcacggactttgcagccagattgcattggcttgaatctgttttgccccttactagcaatgggaccttaaattccttaagaaccacattcctcagtttactcttaggtgaaatgggaataataggagaaactactttg

SEQ ID NO: 130619 - DNA, 1050 bp, Homo sapiens
gaattctttttattgtttaagtcagcgtaagttgggttttctgttgatttcaaccaaggcttctaactaatagtgtcaacacaataatccagtcacacagagtcactttcagttctcttaaatacatgtactttttacttcaaaatatggttaaactcagccttcaatgtggttaggctgggcacagtggctcacacctgtaattccagcactttggaaggccgaggcaggaggatcacttgagtgcagaaattcaagactagcctgagcaacacagcaagaccccgtctctaaaaaaaagaaaaattagctggttgtgttggcattcacctgtagtcccagctacttggggggctgaggtgggaggatcgcttgagcccagggggttgaggctgcagtgagccatgatcgcaccactgcactccagcctggatgacagagcaagatcctatctcaaacaaaacaaaacaaaaaagtagcgagtacagtcacttgtaaaaagcatgatccaggccccagtgatcatggctgaagaacaaatcaccatctgcggcatctagaaaaaaaaaaaaaaactttaaaaactgagaatattccagctgttgagcattccttaagtgttggcttgtagacatctgtcacttttgtttgttcgtttttttggttttgttttgttttgttttgttttgagatggagtttcgctctttcgcccaggctggagtgcagtggcgcgatcttggctcactgcaacctccgcctccccggttcaagcgattcttccgcctcagcctcccgaatagctgggattacagacacgtgccaccacccccggctaatttgtgtgtttttggtagagacgggttttcaccatgttggtcaggctgttctctaactgctgacctcaggggatccacccgcctcagccttccaaagtgctgagattacaggcgtgagccaccgcgcccggcggacatgtgtcattttagggcacctgcctgaacaagtgagcagctctcacactctgaggtcacaccttctctcaaaactat

SEQ ID NO: 130620 - DNA, 3105 bp, Homo sapiens
atggtttatttatttggagccttttcaagttttatgatcctttgacgaatttatttttctttttaaaaatgtgattgaaggccgagagcgcgctgccggtgttgcttgaatagccttgtgtgctctccgtacattccagcaataacttgagtgtgcggtggaagtgggtatgaaggttacagacacctaagccctcctcggtaattcatagactcacaaaacgcgttgttgataaatgccttctttgtcgtgttgtgtagtacgttgctgaagagactcattaaagaaagatttagacagaaactttgagagtcttaaaggcatgtgttctcttaagaataagaagtgatcttgacagtttgaagtttttttcccctccctttagtttcttaagggtgaatgcctaccgcgttttgagcatttactttttttaaatactctggcagctcgtggggtcttcacgttaattcagtattaacgaaggcttcattataatctctttgggtcccgaccacacggggaatgaatggtattaagctatttatttggaaagcacacgtaatcggcctctaaataaaactagtatagtgactaagcttcagaagaaaatattcagcctcagtaaatgaatctaaatgatttttaaataaagacatcttgctttaaaattctgttaaatgaactgaaaaggctcttaaacacaaatacagtaagccctaaaaccccaaattcttggagaattttactttttagatctaaaaatacagcttctgctcatatttgattgtcaatttctttttccttttttctctttttccttccttccttttccttttcctagacagggtctctgtctgtcgcccaggctggagtgcagtggtgtcatctccgctcactgcagcctcaaactcccggggcccaggtgatccacctcggcctcctgagtagttaggactacaggagcgcatcaccacacctggctaatttttgtttgaattttgtggagagaaggttttgccatgttgctcaggctgtattgccaatttctgttgttcttaaaaattcttttagttttgcttcattgtcaagtaaatggcattataacattttttatttagaaatgaaattaactaatttcacaaatgtagcagccaaactggtatttaactgagatcttatgactctgaagccttttcatttttcctgtagcataactttgtaggatacataactcagtcttctggagcaatctgtccatctcgtttgctcttatcactgctctgacttgaatttagttcttcagtataaatacttatttcccagcgagctgatttacaggtgatccttgtgatgaaattttttccttaaaaatacttaagcctatactctttgaagccttttctgctctgttctctcattccactcccttgccctctccagaaatcaattaatttctcccatggtattactgtaaatatcgcatagattctgtcatgacatctccttgacagcaggcaacacatcgggtctgatttgcctcttcattccctgcatgccaagaacatagcagatgctcaggaaaggtttgaatggatgagtacacgtatgtttgttccttgtaaatatgcttcatgaatttcttttgaaattgtaaattccatgagcatcatagttaaatcttctttgtagtctttttcccaatacatgccatcaactccattaaatccacagattggtttttattatatatacacacacacacacacacacacacacacacacacacacacatgttttgttgttgttttgttgagaatttaacttagtacctgagtgaattttcgcctgggggtacagaacttgaatatttatgaaatttctaagtagataatggattaaagtataattactgatgtatgagagagaagccatggatcatcaaaaggattataatcataattttaagtgtgattgaatgtatttgaacttgatggaaatattgttaatgcttgaaaaatttaaaggtcatatttatacatttaagctcttggaacaaatctcattatagctctatcaattattgttttgccggaattgtcttagaatttttagaatgccctgcttaatagaaagtatatgaaaaatttttttgttgttgtttatctttgatgaaccagctttgtacatgagctgcctgcttaatatttaaaagcaatgtatgtgttgacttaactgaataaaaaatacttcatggatacactttcacagtgctgttttaagttggaaaacctctctaggttaaggtgttttgtaattctataatgcctatagaattcggggtttatttcctgcccccacccaagataactttctcccctgtcaaactgtaaaccacaaactaatgtgctcaatttagggaggtcctgagaagagaataaaaggcattcaaatagttgctgtgaatgcactggaaagaaagcaagttgcatgtaggatggactggaacaaataaaccttgtcctgactcagctccttgctggcttgtgactcttgaacaagccgcttcacttctgtaagcttcactggactcatttgtgaaatgggcacagaaatatttgcctcagtgttagcgtgagggtcacccaagattcgatgtttgtggaagggcctggaatacgatagtagctattattttaacaaatgaacagagtggcagtgaattatatagaatcatagaatttaaaaatttttaaagggaagcagcctgtaggaatacctagttcagttttcagccttggctgcacattaaaatctcctgaagagctacttaaaaagaatattgcctggatcccaccccaggacaaataaatcagaattactgggtttggggacagaacaaaggtaattttgcctctttgttaaaacatccccgattttagtgttcagtcaggtggagaacctttgatttaactcaatttcccatctcctttcttatgcttttcattttgtagttgagtaaaatgcagaggggttagctgccagccagattcctatcagtcaggctagaaaggatgtattaaatatttgcagctgaggaaagtgaag

SEQ ID NO: 130621 - DNA, 3976 bp, Homo sapiens
cttttttcccttaaattttcctcctgctttctaaactaggggttccccaaagtttagtcctctgctctcgtttttcttccagcatcagccagcatctctaggtgggtgactaccaaatctctctgtcctggagctccctgcccatcctggcatctctgtcccgcagatgtgtttgtcttgtggatgccctggaggacttcaagataaacatgtcccaaactgatttcttctctctcctaaaacaaagctagcatctgcccagtggcttacccttaagcctttgaagtcatcttacagtcctttttcatccatgtgttcagttatttcctaaatcctatctgctatgcctcagttatctgccaattattgtggttcaggcttttcttacctttcatttagagattgttgtaatcctcatatgactggtttctttgtcttcagtcttgcttcttcatattctcttcagtccatcccgtgtactgcttctgtgtctgattaatattttcctatttaaaaacctttgtcttcccatggcctgtgtaataaagtgtaaactcttctatctgatggttgctttcttttgcagtttgtctcatccctatcttaccagacttcttatcactatgccttctcctgaccttgcctcctctggcctaggctccattatttcctctctgggggaatagtcttgtgtaccatcatccatccccaaaccccagatagtttgagctactacttttgctttaaggcccagcttgaatttctggtccttacaagacctgttcctagatgttctacctggtcaaaattacatcccacctcaactccttggccctgggacctttaccactgttttttttgttttgttttggtttgttttaagttaaaaagtttttggcttgtttttcctctgctgttttagactttgcacagatttaagttaattgtatacctcagtttatagcacattatagggataccaaaccccttccttgttttgtttttttccttctttgtcagttactcccatgataatctttcctatagaaacacaactgaattatatatacttgtctatataaatatgagaatatagctgtctttctcttcctcagaggttttcagttttgagtatcttctgtcctttaatactgctttgcacagagcaagtgataataaatgtttgactacttgaaattcattaaaaattaatggttttatttgcttttgaattaatcacttagactaaaaccctggagattaattttagctttactcttctatatccagtctgcaattctgaatctgacctatcctttattttcctattgtaagcttcagactcttcatcaactttcccctctatttttgcagttacttttcaactggatcctgttttcagtctcttccttctcaatttatctttcgttgtttctatagttatctaagaaaaatccagatcagatcaggccactccttccaaaagtttcagaaggaagtcttagatattaacaagattttgtgttatttttccccccttttcccactaaataactcccctacagcctctgctgcagctgtacagtgtaacttttttttttcttttgagagggagtcttgctctgtggttcaggctggagtgcagtggcacgatcttggctcactgcaacctctgccttctggtttcaagcaactctcttgcctcagcctcccaagtagctgggactacaggtgcatgccaccacacttgactaatttttgtgttttgttttttttttttttttggtagagacggggtttcactgttggccaggctggtatcgaactcctgacctcaagtgatctggttgcctcggccttctaaaatgttggggttacaggcttgagccactgcaccttgcccagtgtgactttttatgtgcgtttttacttgcaaagctttgtgcctttatttagccatttttttgccttcttaaattccgctcattcttcacaacctgttttcagtgttcaaatgctgtattctctgtgccatgccctcactctttgctttttttgcttccttactactttgctaatgtttttagtatagtacttatctccttgtgttttgtattaaccttgtggcgtatatcttatttcctagtgtctgctttgttctttttttccaccaaacataaaccttgaatgtagtgagcaggttgtaactgttttgaatgatactaaagaaaattggtcagggatgtcacaggataactaattcctcagtagtgttttagttgagctttaccaggtttatttttcagatattatttaattaattaatttttttcttgagacaggttctggctctgtggtccaggctgcagtgcagtggtgcagtcatgattcactgcagcgttggccccccaggctcaagctgtcctcccgcctcagcctcccgagtagctgggaccacaagtgcacaccgccacacctggctaatttatgtaattttggtagaaatggggtttcaccatgttgtccaggctggtcttgaactcctggtctcaagggatctgcctgccacggcctcccaaagtgctggattacaggcttgtgccattatgcccaagctattttttagatattatccaatgctttctttacagctgtcagcactgtacagctgcccctgtacaaatacttttagaaatgatgtgagtttttgaatctgagttttgtgatgatgaaaatatgcacgtaatcatcattttttatttactaactaaacagctgtgctttttggagaaagaaatcatttatatatattaccatgagattgaaattttttaaaaaacaggatctgccttgctcaatacttagaatttttaattacatactgtacttaaatgggccacaacatttgcttgtaaatttaaaatctgtgggtccagtgaagcagttgatgggtagggtgtggttcctgttttctgtgaaaattaatatagatgttaaaaatgaagtctttgattttcatcaaactcaagattgggagctgctgccacttctaactgctgattgtattcagttcagtgcacattggcacattgatgccatttatgcaagcatttttttttaggtgctgttgcaaatacaaagttggaggaaataatctttttttttttttttcttttttttgagatggagtctcgctctgtcgcccaggctggagtgcagtggcactatctcggctcactgcaagctccgcctcctgggttcgcgccattctcctgcctcagcctcccaagtagctgggactccaggcgcccgctaccgtgcccggctaattttttgtattttcagtagagacaggctttcaccatgttagccaggatggtttcgatctcctgaccttgtgatccgcccgcctcggcctcccaaagtgctgggattacaggcgtgggacaccgcgcccggcctggaaataatctttttttaaggaacctccacatctgttgggaatgagcaagtacacacatttttatgaaacaaatagactataagtgctataaagtggtgcaaataaaatggtgtgaggattcacctggccacaggatatacccagccacaatatttggctgtgaggctatcgaactgagtgtgtcttgaagaattggtgagatttcagtaaatagagaagaacaaaggagggaggacatgccgagcttagaggtagggaaagaagcccagagcatattctggtaatagctagtagtctggtttgactataacagagaatgtagagaaagaggtaaaactggaaagatagattgcagcaggttaggacttgactgtgaagggctttgaataccaagttaaggattttagatttgattctgttggccaaggaatctggtttctgagtagacttacctgattatagctatagttaaagaatattaatcttgccttgtgtaggatgatttgaatcaaa

SEQ ID NO: 130622 - DNA, 1532 bp, Homo sapiens
tttttaaagaaaaataccatatgtaggacaagatgaaatggatactgtcattgtgctgcttggtaaattggtgttacttccagaatggaaattttgtaaaaggtagcaagattctttattcatgccttttgagccagtaattttatttacttcttgaaatttgttctatgaagccatttctgcaaggggacgggaaagctttctcttagttcttcctatatacactggtattctttcccaagaaaagtagacattaatcaaattgggccatgtttatagctctcttctgcttcctcccctcaatgagtaggatatgggaaggactcagtccttggctaggccctgtaatcttgtgttctaaccctctcacaaaagtgtagcattcttactgcttggggcacctcagtgtgctggaggtaaatttagatttgggcttaaggggaagggagaggccttgcttaggccctgaaccaaatggtagtgccctaatccagtttaccaaagaacattatttggggtatctagctgtaacccagataaaagtggtactttgatttcccttttgataacctctctccactcctttctttccttgctgcctcctgtttccctaccaccattctctctttctctctcttatatgtgtttgtgtgtgtgtgcagggcagcatttatgtattcctgggttttttagttcattgcttaccatcttttttatgtctgacacatacagaaaatattcaggaccaaaaaggataatggaagaggctgcttaaggccaaaggccttaggttttgtgcatgcccatagtttttcagatatatgtcacaacccaccaatcaatcaagtgggctgccagaatcattaaaataaatgaagataaaagaatgcatcattcattgttgaaataattatacgagtgtttgtaaccttgcaatataaaatgtgtttatgttggtcattgtcaaactttgaaagctatttgctttgctgcagccaaatactaattaataatgccccaaaccttgcttaagttgcatcattattaaacagggagaaagatttatgaacaaagatttagacttaatatattgaaacatttggacaatgaaagattatcaagacaccagctgggtaaatcatgacatatccatcctttcaggtgatttgttcaaggtagtattcccttatcttcagtatttttagggtttgcaatgaaggtccagaggttagttaatagcttccttagagttcttgtagattcagtggagttcttaggaacaattagtgtaccataacatactgtaacatcacagagaaatcagatttgaggcttgttctgctgtgacagccttgggcaagttatttaacccctctttggctgtttactcatccataaaatggagctaatagtgcatgtatcataaggttgctgtgaggaggaaatacagtaataagtgcaaagtgctcagcacattggttggactccctatgagtagagttcattccaggttaagttttgcttttacatta

SEQ ID NO: 130623 - DNA, 3985 bp, Homo sapiens
ctacatcctacttttgtggaggacaagagggctttataaggacccaagatttgcagggagacagaattcagaaataaccagaattctagtgtcctttataatgaaggccaagaagggctatagtgtcagtttttgagctgaatactggaacttacatactatgctgttagtctttaaactttaaatggtcttcttctcaaggcttgttgttctttaatatgacttggttatagtatagtagtattagtttagtaggtttgaaataggatacaactctgggacttgagtgaagtcaatattggacttagagattaaatgtttagattaatagggtgttttgcacattgttaaaatgttattaacattttttagtaccttttctgtgtcaaaccgtatcagtttcaaacaaaactatcagatgatctctgctttttaggttctgcatggtctctggaggaacagatttcagtcctttggtaaaagtgaagctagaatatacatggaatatggatagctcacaggaagggttttagtctagcatgggagtttaaaggaggcttcctggaggagacacgattacctaaactaagtctcgaaggatgaatatgagttagctgcagtagtaagtagtaaaaggaacaacagtgaaatggactacaagtagtagagtgttcttagaatatgacatttgaggtgaagactgacttatggtgaggttggagtgacaagaaccaagtaatgaaaggccgtgaacaccctgtatttaataggttaagggatcattttgagcaatgatggggtcaaattagggttttagagatcactgcccaaagattgatttgggggcaagattgaaggccaggacacatgttgggaaacagttctagtaatccaggtgagagaattaaggctgtagctcagtggtaatagcttacttggaaaattgtagtcatttttcttagtttatgtaacattttgttccctattgttcagaatcccattgagattacatttcattgaatggggtttattattttgcagagataagttatgttaattatccaatcgtctttcattcaattatgtctgtaggaagtttatacttttacaaatacctgcttaactagtatggtgctacgtggagatgataaataagtgtttttcatcattttaaaaattgagaaatgttagcccttttgatgtgcttagtgattatcttagagggaaagaattttagaacattttgcctttgtgtaaaagcaatgatttgttagcttaatttatatataattaacttataggaatttataatttatatgtgctaatttctttttcttttttttaaaaggctattagtgaaagatggtggatcgcttggcaaacagtgaagcaaatactagacgtataagtatagtggaaaactgttttggagcagctggtcaacctttaactatacctggacgagttcttattggagaaggagtattgactaagttgtgcaggaaaaagcccaaagcaaggcagtttttcttgtttaatgatattcttgtatatggcaatattgtcatccagaagaaaaaatataacaaacaacatattattcccctggaaaatgtcactattgattccatcaaagatgagggagacttaaggaatggatggctaatcaagacaccaactaaatcttttgcagtttatgctgccactgctacggagaaatcagaatggatgaatcatataaataaatgtgttactgatttactctccaaaagtgggaagacacccagtaatgaacatgctgctgtctgggttcctgactctgaggcaactgtatgtatgcgttgtcagaaagcaaaattcacacctgttaatcgtcgccaccattgccgcaaatgtggttttgttgtctgtgggccctgctctgaaaagagatttcttcttcccagccagtcctctaagcctgtgcggatttgtgacttctgctatgacctgctttctgctggggacatggccacatgccagcctgctagatcagactcttacagccagtcattgaagtctcctttaaatgatatgtctgatgatgatgacgatgatgatagcagtgactaaggacacatttgggagtatttaatcaggtgtggctatctgagaaatcaactttgggggaaatgtaagattctgagctctctctctgttttgttctagccatgaatttgcctgagaaacttgtaacctatgtgcctcaatatattccatagaaagtaggtccccctgccttctcccactcctcacactcttctacagggataggcttttgcaaatatatcagataaattttttgtttcttgtttatttttaggttattttcttggaaggttgggaaaagatgtttgttttaacaggtcatgtactacgttgttgttttcatttctgttataagtaaaactaaaagcacagaatggtgggaaaggggctataatgtggttcattaataatgttagcagcttttttctaaccatcctgtctaatggttaagacaccagtaacaaaaacacatgatttggaaatactttggctttttcatatacctagtggtgccttatcataatagcactgttacatgaaataagcccctaccttcttactttctggtttgttgaaaaaatacactggtgctctttgaagtgataaaatgagtgtttatgaatgggtgtaattaggaaatacttctcatctgacagctacaaataactaagtttggaggtattttcactctatatgaataaatatttttccataaaatagttgtgattatatttttgttttatataggtcccaaattataattgtcaaatatatattttaaattaataaaagttgtcattcttaggaatttggtttgaaatttatcagttatacagaattgtcatactgcattagcttctacctttagtaagacatattttttaggtataaattcttatgctttaacattatttctggattgaaaatcttataaaacccttgaaaataaacagtctcttttttacaaagcctgtgttagagcacagatttacctaggcttgaagatttggaagaaataatatgtaagaatggcctcaaggcagaccactttaagtttggctagacttcatatcgtggaagtattgtctatttcagtgtgaaactatcttgaatttgcaaatatagtgttatattttataaagttttgtaaaatcccaaacaatatttctatttttgtaaaacaattgtatgtataatctgtatttgaaatcattttgcaatctatggaaatagagtagcaattgctatttctaaattgtgaactttaagtcaatctagatttattttgagaagtaattgttcactctttacttttgaggcagccattaggttgaaagtatatatttatcatataaaacttgatgcgttttgcactactctttccatttatatgctgcaaacaactacagtctttgaaatatggaaaatcagcagtctaaagtttgttttaaattctaaatttaaaaaatcttcaaatctgaatataccgcaaatgtcatgagaagtttgattcagtaacttgtgatggaggattctttggtatcttactgtttggttaaggcactaattttacttacctattagattttgaaagtatctgagatatacaaatctccctgtaggaaatgtgaaagaaaagcacaacaaaactagggttttttgttcatttgcttgcttttatgattttttttggtttgttttaatatcaggtggatttttgtttctaagcaatatatacataaaatcaaccaacatatctgaaaaggatcatgaaacctgagaaatgctaatggagatttgctggtacataggaatctagcaaattcaggaaccaaggggaaatgttgtgagataacatttacattgtcaacctttattgactttgtttttacaataa

SEQ ID NO: 130624 - DNA, 1049 bp, Homo sapiens
accacaaacacatgagtaagcattgtgctatataggacagctatgatgtaactaggaataggaattatttagctccgttataattctataggaccactgttgtatatgtggtccgtcattgaccaaaacatcactggggcaaattaattatattgaataatagaagtgggagttaaaaaaaacattgttggagggttgtggtggtgccagcctacatcgaaggacaatgcccagaaggtagggctataggacaaaagtgaaattaggagtctggagaagccttatatgggaacaccaggcagccaacaggctaatataaatccactggaatgttacctactgttagagctataaagaagaattaatagtaattgaatcaccatgtgttgaggactctctgtacaaaaaaattagagatacaaactgcctgtagaggtagtgttgttgctgtcagtcctaaattgcctgtctcaactcagttgggacttgtctccgtcattttcagagccatgcctcctctattccaggcatctctcaagtcacccatgagccacagcagcagtttcccagttatcatccacttacatcttttctaatatcacccacatatagcattcaagataatatccctaaaatactattctgagtgcctctcctctattcagaagggaagtgagagttgccatttgtctcacattaactctaaactcactatttgctttaccaaattgttatccttgttgttcctcttctctctttagttccttcagctccaattaaagcctgggtcagatattccactgccactgggatgcttgtcattctgtactttccacttatgtttttctgtgtctgagtatatttacatttattccctatctggaacaacactcccttctaatgcatgtctcctgctgccttatctgtttaattcacacactgcagattgatttttctatttaaattttttcgattttttaaatccattgaatgcccatgtcctaaaccctgtgctagcttatcaataaaaggcaaaacactggccagta

SEQ ID NO: 130625 - DNA, 2196 bp, Homo sapiens
cttttctttcatgacttgccaccattttcctgcaaccacttttgctcataaataaaataagcactttttatcaacattttatagagtataaacttttttcttttaaatctaattcttttgattaaattcttgctgtatatactatatacttttaaaaggaaatttatttctatgtttgcattcatcagcaagataactgagtactggttgcttgcctatcaatgtgttcatatagtataattaaattgtagcaattaacagtgtgacaattatcagtttcagcatcaggcaagtggctggatggtattcgaaaatggtattacaatgctgcaggattcaataaactgggtaagcagctgtgctgtttaatgttttttgttgttgttgttgtttctttgtttttttttttgtttttctgagagtattgcttttgcaagtgttactgtggttccaaaaaccatttcagttcttgtatacatcagaagattttaaaattaaatcacattatgttaaatccagttcctttttaaagtttttttgagagaagagggatgaaagcctctaaaatgttcgacttggtaatgatttaagtagtaagacattttccttctacaccccctttcccaactcttccacttaaaattttatttatttatttatttatttatttgagacagagtcttgctctgtcaccaggctggagtgcagtggcgcaatcacggttcactgcaacctccgcctcccgagttcaagtgattctcctgcctcagcctcctgagtagctgggattacaggcgtgtgccaccacgcctggctaattttttttgtatgtagtagagacggggtttcaccatattaggctggtcgcaaactcctgacctcaggtgatccacctgcctcggcctcccaaagtgctgggattataggtgtgcactactgcgcccggccttccacttaaaattttaatttaaattatataaacattgaaagtagagagtttttgaatattaaaattttatcacgtccatgcaatcatatgattcctaagcttttttagaactttgtaatttaccatgaacttcatcttttactattgaagcttgaagaaagtgtaagcaaaagtcactgttccttagtatactatcattttaagattctttaataccttgatctcagatttaaactatgagaaaaaagagatgtggtttattaatgtgtgtttaaaaacaaagtaaacatttaaaatattttgtaaatggtttagataaaatatgaattttgtggcattggattttaagaggctcatatattgtttccatagtctagttcaagaagtaacccattatatcaagtaataactcattacttttaatggcaaaactgcaattacttttgcaccaacctataatgtatgaaatgcattgaatttccattgaacctagtgatttgaattcgatagttcaccaaaagttgtaagttataagtcataaaggtattttactaatttaaaaaaaccgcgatttttgagatgcatgtgcaatctaactttgtcatctatcatagggttaatgcgagatgatacaatatacgaggatgaagatgtaaaagaagccataagaagacttcctgagaacctttataatgacaggatgtttcgcattaagagggcactggacctgaacttgaagcatcagatcttgcctaaagagcagtggaccaaatatgaagaggtagcacagctttatctacctgacagtgttgctcattaaggatggagttttagaaacaagagaaacatgttcatttgcatagtgttagagttctctgagtcatgtcaaataaatatgtgaggttaataaagcaaatgttatttccgttttagaagaaaaccacattgagtcttacgtgtgaaatgattcttctgaaattactaagcaagtctctaatatagagagccaggactaaaatccaggtctgttgcctcccaggtctttgctgttccagctctgcactctgcttcctacttagatgaaaagatcagcccattgagtgtccctccagatcccaagaagagcttctgtgaagcaaactctcaccccttgaactgcattgaaactaggcaaaggcctgtggacattcatttctttttcttcccgaaaagacttccccctcataacctatcaaagcaacttatca

SEQ ID NO: 130626 - DNA, 1066 bp, Homo sapiens
caaccaagttggagtagcttaaaaaatgttgatccttttctccccgcccccagcaattgtgaagctgttaggaaacatcaggttgccagaaacatccgttaacctaattgacattgagctttttgggggtgggggagactttttaaataattattttattaatttggcagatattgaaggagtcttactaaattcaagacactgcttctgtgcgtgtttgggaactacatagaccagatctcaactcccattagctaactctgaccttgggtgggatcacttctgtaagccagcttccccttctgtagtaacagacatgtaaataaatcagctaatgttggtaaagcaaataggaaagtgtttggtgcacaataagtgcttagtgaatattattatagtcactgataggtggttgaatataatctgtcttccacaagtatgtttgtagattgttgactgatacttgtttttctagcagcagttttatacatgactcttaatttccaaggagatttgctaaagccacgtaatctgtagtgcactgagtttgcaagcaaggagagttgagtgaaaggagagtttgctttccttccttggtaagggctaaccctagacaaaattttaaaagagaatacaaacctgttctacctctccttttgtaaaatgtctctcctaaaatgtcagatacggtcctgctgtacttggaccctgctgggttacttcatcaggctcagccctgttccccaaacagttttaaaattacctatttctcatcctttttcaatatccattcccttggggggaacttagttgcttaggaggaggtaaatggacttcttttacgaatccatattaatgtttaaatgactaatggtatcaaaatcctccccaaaatacatacatttttaaagaatgtggccaaatgaaataactgtaatatcgagtaaaaattttagaggatgagggtcatttagacctgccagtctatgctgaaatctcactgtcttttccctacaactccagctctcttgaaatgaaaagtttacaattatttcctgtgatctat

SEQ ID NO: 130627 - DNA, 1040 bp, Homo sapiens
ttttctgttcttatcaaaaaaaaaaaaatcttaagcagaagctatttcattctttcttaccaagtaataaaccagattaattgaaaagagaatctaaaggttggtgcaaaagtaatcatgtttttgctattgaaagtaatggcaaaaaccgcaactaatacctattagtggatttcagaattattttctgtttttaagtataagtggaaaccatctagagttgggtgaatgcttgttttgttttaaacgtgtttttgccattgttacagaatgcttttatttagttagtaatttagggtgtgggagcctttttaaaaacagctgttactttgggaagtagcatgagactccatctcaaaaaaaaagaatgtaagtgtttatcacatgcgtatgtatttatgtttctctagggtggcttatctgcattcaaaaaatttcagtaaagcagatgttgcacagatggtcagaaaagcaccatttttgctgaacttttcagtggaaagactggataacagattgggattttttcagaaagaacttgaacttagtgtgaagaaggtaaagaaaaggagagaatttgtttatttccatgtcaggtacattttaatagctgatagatctcatgttcccagcagatgcctggcccatgtgaatcatataaattcctggtattttttgtacaaaaatgaattatcctgctagtttaaacatagagctccatcattttataatacttaatcaaactggttccttcagtttttgttttctttttttccaaacagtattaatcttatctattcctggggttcctatcatttttctgattgggtcatattttaagttttaactttgtatcttaataatgccttaattttccaaactagttaaagatgcacgtatagtaatactagattgttttgtttgcaaccacagactagagatctggtagttcgtctcccaaggctgctaactggaagtctggaacccgtgaaagaaaatatgaaggtaggacaactttaggctttttgagaaatcagttt

SEQ ID NO: 130628 - DNA, 1066 bp, Homo sapiens
tttatagctacacatataaaacatttgctttttaaatattttattgtttagattcttaaaacaaaattcttctagtggtaattagttttattagggtataattatatcaagtaaaattcatcttgtgggatatatagttctatgaattttgacatatgcatttagtgtgtaagaactactgcaatcaacaaataaaacaattatattaactccacagagttccctcatggtcgctttttagtcaatcctctccttcctatgggtcctattctaggaatatttcgctggtaatgaaatgatataaggttaagtagaatatgaaggaaagagagctggggagagggcagggaggagatgctggctataaatgatgagaaaggatagttaatgatgagaagcacaaaacagaacaaaagatcacagacctgattccttagcttaaggtaatgtgtagttctaagtgtcttccatgctgcgtttgattttaaaaaaacaaaaacaacttcagaatcagggctgtactagagagtcacatctcctgtagagaggactgcaggttgtagaaacaatcatagaagcccttttaaagatgtatttgagggtaacttggaagggagggcattgggtcaaaacaaagactttcgggatatgattactttaatccatgcaattcagactgttggcatatgtgtacttttagccaagttaacaggctatggtaaactcaatctctgtttcaaaattcacttgaaagttaggtgatttttagcattctcacctactgattaagtgaaggaaaggcattgtgtgctttgaaatttaccaacaaatttctaatctcagaggaacagtagttagtctgtctaaatagttgtaaccttacctcttaaaaggtgaaaaattagggacttggatgtttaattctaaaatgatcccaagatttaaccactgaaagaagcaaacaagggaagagctggtctttgcagaaatagttttaagtgtgcatattagagcactaatttgtttctctctttcaaagaactggatgaattgcctccattgtctc

SEQ ID NO: 130629 - DNA, 1048 bp, Homo sapiens
ggctaaatataaaatcccttcatattcctggagtttaacatagcactagcctttcctgataaaaatatttttgaaaactactttttcagtcaaaatatacaggtattaattgctggttgcttatttatttctgtcacttggttttgttactagttttgaccttttctttttgaaggcttttttctcctttcctacagtgaaacaaaacttgacaaaactggttttgttcaattccctttggaagaacagctttatctgtgaagtaatcaacagtgttcagccctgagaatgaagcaagaaactgctttcactgttctgtatatcaatgataatattttgatgatttgtttaggacacagtagatttctgttttttcattttgggacaaatttatatacataaaatgcatttgaataattcagtgttactttgatcagcaatgtgctgcggaaacacccttcacaccaaatttcaagaacacttatttgcatcagcttattctctttaaatgattaaattaacagattagtgaggtctgctgtcacttgaacatttgcagatttttgttttaagcatttttcttacaccagtgtcattgcattttgtttttaaattgtaaagtatatctttatttttccactcagaagttcctgtctgttggtttgtaactgagattgccttgttgttggcttttcctgtacataagaaacatctcactattttagactaaatatatatttaaacacctttcaattagaaaaaaataatttccagtttatctttttgttgtttgaataccgttttaaacatttaagtaaattaaatttctcttcttttgacggttatatctttcctttgtagactaagaaaaatggctttgtcagcccaacagatacccagatggtttaactcagttaagttgaggagcctcattaatgctgcacaactcacaaaacgttttactagaccagcaagaacactgttacatggcttttctgctcagcctcagatatcctctgacaattgctttctccagtggggatttaag

SEQ ID NO: 130630 - DNA, 1096 bp, Homo sapiens
ggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccaggtggggcggcccagccgagcggggggcgcgtccaagggctagggaagaggcgggagggagggtggcggggaggggggcccggcatggctctgggtgaggaagtgggctggctgctccacgcacacgcactggcagcccgccgcccacgcggcccctccgcccgcccggtgtctcacagtacgctagcctgctcccctacccctcagtgccccttctccatacagcgcctccggttacacggggaacgcacgcgagtcacctagcacgatcgccccctcacccaccgcactcagcatcgctccacacaacatcacgacgcgggcccctcctctgcactgctccagccttcgtccctacccagcacaccgcatgaatcatgtcgtatgcaccactttcagcacacaccgctacacatacaaagcaccccaatccacagcgcctgcaggcaccatacacaggcccaggacacaacctagatcccttcctgtggaactccggtattcggcactatccgtaacgcacaaaaaatgcacatgtgtgctgcatacacggtctttcctgtgcagcacttcccgtatgcattgcacacaagtcatccagcataacacttcccccagcctcaaacactaccatctgtaccacggcacaaactgccactctaaacacacacctcacagcggacctttcctttccagcacagcccaatacccatcatctgtgtacatggctgcacagacaccagcccgccacacatcacgcggtgcataccctgctcactcattacctaacatacgtgctgaaatgtgatcttgtccagcaattttaatggtgcctggggtatagtaactgctgtgtgtta

SEQ ID NO: 130631 - DNA, 1012 bp, Homo sapiens
gatgtcaattatgtgatgtcagtctgaatgaggacattgtgtgccctcagtgtgcagccattcttaagtaaaaactggtgttcctggaaattggatgttgagcctccctacctaagccagaaggcatcacaggtaccctagtaaagatcaggctggcattttgagggccacatttataacctctgggcagatattcagttgttaggtgtctattaaaagtgcacttcactggaaggtaaagtgtgtctgattatatagtctggttttataatcaggtctgtgaaattaacagtcagcattagtttgttagtgccgtttggacacataatgatctaagaattattgtatgatctgtataaatctcttatttcagaacctatgttcaatcctgtcatacatctggcagtcccccagtttttagaacatggaaatcttccttcctctaggttttctatttggatctgaaagtaaatgctcaatgttgtttttctattttcagggatgactctgttccagaagacaacatctggagaggcatcctctctgttattttcttctttcttatcatcagtgtgttagctttccccaatggtaagtaatgtcatgcattaccacatttctcctatattgtgcctttctggtttttttgagatgtgagtcatctagaagatgaagtaaagaaataatctgagttttgtgtagtggttaggggcacaggctctggaggcagactgcccattctgccacttcctagccccagagaagcctcctaagagtgctgagaatacttcagtttccttctataaaatggagagagcagacaggtacggttgtgagggttaactaaatgggtgcacgttaaacactatgaacatgactgacaaattataagctctcaataaatgtggttgtttttgttgctgtttttgttattatcagttgagtcataaaatactccattactgctgagttcttcctttttgctaaggacagggtcaatgctgtaatgagt

SEQ ID NO: 130632 - DNA, 1032 bp, Homo sapiens
ttggcagactggcttattcagcggctcagtgacctgtgaagacccagcttctttacccctttctgttctgccgtcttctaggctgcagtctgccctgctggccttgagacagctcctgcagtgccagccatgtagtggcaggcaatggccagcagatgaagagatcatctcttctcttgtgtctttacttgagtagagaccccttttctagcaatcctccagcacacttacatgtctttgactaggattgggccacatgtctcttctcaaccagttccaaggacagaaatttatagtgtttagaggagtaggtgttcaacagatatttgttggctagaagaatgacaggggactaggattacctctgctggtttagaatccacccctgagctatatggcagaggagtggacactcaaacaaaattttgtgtgacaatcaacagggtgagtggtaggattaggtcccagagttctttcattcagtcccataagcagatgtggagggagagggctggcagtgagagcaggggaaggagagggtctgatgtctgcatttacacttctctcctgccctcttcgcctcttcagttctcctcttcattctcttttggcttccttacaaaaatgttttaatggctaccttcatcccattatagcaactgacactcaagtgtatgtgtaattttaactataccaccctatcactggagtgaaatttagaaacctatttgagtctccagttggctggagatttctttcaacggtcgaccttctggtgtacatttcctgcttctgagaactccctttaactgttgttcatcccctttccaccttaccacgcccccaaaaccagcccagccttatctgtacttcaagtgcctggcccattattaacttctcatgaatatatgctgaattaaataataaatccacctggaaaaaagttcacagaacaagacctcttttttcccttttgttgtctgcaagagaaacaccattcagcccccctttttttttttttttttttgagac

SEQ ID NO: 130633 - DNA, 1050 bp, Homo sapiens
cagggcttcacagacctcgaagcccaaccaagaactccagattgagaatccctgcaccacagattctttctgtcctaatgtaattattcaagaggatcataattattaaaaagtgtagtggggggcgtttgtggtgaaaattggtaaaaaatgggtggtgcataagtgcaaactgaaggcaattctcatatcaacttgcctaaaaaatgtgcattccctgggccctaggatgcacaattatgggctggccacataccacccgggcctcccttgaactccctgaggccaggagaggggtgcctgttagaaggtctggcactatagcgcttgcagtggatttcattccagccacggacgtgctctcctctggagtggctcactggagattagtgctgagccaagtttggatggatgctgtgatccaaggtcatttgtatcacggtctctaaatgtcccgcataaacattctaattccaatgagttcaagggaaagagaaaccacaaaacccctcgtgatcgtttctgaaatctctctaaaacgtattggacagggttttgccttctaaaagtgcattgttaacatttctttttaaaatgacacatagtgattattaggatagcaattatgagatgatagaacaataaaataatgcctacacggggtaatgtggagtgtaagtctcaaaaaagtggccctgggccacctcttgaaccttacactggtagtactgtccacacccagccttgccctcctccagtccacttagttggctttttaaaatgttacctagatcatcttatttccccacttaacttacaatcatatctgaaatgttggccgtggcctttaagccctgatggtcacttcagggccgccttgctccattcccctctctgccagtgctctagccacatacggggtcctagatatttctcttttcggaaaccgacctgcatgctgttctctacctgaatgttgcgtgcaatcctcacacccaccccgcacaccctttgcctcatgatccttcaagtctcagtctaagttagcat

SEQ ID NO: 130634 - DNA, 1046 bp, Homo sapiens
tgggtcacggtggctgcccctgcacctgtcaatgtcactctcagcacctgcactctctggccttgatgccttgatcctgctccactgcttgccacagagaggccagtagtcatgaattagtttatttcatttgttactattatttttatcgaaccatacaaaaaaattttattcttggctaaaacgactctattttggcttttactgaagagactaattatgtgggaaaaaccaactatttttctcttcactgacggtgaacacttctgtgaccagatgtgtaggtttttcccacaccagccaattctctaactttcctgacacctggagttagcgtcagatcccactagttaagggcccagttccataagactgcccacatttcagatgccactcgcaagtccaggctgtcacctgtgcttctgaccaatcagctacaaatcaggggttcccacaatatcctccttgtgcacaatcatttgctatgatggctcacagaactcagggaaatatttaagtttgccggcttattgtaaaggacatgataaaggatacaggtgaatggccagatggagaggtacctagggtgaggtccagcagagtcctcagggcagaagcttctgtctctgtggtgttggggtacaccaccctcccagcatgtggatgtgttcactaacctggaaactctgaaccccagagttcagagatttttatggagactatcgcataggcatgatctttttttttgagacagagtctcactctgttgcctaggctggagtgcagtggcacaatctcggctcactgcagcctctgtctcccaggttcaagcgattatcctgcttcagcctcccgaatagctaggattacaggcgcctgccactacacccggctaacttttgtatttttagtagagacggtggtctcaccacgttggccaggctggtcgcaaactcctgatctcaaatgatctgcctgcttcggcctcctagagtgctgggattacaggcatgagccaccacgcttggcctttttttttttttttt

SEQ ID NO: 130635 - DNA, 1086 bp, Homo sapiens
acaatatcacactattttatactataatgtgttcttttccaatgttttttaatcccaacatttggtacaggttaatttttttctgaaaaggagaacgggaatttgggccatagatgggtttgctttgacaaacaagaagtaacacaaagggacttcataaaaggtccaagaaataatcattcccccatggtgacattggtcaaatccttcttagagtggtatttaaagattgttatctataaattttttaagggatatgcttaaagcaaaaataagaatgccagaaattatttatcagtcttgggggagaaagtctgttttggaatttttttactctaagggagagaatgacggaggttgacttcttagcctatgatgatgatgataatgcagatgacggttatgagaataagggcagttatttattatgaattgtctatgtcagacactgtgcagggctctttatattctacataagcctcgtgcatgcatgctagatgttcatatcaccattttacaggggaggagatggaagcttaaaatgcagtatctcactgaaaacacaagccgatggatctctctggcgtcaaaacctgtgcttttcatttggagtgtgctttcagtatatagttataaaaataagtgctttgatgctcacaggagccttaggaaatagaaattgggagaaagataccccaagtgtaatattttcccaaacatctttcttgcatttttgaacaaaagtggtcacattgcaaagtaaactgacttgcaggtggatgtgcttgtgtgcctctgctgatccagttctcacagccagtaggaggagattgaatcgaatgataatgctcttgacacctggctttcttaagaatttgacatcacagggacatccagatgtcaaagttacagccccaagtagctgaacctggcttttaaactctagttttcaagtattggctaaatctttcttgccaaagtaaagcacgaggctgtgttcagcctgtagagttctaactggtgctaaaacagcctcatcttctccatctctaatcccatccctttatacttctttaaattgtcttt

SEQ ID NO: 130636 - DNA, 1032 bp, Homo sapiens
attttgagaattatgacaatgctttgttgtcagggttggaaacttttctccttttcccctcccagatccttgtcatgttgtcattagccaaggtaattaattggtagtatttttcaagagagaccattctttctttaaaagccctgtgtcaaaaagagaagagctgtttggatatgtgctgtttgtttgcaaaccatctgcaatataaaaaacaagaaacagattgcagaacctgttactgttggttattttctgtacattaggaaaaaatgaaatgtcaacaacttcttctaaaataatgtattgttaaaaaggaaatctatctatctgcatggtaccccagttttgtttatttttccaaccatgggctcttgtgtttctcagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaagtgagttgccttctttttggatattagtcacagtttttcatgatatatatttaattgttttggtaggaatccattttagtatgatctttgatgataaggaataaattccatgttaataactgaaactcataaatgattataaacctgatttcaagcatttgtccagaaaatgctcaatcatttatgattttctctctctcaccctatgtattcagggggtcctaacaccatcctcctaattcaaaagatttctgaaatccacccccactcttttttatcccgactgcctcagccttcattcagactcccatccctggatcaattcatctctgtttccaggttaagtcctccagtccttcccacaccattgcttgagtgatctttttaagaacatcagattcatcatgtcattgccctgtgatggcttctcatggtctttggtcatggtcaatacatccattaccccagtagggagatcctttctctacaccctccc

SEQ ID NO: 130637 - DNA, 1045 bp, Homo sapiens
gcagttttacgtgggagacaagcagtgggagaacagtctccttgctgccctgtgcctgtcatcaatgagattcctcattgagtgtgcttctgtcacctgctttacctgtatagagagacctttgagacacaattcaaataaaaagcagtctctttgtcctgagcatttattataaaaatcatcagtgcacaggatttttttcttgtgctttgttttccccctgccttatctctggattttcactggagccattctcttcttacagggacattcataccaccaccgggaagatcaagagagctgttctgcagttcactcctgctagctggacctatgttcgatggtttgaccccaaatcttcttttcagagagtagctggagtgtaccttttcatgatcatctggcaggtattttttcagatgcccagaagttgggaggaaaacaaaaactaaaataaaaactttttaggaatttagagttaacattagtttacattgcttttcagctccatactttacaagatataatattctgcagctggcatgtagaataattaagcaaagtgatgttgttatgcctaaggtcttgcctcattttgaagacagttttaaaatatggatctttgaattacaaattagaaacagattagattccgtgaaataatttgtgtctagcatccatcatccaatgagttaggcattggattgctttttagaatgatcattttcaagaccaaaggaacaaatgagaaggcttttcttacattcctaattcagtgtttattggttaaaattgttcctcagctgttaccactttggttaatctgtagggtgctaaatgagtgctggggaattggagccttttgctgagtcctccagagtgttgtcctccgtggagagaagctgtatttccaagtggcccacttcacgacggaagtgattctgacagcccagggtcttggcaaaagattatcaagcatctgtgtttctgagagacagcaattttttctgatgctcctggccccaggttgtttcacaacttttgg

SEQ ID NO: 130638 - DNA, 1876 bp, Homo sapiens
tttagtggttttttttttttttttttttttttttttttaggctagtcaagtgaagcagtgggagtggaaaaggaacaaagaaatctgtaaatggttgcgatcagttagttgtaaacaccccggcactcagaccagacaagaatctggctctttaaatgatgctcccctgcctccagcctaacccaaacgctgaatctcttacaggaatgttttaacaggcactggctttctcttctcttgaacagaactagaccaggcagcctgacatgggacaaggagggacgttttttactttgtcaaagtgatttaattatgtgctgacttgctggtcttccagcagctctcaatgaattccaactttgttctttcagacagtactacgcttacctcaccgacacacagtgcaagcgcgtaggaacacaatgctgggtgtttgggtgagtaatctgttattgtggagatttaaaaaccacttaagccctaattttatttgggtatttcttgaccctgtgttaagagcctttcagtataatttttctatgaagacaggtggactagattttatatatctatatctatatctatatatacatagatatatcttttcatctttaatattcccttttctgatttaagttaagaatagttacttggcaaattataaaacaagagtatagaaatggctctcttattttggccgggtgcagtggctcatgcctgtaatcctatcactttgggagcccgaggtgggcggatcacttgagcccaggaattcgagactaacctggtcaacatggcgaaaccctgtctctactaaaagtacaaaaattagctggttgaggctgaggcaggagaatcgcttgaacccgggaggctgaggtttcagtgagccaaagtcacgccactgcactgcactccagcctgggcgatagagtgagactccatgttaaaaaacaaacagacaaaaagaaatggatctctctctttttttttttttttgagatggagtctcactctgtcccaggctggagggcagtggcatgatctcggctcactgcaacctctgccttctgggctcaagtgattctcctgcctcagcctcccaagtagctgggattacaggtgcgcaccaccacaccctactaagttttgtattttcagtagagacggggtttcaccgtgttggtcaggctggtttctaactctgacctcatgatctgacccccttggcctcccaaagtgctgggattacaggcatgagccaccgcacccggccttggctctctttttttttttttaaataaattaggaaatcagatggtatttcccacaaacaactctgagactttgttttatgaaatacattagagagaaaatggattggttgcattccttctggatgtatcttgagtttggaatgccatcctgtcatgggctgacccacaccccatattattgtcacatcaaaagggccccttggaacagctgcttgctatatactgaagtataattttattgttccaaagagtactaacatacagcagcatggtcacaatggtcttgttatggattcaaatgttatatctttttttttttctttttgagacggagtgttctgtcgccaggctggagtacagtggcgtgatctcggctcactgcaacctccgcctcccaggttcaagcgattctcctgcctcagtcccccaagtagctgggactacaggcgcgtgccaccacacccagctaatttttgtatttttagtagagatggggtttcaccatgttggccaggatggtctcgatttcttgaacctcgtgatccacccaccttctgcctcccaaagtgctgggattacaggcttgagccactgcgccc

SEQ ID NO: 130639 - DNA, 1319 bp, Homo sapiens
ttgaagttattattttgaagaaaagttcttattttatatttaagcttaagatttttcacttagtctagaaaatgtattgggctttttaaataatcatagaaaatttcagacatgtgcaaatagagaggatagatggcccctcatgaacccatcatcggttatcaactcagggccaattgtgtttcctcttatgttgtactcactgccccaaccctaacttattttgaaacagatccacctttaatatttcaggatggatcactaaaagaagctcaggatactttttcggtttaatgcaaccaccctaccattatcatatctaaaaaagaattaacagtaattccttaatatcatcaaatacctaatcagtgttcaaattactaaccttttcttaaaggttgtatttgtttaacaatatatttgaatccacattcacccatcgtgattggttggcatgccttttaagtctctgaatccataggttttcctctatcgctaaccctctttccctcgtaatttatcggttgaagaaagcagcccttttgtcctatagattttcccacagtctggattttactgattttatcgtatcttgtaatttaacatatttctttgtcctctgtattttctgtaagtcggtaattggatctagaggcttaatcacatttgggtctagtttttttcttttcttttctcttttttggcaagactaacctttgtatttttaacgtgtcttttatcgcctttaacgggatctatttttagggttacttgttagaaatcctaactgtaccaaggcacagtgagcctgttctgtcctgtttcatcttgaacaataaaagggaataatgatctcctttgtatttaaactacagaattaatgcccaagtatattttttcatgtcagtgagaccagatgtaaggaatcggttagggaaatgtgtcagacatgcccagagattttcactatgctcttctcagatatgtctctggcctgtgcacctcaagtctgaattgtaataggacctgactgcagggggcagaggtgggtgccctcttcaccgggtaccagagaaccacccgcccacagggagggtgagacaggcaggactcccaggacaagacagacagccctcctcaccacagcaaatcacaggcctcccagctgcctccccaccactgccccctgggcagcagtgaccagaaaggtcttctcaggccacctacccaggcagccctctctggtccctgtcttagtccattttctgttgctataacagaataccatgggcttggtaatttacagagaaattaaatca

SEQ ID NO: 130640 - DNA, 1024 bp, Homo sapiens
gcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctc

SEQ ID NO: 130641 - DNA, 1061 bp, Homo sapiens
aagaacggtttatgtatttttctccttaagtagcattgcattgagtgttaggttcttttccctttttttcattcttggtcttcccaaagcttcttcccacatttcgtttgtgtctgtttccaccattcatagaaaccttggaaccactctcacagcaatgctaggatgtttcatggacctgttaagcattttgatgatacaagacatcctatcaatgccagtcttattttcgctaggactctgcttccacagtaagctcctaaggtgctcacccaacccaggagaaaacaaaattcattaccaaatacaacaggttcagccttcttggtcttccctcagaagccaccgtgtagcaccctggaatgatgcctctttatgccaaggcccaccctttggaattgggagggttttgggtagaatcctgcacttacagaggcccttggggtcattgagaagtggaggaggttggacacagaaggggaggctaaacacaaggtggggaagaaaaaatgtaaccattggcagccagactgaagctagccctttaaaatacggggttggggggttaacatccgctctttggaatgtgctcagtgactgctgcagagttcctgggccaccctaatgtttaccaggtgggcgttgtttatatggttcttattgttatgacaactagaaatcccacagtagactagacagtgctccctaccatttcccatttataggattgaaatcaagatgtaaggagagctggccgggcgcagggctcacgcctgtaatcccagcactttgggaggctgaggtgggtggatcgcctgaggtcaggagtttgagaccagcctgaccaatatggtgaaaccctgtctctgctgaaaatacttaaattagccgggcatggtggcaggcacctgtagtcccagctactcgggagacagagacagaagaaatgcttgaacccaggaggtggaggttccagtgagccgagatcacgccaccgcactctctaacctgggcgacagagcgagactatctcaaaaaaaaaaaaaaaaaaaaaaaaaaac

SEQ ID NO: 130642 - DNA, 1090 bp, Homo sapiens
gtaggctataccacccaagtttgtatacattcactctatgatgtttcgcacaatggcaaaatcgcctaaagacacatttctcagaacatatcccatcattcagcagctcatgactgtgcagggctaggtcaatacaggatagctcttgctgatcctagcctgagtttgtccactaggctatgctgcctctcactcagatgaaagggaagagctcttggtggagacttctggaggactgtaaaggaacattgggcctgactgcaaagaactgaatgctgacctcatgcttcccagttttcatgggctgtgatgaacaggatggagtggcggtggcagactagagtgaggaagagcaatgaggggccactgagaaacctgcagatccaagggagaggcagggaagctggaagcaggggaaatgggaggccatgagcaaagagagaagaggctttggtgattctgccttatgtaagggtcggggtggggttggagaaaacactggtgacagtgaaactaagatgtcaaggaaaggcatgggtttacagggaaaagggctgagtctgttgtatttgaagttctggagaaacttcagcatctagccttctggtctgtgctggagagtggttactgctggaccagaggactcccctcacgttgagttactgaaagccatggtgggaaccgcggatggatgagaccaccgggcagaaaagccgagcagctcctgaacagtgaacctttgggatcaccacactgtgtttctcacaattcagtatcgctgcttctcagtggaggctctgctgcctccatgggagagcactggaaaatagaggggatgcttttgattgtcccagtggttgaaggatggtataggccttcgatagatatacagtgacacagggaaacaagatgttctgcaatgcacagggcagctctgcaaagtgaaaaatttctctggggtcctcttgatttgtaaatatctcattgggctttcatttaggtgaaaaatctattttgaagtctcttagcccagaacctaattacagtttccatatatacctatatattttacttcatttaaatttacatg

SEQ ID NO: 130643 - DNA, 1070 bp, Homo sapiens
taaaacacaagcagatagcttaatctacagtcttcacagagtgaaaaaaaatcggaccacatcattttctaattttgttattagaactctctcctccttacacaaagctgaaaaattccttaggatgatcatgtaaagtttccttgaaggatttcatattgtgcttctaaaacctatcttgtgcttattggaacaaaccagtaagctattccttcgcttgtttctctcttttaaaaggtctttttcatagagcaaattatgtctagatgctagaataggctctaattacttgtttgcttttcatctaagactcacaggctcctggtgggtggaatgagtcacactggaccaagtgtatgacccctatccttgctgactatgaggctaaggaagagacagcagaagggaggaaagacgacaacagcatctcaaaaacaaaagagcaagagatgatggtgacaacagggattaggaagttacatgtcaaaatgcacagcaaacagaaataaacagggcagtgaaaaacacacctgggccaggctttgagcaccagaggctcatgtctaccacagatggcccacctgaggggaacatcaatggaataaaggctggacaaaggtgagatggcgccgagctaggctagatttgaaagcagagtcaggaaaataatagatactggaaatcaagaaatcagggcattgaatgatgacaggagagcatgacttcctggagctggagacatttctaagcagttggcctcctatagatttcctatgaggtgtatcctggatcttctagaagatatctgataattagataccagggtaaaatggaactagtgaacatattaatgtcctttttttttaatgtatttttctggtcgtaaaagtagaacatactgatgcaaagtgtaaaggcaaaaataatcaaatcctatcaccaagggaacttattaagagtctttttggggattccctgttcaataaatgatgctgggatagctggctagccatatgcagaagtatgaaactctggaccacaacttttcaccatatacaaaaattaactca

SEQ ID NO: 130644 - DNA, 1033 bp, Homo sapiens
tgtattatgaaaggcaggctctggaaagtttgcattagaagggtaactaaaatcgaaatcatgtaactttgcagttctttagaaaatatagtttggctgttttatgagtgaaacaaattgcttttgctagggaattttataaaaacaagggctctttctctcttagttgggtattagcagaaggaggatgtcatttaagaaggaaagatcttgaaagatcaggcttgcagaaaatggatgtctgagaagcaatttgagcatgcccttcagcttctgcttttaggacctgatatgtctagttttgatggtaaccacccttcgaggggtagcctaccctgtgtaatatgatcacttaaatggcgccttggataatcattagtttggaaaggatttcaaaaggtgaactggtttgttccctgggtggaactagttttcaagtctccaaaagcccccagagacctgactggccagctagaggtggcttggagtctccttaggttggcaaggcccctgaagctgacccagtcacacagagccccaccagccctgtcattaaggtttatagcaagtccagtcaagccactgtgctgttggcatacctgctggtggggatccagttgtcctgtgaggaatgccatctgggtttagattctcactagattgtccttcttccattgccaaaaatcaaactaaaagattttgcccatccttttcttcttcccaaggcagaagggtgcattgcagaatctccaaaccactgaattcttttcgtggactagaggccaaaataaagtcttagagaaaagccagaagtaatgaagaagaatctttgctaaaaccaatctactcttatttaacttttttagtcaactgtgacagtactatcattttcattctaatcatttggatttaaatcttgaagaagccctggactcattcatctttgttggtttccacgtccagtctgcctctaagtccagctgtgcattcattctgcagatatttatttcatacctactaggtgcttgaggta

SEQ ID NO: 130645 - DNA, 1205 bp, Homo sapiens
cctaagaatgcctttataacatgactgttgtgaagatgaaatgaagggagcatatgaatggtgcttgaggcacggaagataggacatttttttttcttcctttcctctcttggcctttttttttttggcaatgaaatgaatgaaatgagggagccatgtcagatgttcttacctctctgacattctaaataggtgaattttctctcccatcaaggttagtgctataggaagaaaccatgtttccaaatctcctactcctgtgcagtgctgagctgggtaaacatctgttgacactgcatgctgaagtgcagatacccgtgggcctggacattttggggttggttggcactcctgaagaagtttcacgctggccactgaaggcattatggttcagggtcaactgaatacaccagcccccagtggacctgggctagttgtccagttttgatgcctctgcactcagtgtcatcagcattgcagggttggtgtcaagaataaagaagacattgatgtaacgtcttgacacatcagctgtgcacagtcacacctcctcctcttccctgaggctgtgctgagattccagcacatgggaaggagagagttagaatttagtctgtatcatgcgttggtatgccgttggtcatttagaatgaggtggcaggggtagtgagtatattttggggatctgggggcagaaaagggattatttttattttttaagtgtggaaatgtggcctggcgcgatatctcatgcctgtaatcccagcactttgggaggccgaggtgggccaatcacctgaggtcaggaattcgagaccagcctggccaacatggtgaaaccccgtctctactaaaaatataaaaattagccgggcgtggtgatgggcacctataatcccagctacttgggaggctgaggcaggagaattgcttgaacacaggagacggaggttgcaatgagccgagatcatgccatggcactgcagcctgggcgacagagtgagactccatctcaaaaaaaaaaaaaaaaaaaagagtggaaatgcattaaatttcttcttttagccattgggctttaggtcttactattaaaaatctcaactgcattttgataagtctgtttctaggcagcattagctttagcaacaaggatggaggggtgaatgcctctgaatgggagaggacactgttgaaatagaattgtg

SEQ ID NO: 130646 - DNA, 1048 bp, Homo sapiens
tgagaaagatgtaacgtcatgacttgcacctgaccctttgtcttcttggatcttacatacttttggacaaccaagagtgaaaagggtggaaacttccgatctcgactgagtaaaaggaaagcctttctaagaggcagtcaaagatggaacaggctacttaagcaggaggcaggacccatacctggagctaagctggtgtttgtttggatggctgtttactgaggatctttagaggagattcaagccatcaactggctggggagagtcgctgacctttatagcttccttctaaccttagaagattctgtacgacattttaaaggtgagtgctgagcaacttaaactatattttatttcctttcctgataacttggtctgactgagactagacatcttttgttgcctatagttgaaggagtctggcattctaggaccaacttgctgttaaactgatggcaagatctctatttgccaaagttaggggactgtgtatgtaaccattgaaatctaacattacctcaaacttcaagggactctgacaggtactttaaccagttagaatggcacacttgactatctggtttgagtcagagcagtgagtgcctgggagaaaacagcaaactcaagacaccatgagtggactttagggagagggaagagagacagagggcccacaggccagcacgaagaatgtaaagggaaagtagccactgtcccaacctgccaggggtttgggaggcactgttaatttcccaagcattcacttatccgcactttgaccaggcaacccttcttcggctggacagggacactcatgctggaccttgatcacccatgacccatgtgtcatagtgcagagctttccttctgaggcttaagtgaccagtgtgacaagaaccctgaaacacctaatgtacagaaggactctaggtccatggtccccaacctttctggcaccagggactggtttcatgggagacagtttttccacaggtgttaggggggatggttttgggatgaaactgttccatcttggatcatcaggcat

SEQ ID NO: 130647 - DNA, 1069 bp, Homo sapiens
atgttggtcaggctggtcttgaactcctgaccttgtgatccaccctccttagcctcccaaagttctgggattacagacgtgagccactgcgcccagccaaagcttgtgttatatattgggcttccattcctgaaagctggttttatactatacaaataacaaagtcaatatgaaaatgtgtcaaaaatatgaatgtacctcttaaatacacatattaactatttcaaacaaaagtactaaagataaaaaaaagttatactgtaaatgttactttcagggaatttttttctgctgaggttgagttgactgaagcttttaaagtccaatgttaagtctttctaaagcatatagaggtatttttttttccagtgtttcaaggtcttttaaattgtgttaaaaaacagagttatctgcttccaattctattgcatatgaaaagtgtagaaatgctgggaagtttgttaattgctaaaagttgaaggagggacagtttccatggcaacttcttcagtaacccatgctctgatatttcagaaggatattctttgctgagctgtgaatgcagtattaagaattcaatcaaatcttcagaatgtgaagagcaattgctaaagaaaatcattagccctgtgcacagttagaccaaacagctggctgggtctgggctgtcccgtattgagtcagccttacctgtccactaatcaaggcgttgccttctggacgtagtccttggtgagtctgctagccgtctggttttggtcatccctatgaaagtcttaggaaaggcagtaacaggttgagctgtctttgattgagttagattcatgactgaatatcattagggtgtattcctttaatctgtatgtgttgggaaatgatttgtgtgtctgaagaaagtaagcaacatataaattttgtctaaaaggccgcatttatgctgtaataattttctcgtttttcttttaaataaggggacaaaccagggcctgacattatcttgtaataacgagtactgagcatagaattttatgtgtccatgtctgtgccttcatgaattgtcagattctac

SEQ ID NO: 130648 - DNA, 1666 bp, Homo sapiens
gtataattatcacctggtttgtgcataattaaaaatgtaattgtatatttttatgcaataggttatcatgtactgttttaagtgtgtacagttttttatgggcctaccatttagttaaattgcatagatgctttttagaatgctactgtgaagaagtgcagagttgaggtcgtttttagaagctcagtgagttggccccttttgctctctgtattatccttttaggctaagctgcagcacagctgtcccacctgactagctttcctcctgtggctcttattgtcattgcattagctgagagaacaggttttaagatttttaactcttctctgcctagcctaggtttcagaaatattttagagggtttttagaaagtcgaaattcagtggataagacttttgatagttttcaggttctctttgttttatgtaaccttcggtttttaaaaatgtttacatttcactccattttcttctaatcctgtagatatgggactggcctaggatctggcgttttaaataatcttttcacttccccttcccccaacaaggtaattctgatgtcagggagacagggaaaaattcacctcgagaaacaccatgacaggtcagtattggggaatgaggacttgagatttgcctttcaaaatgagtaaggtttaagtggatggagaggagatgatttccttgtggaggtaagaaatggagcaaagtctaaggtgagaatgagcacgtaatattaggagagaaggagggcaaggaggatgctaaccagctttcagtggaagattattttagagcaatgttctcaaactgtgggtacattagaagtgtaccatgggcttgttaaatagccacattcctgccttccaccccgaccctgaaattgcttgtttgggcattctgtgggcttagggtggtggcctgggcgtcggcatttctaacagacatccagctgaacttggtgtgatggaatccctgctttatggaataaaagagggtctgctgacaaggcagcagggactgcattttggcagtccttactgtgttagatgaggtttcggagttaagatggggacactagaactctagctgggaaatcaggtgcagggatgctgcataatcccctgaggtgatgcgtgcagcgaggcaacagcagtcaggctctacagggtagaatttattctcagaagaaggtatagaccgctgacaaaggagttcactcctctgtaaactgttaaggaattgcaaagaaattttccatttgtaatctgctgacatattttagaaaggtagcctccttaatccacccctctaaagacctgatggtggtccctcacaggtatccaaagtagccttaaatcagagactggtctagttggaggatgtgacttggaatctatgaaccctggatgtacttgagggcaactcacttgaaactttggaatttcatgtggatgcatgttttctggagagaggtcctagagtcttgaccatattctcagacatgcccttacttggatttaggataagatgatttagtacttggctcattgggtggctggctttctctctcctctcttttttaaaaacccagaacaaattcctattagtgaaaaagaaacaatagcttgaagaacaaagaaggccccagaccataagataga

SEQ ID NO: 130649 - DNA, 1124 bp, Homo sapiens
cattttcatctgcatacatgacattagattctccaaatgtccaattaaacacttgtcaatggaagaaatgtttgtttcctcagctgacctgttgtcagccttggccttcctgatggggaagcagtttcagctgatactgttgtatgctcttcctttctgggcctgatcttgtccctgttgagaactgtggagactgtgccaagctgtggaccatgggattaggttaggtaactaaagaaaatatccaggctgtgagcacttttcaaacctaagaaaatctttagtttcttttgcacagttgtaaaccgtttgtgcttaaaaaattataaaagtgattgcagttgagatagagaaaagagcagtgctgatatgtgtttatatacttctaagggctgacttcatttttttcaacatcttaaacttctattgaacaaatattgtgtgtgtaggtgtgtgtttgtgtgtgtgtgtgtcatcatctctgttgacagaaatgctcaatgataagtctctgtgactggaagagcagtgaaggacttggacacatgctgtagaaacataaaggaagtgaggaaggcaatattggagaagaatcaaaggagtttaaattattctttggaaaagttggagtttataaattaaaaaaaaactgtatgaccttgagcaaatttctatttttactagtgtcagtttcctaatccataaaatagggaatataatgtcaagaacatcgaaggttattattaaaattaaataaaatgatctatgtaaaatgcagcaacacttgccacattgtaaattctcaagaaatgctagctaatattgaaatatgaaataatacttctttggtccaaagatgtttaagcattcctatttggtaaagagaaggagcaaaagaacaagagaaaaattagataattggtacagtatgaacagagtatttggctttggaaaggagggtgggcagttctttcactgggacaggagctcagaatgactctataggtaaagggatagaagaactttaaggtgaggatgaagaaagacaaagcatgtcatggtcattctattgtctcttcagttacgtagaagaggagagctttttctgagcatgagggggaata

SEQ ID NO: 130650 - DNA, 1079 bp, Homo sapiens
gacaactcctcaacattgacccatcccctcagtccagttccatatgttccattgggaattaatttcctgcaggcatagaggagtcgtaagagttgcctctgccagagaagccccatctttccttgagccaggagtcagtagaagatagtaggctacaaaccatttgactatacctctatgatctcttgccactgaatatagaaaaggagtataaagaagcagtataaaatatgaaattgaattgtcagtggctagatagttagacatatagtctgggtattcaaagggagtgccttttaaaaatgtgctcaacccccattagcccatgaaatgcctcctttccgttcctacactggcatatctttcaccagaagcatttaaccagattctagaacctgtccattgggaataatttagtcaccttcttcaacttatttttctctttttcccctctcaaatgtcattttttttcacatggctccagtctcaattctcctcttattttatccattgtccccagtaacacactcttctttgtccatctagtcatacatcaatccacctatctattcatccaatcaactattattgagccccaattacatgcatgtgaagcatattctcaaagcaccatttccctggccaagctaggatgataatgagagataagatgctctgtttcagtttggttattcaaagcagaccctataataaggaattgggagcaagtagtttatttgttaggtaattccaggaagcaacagtgaggtaaagaaggagaggaaagggggaaaaaaaacaacaaaataataaaggtgcattaagatgtgagaaactgcttataggcaactgggtttagtcctgctgggaattttttgagaaactttgtagaacgtgcctcagaattgtgcccctgaaggatgagaaagctgagatgtttatccatttacttcagtcctcactggctaagagttatcttgggggcattaaatccctggcattttcaggatgccctcccagtaggctttgcaagccttagtactggagagagccttcaggcagaaaagcagaagacaagg

SEQ ID NO: 130651 - DNA, 1059 bp, Homo sapiens
cattgttaaaccctgtctctactgaaaatacaaaaattagccaggcgtggtggcatgctcttgtaatcccagctactcgggaggctgaagcaggagaatcgcttgaatccaggaggaggaggttgtagtgagctgagattgtgccgctgcactccagcctgggtgacagagcaagactctgtcagaagaagaagaagaaggagaagaagaagaaggagaaggagaaggagaagaagtagaaaaaaaccattattctgaaaacacattttaaagcataaaaagataaataaagggctgggggtgatggctcacacctgtaatcctagcactttgaaggctgaggtgggaagatcacttgagcccaggagtttgagaacacctgggcaacattgtgaaaccccatctctacaaaaaacaagaataaagtttaaaaaataacaacaaaaacatcctgggagtgtcgtgagtgcttttggatgagatgaacatttgaattggtaggctgagtaaagccgattgccttccccaatgtaggtgggcatcatccaatctgtcataggtccgaatagaacaaaaaggcttcatgaggaagaatttgctctttctgtctttcagccaggacattggtcttctgccttcagactctggcgggagcttacctcagctctcctggttctcgggcctttggacttggactggaactacaccatctgctctcttgggcacttctcagcctctgtaatcatgtgagctgacagcttatggtaaatctgtttctagctatctatctatctgtatatcatattggttctgtttttctggagaacccagactaatacatgtacatacatcttgttcatttagtcctattattttctgtagtttatctctaaaagtctggtttcttggttaaaggcttttgtggttcttttgggtaacattttgagatcactttgataaagattctcaatgaacattccgtcaggctgggctctgaaagtttgcaagctaaccttgaagttggactctcatggcagagactctctagtgccacctagt

SEQ ID NO: 130652 - DNA, 1001 bp, Homo sapiens
atttatattttttgagacaggatctcactttgtcaccaaggctcactgaagcctcaaactcctgggctcaaatgatcctcctgccttaggctccccagtggctgggaccacaggtgtacaccaccacgccaggctaatttttagaagttttagtaaagacgaggtctcgctatattgcccaggcttgtctcgaactcctgggctcaagtgatccttttgccttggcctatcgaagtgctgggattataggtatgagccacaccagggctaaaaattactcttgaaccaatctaaatgtctaaggctgatgggagtaaaatcagaagttactttcatttactgtattttatccttacaaaattataccattatcctacctgcaatatacatttacattaattaaatgtagtagctacttcttgcttcaattaaaaaataagataaaattgtagtagcagttgcttctaattgcattaatcgctaaatgcaaaaaattgtgttatgccagagtcagttatctgcgaattccagtgtcagcagagctccagcccttttaaatcggcagaaggggtcaacttcagttttgatttctttctactactgagaattaattcgctggcttctacttccaaagtttcaaaagcagaggctaatatttgaaggccattgattgggtgaaatagttaattgagaaaactcaataaccagcatcaagtttgtgttagcaattgagcggggtgcagttaaagcagacatgaattgcagtgacagaagcagtttaattagctgtcaattttctaaacaaaacgttctggtgtaggtcaggattttgaaactttcatcttggtttctgcaggaactggcaaggttgaaaagggaagcggctggagggtgtttcatcgctgggacgttgtacacaaagcaaccagacaatgaaaaaggaaggaggttggacagggtgggtggggtgcgcggaataggagaggagctcttctttattt

SEQ ID NO: 130653 - DNA, 1048 bp, Homo sapiens
gccaatttaagaaaaggatggaggcagcagtgtctggctttgctaggagacagattactgtcattataatgcacgagaaacattccatttgttaagccagagaaaaagatatttcacacaaaaaataagaggaatgtatctattggtcaattatttcatcttactccaagaattactgaatttcagataaatgattcttcatcatagaagatattagttgccaaagagtcctctaaagacaaggccgggcaggcccttcaatgtgtgaaatacaaatgtataaaatgaagttaacaggcaagtgcactcccacctaaagacattcagattttaagatatttgaaaacattgatctggtcatacaaaaccaaaacacagctgtatgcaaatctggcacacagatgctggctctcctctctggctctcaggttaagcaaagagattattaaaataatcaaagatccggaaatgtttttatttttttcttaactacatggtttaattttagacagcatgggttgactccctgctatgaaagatgaagtgattacactcttaacaatttctcctacctacattttcctccatttctcttctcattaattataatatattttactttgccaggttataagccatcacatcatgttctgtaattatgatacccctagttacttagtttttgttctatttttaaaagcgtctaatgctcatttccagttcttttaccactcctacattcttgattttgattcatttctttggctggatttcaatgtccaatggttttgttcatgaaaggcttacttctatatcttttacacactagattctaagtactactttccctctgtcttttcatatttgagaaagcttgcttgttgactttataactgaacagttttgttggactacactttttttaaacaggcttaattcgctttattttacttgtataaaaaccttatgttgtagccacagctggagcctgggtcctctgcacgtagactctggcgtgggtcttgacaaggtggtcagtgaattcctg

SEQ ID NO: 130654 - DNA, 2865 bp, Homo sapiens
cgccaccagccaccccgcgaaggcgtccaccaattaacccctcccagcttctggtctacagtaacgggtccccaacgccgcgtcttaaccaggcccgaaccgaccaccgccaaccttccctgacacgcctttgccccacccgaccccgcccgcccccacgtgacgcccacgccccgcccactggcgcccacgtgacccacggtcgtccccgcgcgcggcgtggatcgcggcccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaagtgagtatgggatgagcggcagtagagaacgggcgaagggcgggcgtggagaccctcgagcttgggggaggccgcgccccagccgggaaggaaaagagtgcttagtcgaaagccgagaggcagcactcccaagtggaggaggaggtgataggtggtcatgttatttggggaatggggggaactcaggaagtataggacgagtggggaagcccagtttcgaggaaggaagttaggaggtctgggggtccgttcagataggcgcccagaggtcaagccatctttgggaaccgtcaccgctagaataagcacagcatccttccttgaggcctgcagagtaggctgcatgtggagcgtaatgggaccttaaggtggtgttaggaagttgtataaagactgcgctcggaagacagatgtctatctcaagtcacattgagacagtaggcagtggaagaagtgcggtgacctagaaattctggggcttacacaggattaaaggtgtccaggtctagacgcgcttccattttagttgggactgttaaagggaaatggttgcccattcttgttctggcaaatgtggccaacagaggccggaacgggagcaaggcaagagggggtcggttacctaatacgctttgaggtgtatggtcctgtgagaaagagctaaggcgagttcaacgaacgagtctgttgcacactctgtggcgtggtagatttgtgaaatagagtaaagggagatgacagggcagaatggtgaaagccgagagaggaattcaggcaccgatttactgggccacgtgtggaagttgcagagggcatcacgtctgtcttaggccttcatgttttacgtttacattctttattgccattcccatggttctcccattatatctttcatagttttatgtatttttaaaaatattttacatttgagcaaattgagactatggagggtatgcagagttagaaacagcacctaacctatttttatatccagcgaattaagatcttcaccttttcagtacaattcagtaagccagtacgaaggccctaccatgtgaaatttgcactctggtgtttggagggcagtgcaaggtatacacgtagagtcagtgttggagagtagtggagacagattcataaataattagaattttgcatagactgataggtgttaaagaggttttaactgagtgttaatgaggtttggagggtaggagacatttcactggagggctttaggaaagttgttggaggaaatggggtttgagttccaactaacaagagttttgttggtaacaaactctaatctctagattagagatgtgacaggtcacagttagtgcattatgaggcctggataggccttcacgttttgcctgctgattaagagatgcaagatacatatgaaacctggaaaaggcacaactttgtcaatgtgaatactaccataagttaggagaggagaaaatagaactgatttggaacataaataatttaaaaatttgtggagactatcaagaattaccaattatcaaagtaatgttatggtgaaaatagagaaccttgctccaaggtaaggaaagaaggtgatcttgaaagaaacacattcagcacaaacccatgtggatgaagcacattgtgaaaatttcaaagccctatttgggacatctagaaatttcagataaacttgagttgagagagacaggttctccaagaacccatccgacatgcgttataacactcaaatgactcatctgaaagaatacagattccggcgaatgcttatacattactgtgaaaaatgctcagtagacttaaaagacttaccccctcattttcattcgagttaaggaagtggggagtaaataagtaaacctagcgttagctttgaggagtggagaatgggaagactgtatggctgaatgtta

SEQ ID NO: 130655 - DNA, 1057 bp, Homo sapiens
gatacaaaggttaaagctcagtttctccccagggagctttttgtttcagtcgtggaaaaagatatacttaagaaattaatgatacaactggatgtggacccaggtgggcgtgaaaggccttgtcacagaagctgactttgaaagtgggtaggagtcccccaggaattcaagaacgacctgggcaatatagtgagacctcatctctacaaaaaatttaaaaaattagcccagtgtggtggtgtgcacctgtagtcccagctattctggaggctgaggttggaggattgcttgagccaggaggtggaggctgcagtgagccaattcgaggccctgtctaaaaaaaggggggaagggagggcagtaagagcaagataatgtgagaggcctgagaaacaacaaaggcccaggattgaaagaagacaactctgtcagcctggcaggaatgggaaactctaaacttgagtaaggcatttcaccttgctctgttcagtgtatcttgtttacaaattggaaatcttagttgagttaaaacactgcagtattcttcaaagtgttatccctggctacttgcaatgagtcactttgaatgcttgtggaaatgcttgggccaggcacagtggcttatgcctgtaatcccagcactttgggaggcactgttgggaggatcacttgagcctaggagtttgacgctgtgatgagctatgatcaggtgactgcactccagcctgggcaacacagcaagactctgtctcctaaaagaaaaaaaaaaaaaaagcttgtagattcctgatctctgatcttttcgttccattatttttagctttctcttaaatcactccaaattttgcgactcctgttttcaaatttttcatttgtagagtaaatagtggcgaaatctgtatttacctcaacctgtttataagcaatttctgaaattattttatcaatttgttttttatcccctaataaaaccatgccatagatcttttagggtatgaattacagtttgttccctaattaaaagtgaggggggccactttttactgggctcagttct

SEQ ID NO: 130656 - DNA, 2440 bp, Homo sapiens
taaaatctaaatctctttccatggcccgtatggcccagcacctgcttttcattctaagctgaatttgtgtgagtttcctgtcatttgctgttcagttcttgaaactctttcacaacccagcgcctttacatgagctattattaacacttttggaacaatctttcccccactattctcctcagcctttagttttcaccttaaaagtcaccttccccgaaaatcctttcctgatcaccctatgtgaaatagacatccctttctattttctgtctcaaccccttagatgtttccttcatagtggttattacagtttgtacattatttgtttacttacccatttacttttttgggttctctccctccccagattgtaaaccggtggcaaactgcctggcgtataagtgcctttggtaattatttgttgaactaaaagctgaacaaagtgactaaaataacatctcacagttaattggataatctgttattgagttaaataaatttatctcttaatatattcccagtagaattgtgtttttttattcttaggtaatagttttgctggtaatattaaaaaagttatatcacttgccacctatagagttttctttttacctttaagtcactctttgtcagttttaattcttaagagaataatcagccaggtgcggtggttcacacctgtaatcccagtacttcgggcggaccaccaggtcaggagattgagaccatcctggccaacatggtgaaaccccatctctactaaaactacaaaaatcagccaggcatggtggcgtgcacctatagtcccagctactcaggaggctgagacaggggaatcgcttgaacccgggaggcggaggttgcagtgagccgagatcgcaccactgtactctagcctggcgacagagcgagactctgtctcaaaaaaagaaaaaaaaaaaaagaataatcatttgctcaaaaaaatccaaattataagtaaaacaaatattcatgattttacagaagagaaatcttgagattcagaaaaattaactgacttattcaaggtcataggacaaaggagtttaaaaggcaaaacaatatcctaatttctagtctaagaactttgttatttccactctacctctctggtttcgatggcatgttccaggatattaaattgcattcagagaacaaatagagttttcccagtgagttatggctttattgcttttaaaatttcgagtcagaagtttctgctgaaaattataatgaccttacaaaagctccagaattttggctccatttgtttggttatgtgacaggattttttcatcttttcttttcattctgccagaggcctaacgtaaaagacctttaacagttctgacagaaaagacctttagtagttgtgcccatcttagataccaagaacaacaataaaccctatgaacattcatttttgttgtgctttggcattactggttagtgtactatttctcaaggctgtaaaagccttgagagtatttttaaattattattcaagcaaaattcagagatataagtgaggaattggtgttatttgatcagttttaaaatgcacttgtttttctctccagctatgctagtagttttcaaactgctccatggaatgccaggcttcccagaaggcatccgtcagaatgtcttagacatttttcttctaagaaagaattatacagatgtgtatttgctgtatcatttgtagtccttatcatacccatcagatgtaaaatattgaaaaccaatgcttgtatttagtttttcagaaatcatctttggcatatcttggccatgtgacagttattaccatctccccatctcataaaggtaaccctgagcatccctgctgtagtcaacaaggagacagtttggaatcctgagttgaatttttggctgtttagaaagcacagggatctttaccactaaaggaaatatctcagtatatagtgagattttgcaaatttgaaccataggttatatttgtaagattgttctctcagttattaagagtttgaaattggggttgaactgtgtctaaagctatggtttatgtgtatgtttagtttatgtagttgctgtgtgcataacatttggcaggggaaaatgtttttactttcaaacaaactgacaagaaattgttccatcttgaatttgtgtaagaacgtttcagaactaaaacaaacttaccaaaactaggtcttgtccattaaatgagataatgcgtgtaatgtgtctagcaagtacttggaaattattattgttaagactgtcttatagtctaacttatcaactacaatgatgcctcttctgaatttcctaatttcttgcctttatctttttttttttttaattatactttaagttctgggatacatgtgcggaatgtgcaggtttgttacataggtatacatgtgcc

SEQ ID NO: 130657 - DNA, 1514 bp, Homo sapiens
tcgagccgagatcacacaccactgcactccagcctgggcaacagagccagaccctgtctcaaaagaaaaaaataaaaatgaaattccagtgtttgtccagggtgaaacacatttgggatctcaatcctggtctcccagcctgctttcaaaacctgtactcttgagagtgtgagggagagtataccttttgttttgtactttactatatgttattgtatacctgtcttcctttactaggttctaagcttcttgagtgcaggcattgagccttatctttgtttcaaggtgttaagagttctgcatagcactctactgagtgaatattatgtaattttcttggaaaacagcagttttttaaaaagaaagataacattacaatgctgcctctagagcaagcctggactattttaagcctctgagaggatatatttgcttattatttttaatccattaacttcccaaaagaatttgcatctggagcattggacctgatggatgcctgtccaggcccttttgaccaccaggacttaacattcatctgagcttgttaatataaaaaaatggcccaaatgcttgaacgtgggaataaagggcataggccatcatagctttggagagaaaagggtagacgggccaggtgcagtggcttatacctgtaatcctagcactttgggaggccaaagagggaggatcacttgagcccaggagttcaagaccagcctgggcaacatagcaagacctcatctctaccaaaaatttaagaaaaattttaaaaagaagggaaaaactgtttctggagcaggtatgctttcacatgctctgtcacttggtgtaattcaaatgtaaatgtgtaagacaaagtatatatttttctcatatttacaaatgatgaaatcaagggttaagtcaaggaaaatggttaaaatcacagtgattaaatatggaagttaagccttaatcccaggtttgtcaaactccaaagcccatagtcttctcatattccattttttgggggaagttggtagactgcccttctagtttctaaacctaagaagtttctaggtcatttgaatcatgatctttacatgttgtggctagaaatacagtttacgtaactaagtgaaagtagggttctatgtgatttcattttagaagtcagtgttaaaccttatatatgcttacctcagatacaggttcttttgcaagttggaatcagttttaacaagttaagagtgctcaaatgacatctgttattaagcatacttttttttttttttttttttttgagacagagactcgctctgtccccaggctggagtgcagtggcgcgatctcagctcactgcaacctccgcatcccaggttcaagtgcttctcctgcctcagcctcccgagtctgggactacaggtgcttgccagcacacccagctaatttttgtatttttagtagagacggggtttcaccatgttggccaggatggtctcgatctcttgacctcatgatctgcctgcctc

SEQ ID NO: 130658 - DNA, 1931 bp, Homo sapiens
aaataaagccattgaaactagtatattgacttactaacatgttgaatttgaggggaatgcataagtgaaaagatgttgtaggatccagaaagacggttagagtacagatacctaggccccattctccaaacttctcagtctggtgatggggctcagaaattattatttaaaaagtaaaaaagaggctgggcacggtggctcacgcctgtaatcccagcactttgggaggccaagatgggtggatcacctgaggtcaggagttcaagaccagccagaccaacatggtgaaaccctgtctctactaaaaatacaaaaattagccgggcgtggtggcatgcacctgtaatctcagctactcaggaggctgaggcaggagaatcacttgaacctgggaggcagaggttgcagtgagccgagatcacaccttggcagtccagcctgggcaacaagagcgaaactccgtctcaaaaaaaaggtaaaaaaagaatgattctggttaaaagccagatttgggaatcacacacttgagtctactcatgagcatctctaagtgctatccatcattttattttaggaatgttaggaaagcttttgtagccttttgtaggctgtggcaatgggtcggaaagcttcttactcccagaacagtagagccatgaaattacagaattagaggttccattagagattgcctaacattcatttgtttatgtatcatctatggctgcttttatgctacaatggaggaattatgtagttgcaacaaagacatatgggccaaaaaataaaaataaagaacaaagatatatggcccataaaacctaaaatagtttctgttttgttttgtttttgctgaggactgttgatggcaatcaataaaatatttttttctgaattttattttgccatacaccctgaatatgtttataaataaaatattttctatctggctgtttacagaaaaagtttgctgacttttgagtagatcatacctgtcactttatagatgtagaaataaggctcggagacaatgagtgaaatattctgagattacacagttaattggtggtcaaattgcaaacacagttttgttctccttttaactgcttccattccattatttttgttagagggactgataccttggtgagataagaaaatctgtggtacagaattttgcttatgaattttatatatatatatatataaacactagggataatctatcaactcttagataacattggtgtacaaaaactttttaaatttaggtacagaggtaggatttgattgtagtatatatggtttcctgcgtataaatctttgcactgatctgctaagcagtttgataatatgatactttttgttgcctgtgcagccaaatgggcggactgttgaagtggctgagggtgaagctgttcgaacacctcaaagtgtaacagcaaagcagccaccagagattgacaagaaaaatgaaaaggtaagtttgggagcatatgaaattgtatgcaagactcttaatagaatgacatataaggataatgcttttctgtttcataagattgtatgtatacctctcatttaaacaaaactcagaaaatctgaattaaccatagtggatgggtggtaaaagtttaactgagttgtttttgtttttttaaaggaaagttgcatcaccaaatattttaaacattgctgtggcaatactaaatattcattataccaaaaacaattcattcacaacttgaacatcttgtgtaagttttcagatatataacatatataccttttattcaaaaacagaactgtggaattgtgttacctttgttagtaagacacatctagcatgaaaaccttagcaaaatcgttcagtgatgtttagtgttgaaatagatttctgttgtgttggaaacataattgtctatttacta

SEQ ID NO: 130659 - DNA, 2261 bp, Homo sapiens
cagcatgggcgacagagcgagactccgtctcaaaaaaaaaaaaaaaaaaagatctgaattaatgtagaaatgtaaagattgctagtgagagaaacaacggaaacaaaatgtgtaaacttttgtcaccaccaagttgttaggatgaagtcagcgatatccactaaaccctgatatcatttattacaagtattaataaggtcttaaatttttatgatgctacacaatatacaaaatatttgtacaaaacattttcatatctcttaatcctgatgaacaactctgaggacattatcatttcttttacatagctcaataaagagttttgtgaattgtccaggaacacatagctgataaggaatgctccttcagtttctctaaggcagcagtttttgaagcatggtcagtgaacccctaggaagggaccctagtgaccctttcattaggtccctgaaggcaaaactattttcataataattaagacattattttcctttttaactatgttgatgcttgcactgatggtgcaaaagcgataataggtaaaactgctggctccttatcatgaaccaaggcagtggaaccaaacttccactcattatattcttgttttgttttgtttttgagacagtctcactctgtcgcccagggtggagtgcagtggcacgatctcactcactgcagcctccacctcccaggttcaagcaattctcatgcctcagtctcctgagtagctggaattacaggtacctgccactacccccggctgatttttgtatttttagtagagacggggtttcactgtgttggccaggctggtcttgaacccctgacctcaggtgatccacctgcctccgcctcccaaagtgctgggattataggtgagatccaccgtaccctgccattttgttttgtttgaagagactctcactctgttacccagcctggagcgcagtggcacagtcatgctcactgcagcctcgacctcccaggctcaagcaatccttctacctcagcctcccaagtagctgggactgcagatgcacactaccatgtgcccagctaattttttgtagagacgctgtcttaccatgttgcccaggctgttcttgaactcctcagctcaaagcagtccacctgccttggcctcccagagtgctgggatcacaggcatctcattgtattttttactgccatctactcacagttaaaaaaaaaatgctagtttcacttgagtgtccttaatgaagcagcaaaaattattattagctttattaaatctttattaaatctcagttcttaaacacatgctttttaatctgtgtgatgaaatggaatatatgcataaagtttgctgcaaaatgaagactgatgattgtcttgaggaaaaacacttatgcaatggcttgtgtgccaaattagccacttattcatattactctttttttgcttgaaagaatgactgatagacaagccgtgattattcagatttgcatatttgcagaccttttctcaaaaatgaacaaggctatcttgtcgcttaaaggaagctggtagtatttgttgcaaatgataacatgacttgttggcaagtgaaaattagaaatttggaaaatttgctggtgcagtagctcacacctgtaatcccatcactttgggaggccaaggcaggaggattgcttgagcccatgagttcaagactagcctgggcaacatagcgagaccctgtctctatattaaaaaaaaaaaaaaaaaaaggaagaaatttggaaaatttgtgtctgctaccatgagcttgacaacttaccagtacataaggaatttctaatgacgttagttggtatattaacaaatgtaattttaaaaaatatatgttgtttaatggaatgttttaacattttggaagatctaccgccaggcgcggtggctcacgcctgtaatcccagcactttgggaggccgagatcagtggatcacaaggtcaggagatcaagaccatcctggctaacacggtgaaaccccgtctctactgaaaatacaaaaaactagccgagcgaggtggcaggcgtctgtaatcccagctactcgggaggctgaggcaggagaatggcatgaacccgggaggcggagcttgcagtgagcccaaatcgcatcactatactccagcctgggcgacaaagctagactgcatctcaaaaaaaaagaaaaaaatttttggaagatctttataactcagtgaacaaataattttccagtggaccagtg

SEQ ID NO: 130660 - DNA, 2048 bp, Homo sapiens
tttctgaagggaactgccctgaaatttaaagtcaagctcagtattttgagcaattaaaaagtcattcatcttgtctttgtctcctggaattatggtttgtttgtttttcccccgtggttcttaaatataccatttattatcaccacctaataaacccatttattagtgattatatataatactcctgtcacttctacctagcaagataaaaaaagatagacaagatgacttatatatatcactttttctaaaccatagatgacagatttgataaaaattaccagaataaataataacagttgcctaaaacaacataatgaaattagaaaacattcttaggatgagttaatataatcaacactcttggttttagcttaacatctaaatttatcatgatattttatgtgctccaccccatattctcccccaaaactataacttttttgtcttccccttactgaataacattttttttctggggctatgtcaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtatattagtggaacataagacagtggtacatcaaatcaaactccttttattcggatgtacaaaatatcattatgtcaaaatctgactattttgaatgctaacatcattgtgctgatatacccttcttcatgagagtattgtgaaccatgtatcggtttaccgaataccagcagtgttacttgttacgtattgcctaatgactggcctattaaattaaaatttgcctttctgccttgagtcatatgagaaaatgatgttgccacttttctagtgcgtatcactttgccccaactcccttgcatctctgttccttagagtggataagacatttattaaatgaaatgatttatcaccattttgcatgttgagagctttcattccaagatgaatcatgcatgttctggtgagtgcaggttgtgtctggatttcttatcaccccacctttttgagaatattatagatgtttgatagagctagaccagaacttcaaagattgagctaatgttctttctctcaagtattaatatttcagatgttcatactatccaatactggtggcttcttggtagcccactctttaaattaccgtcatttttaccctggagacaccagtctgcaaagtgatactgttcaatttgctggaaggcattggcgtatcttccttgtctttttgttaatgaccttcccacctccccacacctcagttgtttccaaaccattttcttagccttgttaccttttattttttgcttgataacttggtggaatttattgccatggtacagcaatgacttctacttacccattttcactgttacatattagctatgctttagtatttttgttgattctttttcgctgtcttgtgcatgccatccttgctagcacaatcctatgtcatgctggtttttttaaacattgtgatcattatgctttttagtgtcagagaaatagtatttttgtgttataatgtgtattctcacctcttgccatatttcctaagtcctggtcccaaatactggcaaagttcttcataaggtgatgtgtttgcttccaggattgttgaaaaggcagcgggtgttgttgagaggtggcaaagttgaatccaattacagagcccaatactgcagttcatacttaaaataatcttgataactgttgtagaatagcaaactctgtctgtacataggcagttttccaggttctttttggcattttagttgactaagaatatggtaaccagaaaactcagttccttaccaacaagtgaaatgtgttgtaaaattgacttttttccagtggaagaatttagcacttgaaggagcaatttataatagataataattaaaaattaatttatgtgttactcctaatttaatg

SEQ ID NO: 130661 - DNA, 1256 bp, Homo sapiens
tatttgtgtgtgtgtacatacatacactctacatatataatgatacctgggctccaccacaaagattcagattttaattggtctgggctgaggctccagggtctattgttaataaatttttcagttaattttaatgtgcagccaggttttagaatcattgcttgatacataatgtaatatatataaataaggaaagaacatgtaactaaggaaatgtcttcatattcttagtgggtgagtattcagaatatgtgtcattttcctctttgctctgttgtactttctttgagcaagttattctgctgtgaacaactttgttagtatatatgttatgttcaagcctcctgtttttaaattaaggcaatccttggtgatcaaaggatagtaggggaagtgagtaataaatataagtcaagcaatcatagaaatgtgaaaatatcccagttttaagaagtcatgtacctgttttttaatattcattttcttttctttaagtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattggtaagaagtgttagaaaaatttaactttatttaaaattactaatcttgtacatttttaatttttcagaaatagaaaaaaaaactatgaatagaaaaataagtactgctctgcagaaataatagtaataattaactcatctcacatcctttttgtagagcaaggtgggaattaaataagtaaataacatcatttactctttacatagtgctttcacatactttatcacatttgattatcaacatagctaactggtgtaattatatattcttagtgatgtgatacatgtaatgtgtgggtagactttttgattaatttcaacaattctgttgagtctaaataaaaatagtaaatggaagtacagttgataacatccacttatattttacagtctgcatggtgcctatttataattaaattttcctccggattttaatataaagaccagtagttgagaagtttatttctgttgagagctatcaagttaaaagcagcttaatttgtgtgtgtgtgtgtttgtgtgtgt

SEQ ID NO: 130662 - DNA, 4749 bp, Homo sapiens
ttttgatgtaattcaagttgaatatgcatgtttatgtctcccctagtccccacttaacattgtaacataaacattttccttactttttgtaagtatatttaatggccctataatgtttaaggatagcataacttacttaactattcccatattattcaagaagtaattttccttttttttttgagatggagtctcactctgtcgctgtcacgctggagtgcaatggcatgatctcggctcacaacaccctctgcctcctgggttcaagcaattctcttgcctcagcctcccaagtagctgggattacaggcatacgccaccaaactcagctaattatttttttgtatttttagtagagacggggtttcaccatgttggccaggctggtttcaaactcctgacctcaagtgatccacccacctcggccttctaaagtgttaggattacaggccacggcgcccagccaattttcctttttttaaccattgtagataatgtttcacggaatatatttgtttgggatttttttgttgtggtttttaagatggggtctctctctgttacccaggctggagtgcagtggcatgatttcagctctctacaacctctgcctcctgggttcaagcatttctcatgcctcagccacccgagtagttgggattacaggcgcacaccaccacacttggctaatttttgtatttttttagtagaggtggggtttcaccatgttggccacactggtctagaactcttgacctcaagttgtcttcctaccccagcctcccaaagtgctgggattacaggtgtgagccaccacacctggccatgttttgcggttatttcttaaggacagagtcttgtgagtgatattggattaaagggaatatggatgtttgtaatgctctactacatagtgcctaagtattttctaagagagttgttctaatttatactcaaagcatcagtataagtgcccatttatcatatgcttaccaaggttggggattttttttttccgccttttctaattcgataagcaaaaagtacgtaaattattttggttaactttttgaaatcactgatgagattgaaaagttttccacaactttcttggtcatttctttttttgtttgcttgtttgtttgtttgagacggagtctcgctctgtcgcccaggctggagtgcagtgcaatctcagctcactgcaacctccacctctcaggttcaagtgattctcctgcctcagcctcctaagtagctgggattacaggggcctgtcaccacaaccggctaatttttgtacttttagtagagacaggccatgttggccaggctggtctcaaactcctgacctcatgattcacctaccttggcctcccaaagtactgggatgacaggcgtgagccaccatgcccagccgtttcttggtcatttctatttcttttatgaattgtctgttcttgttattttcccatttgtctaatgagctcttcatgtttttttgttttgttttgtttttaattttttgagacagggtcgtactctgttgtccaggctggagtgcagtggtgtgatcattgctcactgcagcctcgacttccagggctcaaaagatcttcctgccttagccttcttagtagctgggaccacaggcatgtgccaccacacctggctaattttggtatttttttgtagagacagtttcgccatgttgccctggctggtctcaaactcttgggctcaagtgatccacctgcctcggcttctcacagtgctgggattacagatgtgggccaccacatctgcctactattttattttttaaatctagttatactttcttgtgcattaaacatacgattttttctcttgtgcttatggcagatatttttatctgctctaatttgagggagcaatagatactagaaactttttagttttagtatgtaagtagaaaaatatttcttcctttgttgttaggctttttctggaacttttttttttttttgagatggagttttgcccttgttgcctaggctggagtgcaatggcacgatctcggctcaccacaaccaccgcctctcgggttcaagcaattctcctgcctcagcctcctgagtagcctggattacaggcgtgcgccaccacgcctggctaattttgtatttttagtagagatggggtttctccatgttggtcaggctggtctcgaactcccagtctcaggtgatccacctgccttagcctcccaaagtactgggattacacgtgtgagccaccaacactggcccctctcttttaaagctaacaccctcaaaaatcaaacaccagatcatttaattatattgtttttaagcttgctctcccttcctccccattatattgaaaaattgtgtagcggtatcaaaacttgtttgaaagagacattcccttgcctgggcatggtggctcatgtctgtaatcctggcactttgcagggctgaggctggcagatcgcctgagcccaggagttccaagaccagcctgggcaacatggtgaaaccttgtctgtactaaaatacaaaaaaatcgctgggcatggtggcacgtgcctgtaatcccagctactcgggaggccgagacgggacaattgcttaaacctgggaagcggagattgcagtgagccaaggtcgagccactgcactccagccttggcaacagagcgagactccctctcaaaaagaaaaaaaaaaagaccttccctaaattcccactctcatttttagcagagaagaaagcattaatttctgtgctataaagcatcctttcatatttggtaaaagaaatggttgaattttatggagtaatgttaggaaccgtgtgaccttttgggatatttacaatttgcaatttgctgctgcctttttttttttttttctttaagatggaggcttgttctgtcacccaggctggactgcagtggcacaatcttggctcactgcaacctcacctcccgggtcccagttcaagcaattctcctgcctcagcctcctgagtagctgggattacaggcacgtgtcaccatgcccagctaatttttgtatttttagtagaaataggctctcaccatgttggccaggctggtcttgaactcctgacctcataatctgcccgcctcggccccccaaaatgctgggtttagaggcatgagccactccgcccagcctacaatttacttgtaaaagttatatagcatttcataattaggacataaattagatggtatttgcttaatgttgttacagataatattaaacagcaaattagagttcctgcctagatagactaggacttttatggaaaatgaaagggaactatattaaattagatttgtaatgggtcactggaaagagacagatgtgactcgtctcatggaggtttacgttctttaaaataagaaatgtcttgaaaatattgagaaagtagcatggtatagaggagtgaacagggactggttcagacagatctattaggtatgaatctctattcttctacatgatagcttttatggacattcaggctagttatttaacctgtatgaacctcatacttatgtaattgtgaggatttgttgtaatgaaagtcaagtaccaagttcagtgctatcccaaagtagttgcttaattatgataaataataatgcagcttggtatagtggaaaagagcataggctttgggaattgacttaagctgcattcgtggctcagctgttttctagctatcagcaagtcacttaattgctccaaaactgcctagcaaagtttctgtaaggattagaagtggttggtgtaaggggcccagctacgtaataaatattcagtaaatagtagctattactatattaagtggttctcatttctaaggttatctttaaatagtctcatagttttaaatctttacatatctttcaagtctgatgcaagttgaaggttccaagtgatgttttttattttaacagctgcttggtctagtgtggataggggaatgaatacctctgaacagaattctgcttcttttgcatctctcacacttaactctgctgtttctggtatgtgaaaaacagtcttttgttcagctaacaaaaacatttgtttaattttagtgcttgttatttgaaaaactaatcaacatcaagtactgctatcaatataaatagcaggtattataaagtggcagaggcctttacaacaggaagagaagacctaaattcttatgtgcaaatggcttaattcccctctctaggggagtaaggattctgtagcttgagatcactgacagtgtattggcacacagacaaatacacatgcaaggccttccattcaggttcatattcttctgttgctaatgtagtcctgccatacttttagttacaatttgacattttacttctgttcaccgttactcatcatgagtttaaaactaaccctttcaggttatggattcccacataataactataagtatctgtagatttataaaatacatgattactaataaactactgttaattctgcattacttaaatggatatatgttttattaatcatatagaaactacatgtatttaacaaatattacataaatatgggaggccaggtgtggtggctcacatctctaatcccagcacgtagcgaggctgaggtgggaagatcacttgagcctaggagttcaagaccagcctgggcaactacatcaccacataaagttaaa

SEQ ID NO: 130663 - DNA, 1104 bp, Homo sapiens
gctggtaagatcatctgtaaccaagaagaaatttataaattagtagtaaggactcacgtgggaggacgtgattgtatgtaacacttttatactaaccaagtatcttttcttcctaaccatttctttatacagtggctctgaatccaaaatacatatcagagtcatctaaggactccagtacacatgtaaattccaattcagaaggggtgtatgtgtgtgtgcgcacgcctgatggaaaaccactgctttacatttgcatcctaaagtgaatttatatctataaagcaaggggtttgacctggcatcagtgaactcatatgcccccaaaactatatgcagaattttgtgttaagctctggatagtagactgccacagctttcatcaggttcctaaaagactatgtgaacccactctcacccgacctactaccctcacctgagaaaaaacaaaaacagacaaaacttatgagataatattttgttttctttaaatgcacttgaacttagtctctagacctcctgcaactcttcttgtctctttggcttctctctgcctcacctctctagataaccacctatttctctaatgtttcttagccaaaagatgctagctaactcagacattttctagttccctctttcaaggttctgaggatacatagccctgaaacatccaggactaaaatgatcaatggcagagatttctattgtgttttattttccattaagaagaaggaaaaaacaactttttttgacttcttgaaatttgtaggcagggcacagtggtttatgcctgtaatcccagcactttgggaggcagaggaggatccctgtagaccaggagttcaggaccagcctgggcaacacagggaagaccctatctctacgaaaaattttttaaaaataagccaggagaccaggcaaggtggcttatgcctgtaatcccagcactttgggaggctgaggcaggaggatcacttaagcctaggagttcaagaccagcctgggcaacatggtgtaaaaccccatctctacaaaaaatacaaaaattagctgggtatggtaatgtgtgcctgtagtcccagctacttgggaggctgaggt

SEQ ID NO: 130664 - DNA, 1054 bp, Homo sapiens
gtgtataatacaaaacacaaaatctaatggattggtgctagggaaaacatagatttctgatcattgaattagatcaagtgattatcatagttaatctaaaattaccctcaattctacttttccttttaacttaattctttttctaatgtctgaatttttccttttaggagaaattttaaaaataaagtctccgtgtcaaagtatagaactattgttatgaaacatcattaggaaattccatttttaattttattgcattcgtttttcatttaagggtctactgctgagccagtttctcagtctaccacttctgattatcagtgggatgttagccgtaatcaaccctatatcgatgatgaatggtctgggttaagtatgtccttttaaaaattatcagttattttttttcagagttttctttctagcaccctgaattcatgctttatgttttaattttaattctaatttctcacctttaaaggtcataagaatataatttaataccaaatgtactacttgaaacctgattattgaatacctgtagaattaaaactgaattttcgtaattgaggcaatatttaaacaaagttttcttctagttgctctgtagtatttctagtttttaaattttttgttttaaatgaatgtctgtttctcctcctaggtagtataatagactgaattaaatatacagaaatggctttgtatttgtgaagtatacacacatttttgtgccggtagaaaactactttcttaacccagttgccagtagaagtttagttaaaggaagacattttagaagggaagaatatggtttgtatgttcggaaagctcatgccgtcttcatttaaaaaaaaaaaattatgagttttttttcctcacaaacctaaatctcaaaatgtactttgtctgaatttttatttcacatccttttttactatttactgttttctactgttagcacttatatgttccctgtggggttttccaccatttttaagcatatgttttccttctccaagtagagttaagaactctctgaaaatggggacta

SEQ ID NO: 130665 - DNA, 4561 bp, Homo sapiens
tggctctttgaaaagacattggcagactaatggaaaactttagcgataagaaattataattgaagcaaactatactgtgaatcatttttaagggaactatgtctaagaagttttttggtacattaggcctatgaatcttaagaattagttacccaggccggtgccatggctcacacttgtaatcccagcactttgggaagccaaggtgcaaggatttcttgagcccacgcgttcaagaccagcctaggcagcatagtgagaccccatctctacaaaaaaaaattagctgggcgtggttcgcatgcctgtagtcccagctactcaggagtctgaagtggaagatcacttgagcctgagaagtctaggctacagtgtgccatgatcttgccactgcactccagcctgggcaatagagcgagaccctgtcataaaaaatacttttactaagcattttactcgatttttatttttcacctccacctcctaccacatgtattaagaaaatgggtgacatgttggtatattgcccactcaattgcctaaactttcttctgcttaatagtttcttttctggcaagaagtcttagagacatggcttatggacggcaattttcaaaatctgggtttcttatctgtgagatttaagcaaagccactgatagcttggtatgtgaacctcctaaagtattattaatgaatggttggtataagatgagtagttggttccagacatctactagactgaattgaagtatatcttacatatgaagtatatcttaatgagaggttcatcagaattgtgagaaataaatttttaactatacatgccttatagattagaaactggttttaatatcatcagtgataataaaaacagtagctaccatttattgagcgcttactgcattgccatgaattgctttacatgtatctcatataatcctctcagcaatcctatgaagttgataatagagcccattaagaaacttgaccaaaatcatcttgttattaagtggtagaacaatattcaaatgtatatttgtttgacatgaagacccatgctcttcgcctctgtgctactatgtaatactgactccagatacttgctcatggtggtgaatttagaaatacaggaaggaacttccttttttataacacatttcacacttgtaatcacctgttccatgtttttcctccactaggctataaattcttatgttgtctctccctgtcctccactagcttagctcttctttgtttccacagcccccatggcagaatctgtcactctgtatttaatagtttgttaagcttacctatcttcacccctgaatagacagactacaagctgcacgtgcagaaggattctattttacttgtttttctatctctagtacctacctagctcaagttctagcacatagtaagtgcttaataaggattggatagatgtaatttcactattaaaatatatttattattccaacctgggcaatatagtgaatccccttctctacaaaaagtttaaaaattagccaggcatggtggcacatggctgtggtcccagctgctcaggaggctgaggcaggaggatcacttgagccccaggaggttaaggctgcagtgaactatgattataccactgcagtccagcctgggtgacagaataagaccctgtctcttaaactaagaaaatatatatatattatatacatataatgttttatttttttctgtctcttcctcataaatttgagatcatactgtgtagacaattttgtctatgattttttttctgtgagcgttttcccagattattatatattcttccaaaacctagattttaaaactttcataagaatgtattatatattcctgttaaacaaaaacaataatagagttcacctggaaaaataagactagcagaaagtaaataggagtactaaataagagtaatgcaaacaaatttgtccttctagatataaaaatgtattgcagagttatgtatagcactgtcccaggaatagatcagtggaatagaatagaaattgcagaaacagactgaagtgcatataaaagaattgagtaaggccgggcacagtggctcacgcctgtaatcccaacactttgggaggctgaggcaggtggatcaagaggtcaggagttcgagaccagcctgaccaacatggtgaaaccctgtttctactaaaaatacaaaaattagccgggtgtggtggtgcacgcctgtaatcccagctacttgggaggctgaggcaggagaatcgcttgaacccgggaggcggaggttgcagtgagccgagatcgtgccactgcactctagcctgggtgacagagtgagactccatctcaaaaaaaaaagagaattgagcattgctgggcgtggtgcctcacgcctataatcccagcactttgggaggctgagtcaggcagatcacgagatcaagagttcgagaccagcctggccaacatggtgaaaccctgtctctactaagaatacaaaaattagccaggtgtggtggcgcatgcctgtaatcccagctactcgggaggctgaggcaggagaatcacttgaacctgggaggcagaggttccagttagctgagatcatgccactgcactccagcttgggcgacagagcaagactccgtcttggggaaaaaaataaagaaagaattgagtgtttgataagagtagcattaggtattagtgggaaatgattggatttttcatttaagcattgttgggacaacttgttaaccatttggaaataaagcctaacctttgtcatcttaaaccattgtaaatgaaacctgactataagtagatttacaggaacatatataggagtatatgatgtgcagggagagaagggaagaattaactttgagagctacttatttaatctggttaaaggcaaagactggtttctccttttagaataagtcattgatagcttcctcaaggagttaaaaattcagtgcatcctatagtgaaataaagggatctggaagtgtagaataaaatttatttttgataataaatgatgattgaagccctgaaagttattcaaatgtttttgaaatgattggataaaaagcacattgaatgatctgaaaaatataagaaagtacaggttaagtatttaaaaagggggagaaaaataagaggttgaatattgtcatgacttggtgaatttgaagaaactaattttgaaaagctcataaggataggagaggtgtagtataaaatgacaggtagggattgtaactttggtactactgttaagaattaattccaaaccctagacaataaatcaattacaaaaatgttataataatcaggggagaaaacaaccaggtcctagaccaagttaaaaatggatagagaaaagaaattcaggagattgataacaaaggaagcacagagagtggaatcaaatggctaataaattttctggaatttcttagaaattccatttaaccatatgatatgcttagcagaaattgaataaagattgttaccttcatgttatttttttttctggctcttaaaatgtgcttgggagacagaacaataacttaaaattacagcttagttgaacataaggaatttttagtttttgccttttaatttatggcaaaaatgatagacgcctaattcacactgttaaattttagatggtctgtcttctgctgatcccaactctgattggaatgcaccagcagaagagtggggcaattgggtagacgaagaaagagcttcacttctaaagtcccaggaaccaattcctgatgatcaaaaggtgagtataagagattcctgggtgtttatttgttaatgaaagagacaggctgggcacagtggctcacgcctatgattccagcactttgggaggtactgtgggaggattgcttgagcccaggagttcaaggccagcctgggcaacatagcgagaccccatctctatttataaaaataaaataaagcaactgaaggagaattctgggtcacagaggctgacaccaattgagagcctcagggagacaataatagcatcagaaacagcaaacccaagttttgataggactggaggagagatagtggataatagcaacacgtggtatcaggaatggttttgctagggttggggtgttgtattttaatgatagggagattttggtatagggtcagcagtctttttttctttttttttttttttcggagacagattcttgttgtgctgcccaggctggagtgcagtggcatgatctcagctcactgcaacctctacctcctgtgttcaagcagttttcctacctcagactcctgagtagctgggattactagcccgacactatgcccggctaatttttgtgtatttagtagagatgggatttcaccatgttggcaaagctggtctccaactccagacctcaggtgatccgctcacctcagccccccaaagtgctgggattacaggcgtaagccaccatgcctggccttttttttttttttttttttttttgagatggtgtcctcaa

SEQ ID NO: 130666 - DNA, 1053 bp, Homo sapiens
tgggactacaggcgcctgccatcacgcccggctaatttttttgtatttttagtagagatggggtttcaccatgttagccaggatggtctcgatctcctgacctcgtgatccgcccgcctcggcctcccaaagtgctgggattacaggcatgaaccaccgtgcccagcctcagtgagtttttaaaacactaaagtttacacagctctctacttaggttgtagtgagtgatggatgacgtagacacactgagagaatgaggttccatgtattttgttattttttaaatatgtagttcttgatccattgtattacttattactagtttttatttagattttgggaaatgaagactgtacctaatgaatgaaattatttcataataattttctaaataatggacacataaccatttggttctctttaatatttttgcttttaacctaaggtctcagatgatgataaagaaaagggagagggagctcttccaactgggaaatccaaaaagaaaaaaaagaaaaagaagaagcaaggtgaagataactctactgcacaggtaaaatgtcagaacaacaagcattcattaagcgcctccggcttaaaatgtgaaaagattatgtacagatgttaaaaatacatagagataaaagacagtatgagacatcatttatttgaaaaatcatagactgttttacatattcaatacattatattgtaataaaaatgttattgctcaaaaaattcgtgttaaaggtgttgctaaactcaaaaataagtaaaattccaaattattcatgcatttttttattatataatggtgaaatgggaaaagagatacagtattttacacatacaaaaattccttttgagtaactggaaggtaacatttagcacacatagaaaaaccatgtgtataacaagtggagtctttcacttgactttgagtttgctggttatttcacttagaagtatcctttcctgcttttttggcatctacccaacagacattttctctttccatcactcatacatttccttttctttctttttctttgc

SEQ ID NO: 130667 - DNA, 1866 bp, Homo sapiens
tttcctctgttgcccaggctggagtgcaatggtgcgatctcggctcactgcaaccttcacctcccaggctcaagcaattctcatacctcctcctgagtagctgggattaaaggcatgcaccaccatgcctggctaatttttgtagttttgtagttttgggttttttttttttctttgagacagaatcacccagcctggagtacagtggtgtgatcacagtctactgcagcctccatctctcaggctcaagtagtcctccctgctcagcctcctgagtaactgggactacatgtatacaccaccacatgtgactaatttttgtatttttgtagagacagggtttcaccatgttgcccaggctggtctcaaattcctgagctcaagcaattcacccacctccgcctcccagagtgctgggattacagccatacaccaccatagattttaattaatgaagaatgaatgctttatataatctaataggttatttttctctataggacacagaagaattagaaaaagagattagagaagaccttccagtgaatacctctaaaacccgtccaaaacaggaaaaagctttttccttgaagaccataagcactagtgatccagccgaagtactcgtcaaaaatagccaggtaatttttaagaataataaagttgccgggcgcagtggcttacgcctgtaatcccagcactttgagaggccaaggtgggcaggtcatgaggtcaggagttcaagagcagcctggccaacatagtgaaaccccgtctctactaaaaatacaaaaattagccgggcacggtgatgggagcctgtaaccccagctacttaggaggctgaggcaggagaatcgcttgaacctgagaggcggagggtgcagtgagccgagatcactccactgcactccggcctaggcaagagagcaagacactgtctcaaaaaaaaaaaaaaaaaaaagaataataaagttttgttgactcaagtattttatcataaataatgttttaagcactgtgctaagcatttaaaatataatgactaatttagtcttcaaaacaatcccgagagaaaggtgagacgcattttataaatgaagctagagaagttgaataacttgcccagagtcatataactatcagtagtgaaatcaagaaccacactgtactgtattttctcctgctaaatatctaggcatacaagggatagacagcttagacatagagaaaatatgagtggtttcattttcccccaatatatgtacataatatgactatggttcagcctcccaaaatggaacatttgtttaaaacttggttataggctcttgaatgatgtgccttctatggaaagtatctgtatggcagaagggaccattttacaaaaggcctaggttggtgacacaaaatctgatttctaattgggtaaattaattacatcatataaattcagggctgggtgtggtggctcacgcctgtaatcccagcactttgggaggccaaggtgggtggatcacaaggtcaggagttcgagaccagcctggccaagatggtgaaaccctgtctctactaaaaatacaaaaattggccaggtgtggtggcaggcacctgtaatcccagctacccaagaggctgaggcaggagaatcacttgaacccaggaggcagaggttgcagtgagccaagatcacgccactgcactccagcctgggcaacaaagtgagactccatctcataaataagcaaccaggtgcagtggctcagacctgtaatcccaacactttgggaggccaaggcaggaggatcacttgagtccaggagtttgagaccagcctgggcaacatggctagactcagtatttaca

SEQ ID NO: 130668 - DNA, 1098 bp, Homo sapiens
cggatcacgaagtcaagagatcgagaccatcctggctaacacagtgaaaccttgtctctactaaaaacacaaaaaaaatagctgggcgtggtggcacacgcctgtagtcccagctactcaggaggctgaggcaggagaatcgtttgaacccgggaggcggaggttgcagtgagccaagattgtgccactgcactccatcctgggcaacagagtgagactccacctcaaaaaaaagttaatgaaaaattattcatttctatttgaaattcagtagacattttataatttcataccttcatttttatctcaacatatattcataaatgttgtaggtgatgattgatttggctgtatcactagagggcaggtatgagttacattgtttatctggaaaccatattagtattgaattgctgctaaaccacctcttggtattactgtgatatttaaactttatttgaaaatttcaccaaaaaacctgagatgattttttcctaaaatagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagagtaagtaatcctcattttttgttcctttgtactgtttacatttttcatgtgttaaggttctgatcttaaaagtctaatggaggccaggcgcagtggctcacgcctgtaatcccagcactttgggaggccgaggcgggcagatcacgaggtcaggacatcaagaccatcctggctaacatggtgaaaccccgtctctactaaaaatacaaaaaattagccaggtgtggcggcgggtgcctgtagtcccagctactcgggaggctgaggcaggagaatggcgtgaacccgggaggcagagcttgcagtgagccaaaatcgtgccactgcactccagcctgggcaacagagcgagactccgtctcaaaaaaaaaaacgtctaatggattaataagagtagccctttcttcctttgaaaatgctaaattctgccgggtgcgg

SEQ ID NO: 130669 - DNA, 4805 bp, Homo sapiens
tacctttagtatccattttacccatttttctcttttattagttaggttgagccatattaaataacagtttttttgggtcaaaactggttgaatatcagcagttccatatagttcaacctaataataccattgaaaggaaaggagggaagaagacatagaataacttaaaatatataacgagggcttgaaaacttaaacataaaatttgagtattttaaaacattgtttcatagttactacttttatattattgagacgtaacagtatttaccatcctcctaatttttttcttcgttttcccccttttcttttttagccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatggatagcattgttttttatttgcttcaatatgggggtagataatagctaaagagccaaggatgaatttcttcaaatgactttattctgttagctttacataggtgttggaggattcctaaggtgtcagcattttgtaaaggtaccacaaaggagaagttgatagggaatctaattttagaatgtgccaaatggtctgtgctcaacaatataattgaactctctcaactctacctcaccatttctttatctcaaaattctgttggctttgtcaaacgttggattttatttctgcagcctagtatctccccattctaccacctatgccagatgttaaagacagcagatgttttgaggagaatggcattgtggagatgcagagatgcgttgctaagttgaggtggatccagtatagagatacctctatttcttctttatggctcaagagctaggacttggattttgttttaagagatggcagctggccgggtgcagtggctcacgtctgtaatcccagcactttgggaggccgaggcaggtggatcacgaggtcaggagttcaagaccagcctggccaagagggtgaaaccccatctttactaaaaatacaaaaaaaaaaattagctgggtgtggtggtgggctcctgtaatcccagctactcaggaggctaaggcagagaatcatttgaacccaggagacggagtttgcaaagccaagatcgtgccactgcactccagcctgggcaacagaaggagactccgtctcaaaaaaaaaaaaaagatggcagctatataaatgataaaattaattacattctctttcacatgcatgaggtgcaaactctgtcacaaagtattttaattaccttttaccttgtttcatagatctttatgtgacataaaaacagtttctggcacggtggctcacgcctgtaatcctagcactttgggaggctgaggcaggtggatcacctgaggtcaggagtttgagaccagcctggccaatatggtgaaaccccatctctacaaaatttgcaaaaagtagatgggtgtggtagtgggcgcctgtaatcccagctactcaggaggttgaggcagagaatcgcttgaacccggggggtggaggttgcagtgagctgagatcgcaccactgcactccagcatgaaagagcgagactcaatctcaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtccaaaaaaaaaagtattaaaatgtgattgatgtaatttaccatgtttactttatgcatgcattttattggggaggggaggtcagaataattcacccaaatctagtggtcttatttcataggctaatctggtttatatttgcattaaagatactggagggcaatatttacagagtttagtttttcttaattaaaaacagtcctctattaatatagtgtgaaatatctttcaaaatttagagtttaggtttaagatgtctactagatatctttaagattttcctgtaaactcactgcacaaactggaattactttccaaaagacttagggaatgcaaatatgttactcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtagctgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaaaaaaaaaaattagaaacaaaaaaaagattgtttctctttcatattaaagtttgggaaggcaatccagagcccatatgacattatgcagggtcagggatccgggttctttctatattgttcctccccattctcaacctgtagctttttttttttttcttttaatgagatagggtctcactctgttgcccaggctggagtgcagtggcacacttctggctcacttcagcctggaactcccgggctcgagctatattctcccactttagcctcagcctccagagtacctgggactacaggtacacaccaccatgcctggctaaat

SEQ ID NO: 130670 - DNA, 1169 bp, Homo sapiens
gcttgaacccgggaggcggaggttgcagtgagccgagatcgcgccattgcactccagcctgggcgacaagagcgagactctgtctcaaaaaaaaaaaaaaaagaagtagaagggaagaaaatcgcaaggaactagactaaaagaatctcgacccttgaatggagttacacgaacggccagatgaaagaaggaaggcccggacctccactcagggccgactaggggactggcggagggtgcacgctgatggatttactcaccgggtgcttggagctccagcagctggctggagcccgcgatgacgtcacggactcgggtcacatggccaagtccgccccgccccctccccgtccccgccgctgcagcggtcgccttcggagcgaagggtaccgacccggcagaagctcggagctctcggggtatcgaggaggcaggcccgcgggcgcacgggcgagcgggccgggagccggagcggcggaggagccggcagcagcggcgcggcgggctccaggcgaggcggtcgacgctcctgaaaacttgcgcgcgcgctcgcgccactgcgcccggagcgatgaagatggtcgcgccctggacgcggttctactccaacagctgctgcttgtgctgccatgtccgcaccggcaccatcctgctcggcgtctggtatctggtgagcgcggcgcgcccggcccgggaccctgcgttgcttccgcgcccctagctgggcttctggcccggcctcgcggtggggtgaggcgtgcgctcatccgcctaaagttgtattattagaaacttaattctccgggtgccgcgtccgcacttcccccggctgggccagcgccgactgggggaggccaggagtttggggcgatgggggaggccaggggcgcggggcggagggccgcactcgacccttggcgcccaggtggtgtgggtcgccgatctccagcctccgcgcagccccgcggcctcgcgtagggcgcaccggggcagacaaactgagcttatctgccgagcacgtgtttcctttcttcttaaagcccgtgggctttgtgtttcgacggctgcggacggagcggtcgcggaggtgacggcgcatattttgcagctctgtggttagggttgcggatttgtcaatgctcgttctccctggccgcgtctccgctagg

SEQ ID NO: 130671 - DNA, 1016 bp, Homo sapiens
cccaggctggagtgcagtggcacagtcttggctcaccgcaactttcgcctcctgggttcaagcagttctcgtgtctcaacttcccgagtagctgggattacaggtgtgtgccactgagcccgtcctagctttttgtttttttgagacaggggtctcactttatttcccaggttggagtgcagtggtgcaatcacgcctcattgcaacctcggacctttcagctcaagtagttttcccacctcagcctcccgagtagctgggaccacaggcacacaccacacccagctatttttacaaattattgtttgtagaaacagggtcttgcttgtttgcccagtctggtctcgagcttctgggttcaagcgagccacttgccttggcctcccaaagtgctgggattacaggcatgagccaccatgcctggttgatacttttttgtgcacagagtttaggtctccattgtccatcctgaactcggctctgggctgggcctctctcttcatattcaaatatttaaaatgttctttaagacatgaaagggagcacagtcattttctgcctccacaccctgtccctccatgtctcccagtaggtctttgcctcttctgggggccatcctttgccttctgtccattgtctagacatccttcttgttaattacgtgcaccctgtgttctttgagtacgtaatggtgtcttagcctgagaatgaacaccagaaccgactgaagttcactcagagaaattgggattgcttctgctggtgtggcagatcgttttgcacgctagccccttgtcagattgggagtgctgtctggagcactcccttgaaaggaattttgagcttgctgccagggattggtttagcagagttggccagggcctgtgaatggggtgtggtggcttcttgggaggaacctgggttactggtaagagcgtatatggcatttgtaatcaaagcaccaacaattgaatgtcagttgaaaactttatgcacctgtattttatgaacatggt

SEQ ID NO: 130672 - DNA, 1354 bp, Homo sapiens
atagggtaactacctgacgttgccatggcatttgtaaattgtcatggcgctggtgggagtgtcttttagcatgcatgctaatgtattataactagtgcataatgagaaataaggacagccagagctcacttttgtcaccatcttggttttgatgggttttggccggcgtctttaccatcacctgttttatcggcatggtctttgcgacctgtaccttgcaccgacctcctatctcatcctgtgacttagaaggcctaacctcctggaagtgcagcccagtgggtcttagccacattttaccaagcccctgttcataatggagtcgctttggttcagatgcctttgacggagaaggtaacttttcactatatattctttgtacagttcaggtgtttggttaaacacatgcttgtagtatctgtttaaattagttatatgtatatgtatactctgggaagtggctcttctcattattacaatttttttcgaaaagcaatcagcttttatttgacaatttggaaaatacaggaagaaaaaaagttattccggccaggcacggtgcctcacgcctataatcctagcactttgggaggccgaggcgggtggatcacgagatcaggagttcaagaccagcctgaccaagacggtgaaaccccatctctactaaaaatacaaaaattagccgggtgtggtggcaggcacttgtaaccccagctactcgagaggctgaggcaggagaatcgcttgaacctggcaggtggaggttgtagtgagccgagatcgtgccactacactccagcctgggtgacagagtgagactccgtctcaaaaaaaaaagaaaaaaagttacttcgaatcctacaataatcctgaaataaccaattgggattgtcatttaaaaatgaacttttttttttcttcccctgagacagggtctcactctttcacccaggctggagggcagtggcacgatctcagctcactggaacctctgcctccctggttgaagtgattctcctgcctcagcctcctgaatagctgggattacaggcatccaccaccatgcccaactaatttgcattttaagaaatagggtttcaccatgttggccaggctggtctcgaactcctaatctcaagtaatccacccaccttggcttcccaaagtggtgggattacaggtgtgagccaccgtgccgggccaaaaataaactcttgaatggatgttctgtaaaacatttacacttcctttaaacaggtatttccaagtatgtggatttttgtttatttggttttgagggaaggtcttactatgttgctcaggttggagtgcagtggcgcatcagctcactgta

SEQ ID NO: 130673 - DNA, 1149 bp, Homo sapiens
aactgcttcctagatggcttcaaagctctcaaagctccactagtttgaacctgtaaaatgtttgattaactgagacaacttgggttgcttacctttagctctagagtgtagctgactcactggaaagtttttgtgctttttcaaccactggcgccagggctgatgcctgtgtttgtgtgtgttgttcactgctctatggtgcctgggccagggggaatgaggtaaaatcctgctgttgtcttcactccaagccttgtgcacttggctgcaactgaatgggctggcagcatttctgccttgggaatgtttatctgctccctccatgggtggggcttagtgttgagagtcaagccactgaagaagttgcctgtggccagcctgactccatgtggtcagtgtaattttctattataaggattgcatcctggggttacttaaattcttttttttttttttttttcttgttgcagatcatcaatgctgtggtactgttgattttattgagtgccctggctgatccggatcagtataacttttcaagttctgaactgggaggtgactttgagttcatggatgatgccagtaagtagtagatatttgggtattttcaagggcagggaatctgactgccagcacttcctattaaattacaaatatagactcgtgagttcatttgagctgatatataacttgtcattgcaaatcaacgaatatttgtgtgcgtctaacattctgtcttctaggtgcaagagtctaaataagatctattttcatcttatgttaacttacccacttaaaaatgattgcattatcatagactttctaccctgggccttttggccttttttgagaggaaggggtataaatgccaggaaggaaggtgaaaaggcttgtgcttatctccttgtgtcttctattatgtttcagtatttatttttattctaggagtgatccttttccattctagaaatgatgttgcagattatttgggggaatttagggccttttcccagtgaatggaaatatgtacagggatgtggatgtggggtaagcagggaggaagctaggctcccagcttgaagatcactgcagcctcatcattttataatcattatgccgagtccatgccaaaggagaggagtagtgctg

SEQ ID NO: 130674 - DNA, 1835 bp, Homo sapiens
agtagctgggtcagcaggtgcccaccaccacgcccggctaattttttgtatttttagtacacatggggtttcactgtgttaaccaggatggtctcaatctcctgacctcgtgatcgccctcctcggcctcccaaagtgttgggattataggtgtgagccaccgcacctggccggagtttttattttaaataagatcggaagctatgaaggctttcattagagctttgaggcacacatgagtttacaaaatagaagttagacacctatatatctataaagtaatacctaattcattatttatataatccagtggaccagaagaacaaacattaaaaaaatctgtaaaccaatatccctttttctattttgaaataatctcttagtataaagtatttactaactttatgctagtttatttacaaaatgcctttgagaagagactgaaagtattcagtggatccactactgattgtcttttttaaagaaattctttttaatctttcggcagacatgtgcattgccattgcgatttctcttctcatgatcctgatatgtgctatggctacttacggagcgtacaaggtaagccgcttgcagtaagatgctggccttttccttggtctcttacatgtgtaatctgtgctgctgtctatagtgagaagtgactttccagttttctgttaagaatctctgtttaaatctctcgtttgtattatgtggtactaggaaaaccaatattatactggaaatttttttttttttgggaagacggggtctcactctgtcacacaggctggagtagagtggtgtgatcttagctcactgcaatctccgcctcccaagttcaagtgattctcccacctcagcctccagagtagctgggactacaggtgtgtgccaccacaccttgctgatttttgtattttttagtagagacgtgatttcaccatgttgggcaggctagtctcgaactcctgaccttaagtgatccacccacctcagcctcccaaaatgctgggattacaggtgtgagacaccacacacagccagtcctggaaatgttcactgaagcttatttgttgactgcttatatttggcatactggtttccaccatgacctgggttaatgaattccaatttttccatttcctttcagattaataaaatactttgaatttaagaaaaatattgttttataatattgaacacattaactttctattttctgttctgtttagcaacgcgcagcctggatcatcccattcttctgttaccagatctttgactttgccctgaacatgttggttgcaatcactgtgcttatttatccaaactccattcaggaatacatacggcaactggtacgtggacctcttactgctccttttcattaattcttttcattagggaagctggttaagtaagggatgtgtagagatacacagacattaatttcaggatttttagcttgcagctgagttactcataggaaatttcttttttcttttttttgaggtggagtcttgctctcgtcacccaggctggagtgcagtgatgcgatctcggctcactgcaacctctgcctccagggtctcagcctcccagctagctgggattataggcatgtaccaacatacctggctaattttgtatttttagtagagatggggtttcactgtgttggtcaggctggtcttgaactcctgacctcaggtgatccacccatcttggcctcccaaagtgctgggattatgggtgtgagccactgtgcctggcctgataaagttttgagggccggggttatgattggtggcagtgatggtggtggttgatgt

SEQ ID NO: 130675 - DNA, 1187 bp, Homo sapiens
ctgtgagataaatttatatgctatgaaatttttaaaaaaatcgacttgtgtaataaaatcacagataatcatatagaagaaaaatttccaaagaagcagttaaactgtggcaataaatgagttaatacattcgattgttctgtgaattcaggagcgataatgttaattgtgtgcttgttctttccagacacttattcttagaaatttctcattcaactctcatccctcccctctcccaacttcccccagtaccacccccatacccccattggtgtaatagaatacggctccagtagcacattgtgccaagaagttactatacccaacatttgtactttcagggacttttggtttagtagagctgttataatatgtgcatttattgcttatgtcaataaaagttttataatatggctttatctgtgtggtattctaaattacctgcagtttgaaaattaaaaatctgataatcactcctcattttcagggttacttgattagctgtgtttggaactgctaccgatacatcaatggtaggaactcctctgatgtcctggtttatgttaccagcaatgacactacggtaggtatgatgtcacttatggtagagatctcgcccacacctttactgtatgctgatctttaagtgtttctagtgtttgctacatttttattgttactgaaacatactcatgagctgcttagttatcaaaagattcatcttagttatcaaaatactcatttaactatgaagttaaatgtattttgtttttcttacaggatattaaaatgtagatggctcaactctggtttattttaaaatgtattacagatagataatatatgtaccttactgtaattatttatcttaaacctgcattgttaaaccatggtgtataattctagatatcgcttctgcattgtatgacattatattaactcactttatatgtgaagttaaaccaagatgcgatgtttacaggtaggtaaaaaagaactgcaaagttactatgtctttgtaatttatcttatgtatgtattcttagtaaaataatttagatgatctctgttctgctactagttgctcatactttaaaattgcaaacctgtcataaaagatttttgaaaacatgtcttcactggaagagtccatgaaaacatatgcactttatgtaaattatcttgaa

SEQ ID NO: 130676 - DNA, 2235 bp, Homo sapiens
agccgaaatcagccagtgtatagaccgccaactctgaggtatccttatttcatagacatggaaactgatgttaaggaacttacccaaggctacgctgataaaatgtgactgacccaggctttgaatccaggctgataccaaaagcttggcgttttcactgcactttgcagttctcaccatgagtggttactgtagtcaatcaagtgcctgccctatttgtgtgtgcacatggacacactcacctaggggtcttttttcctcttcagagccatcaccatttcttttagagtcaccgacctctggccatccagctacacatggacagggttagaaaaactcaaggcttgagagtcgctctccatttgctcctttaaggattcaaaaagtcttttaatgaagtgtatccacttgctagaaaattgaacttggtacaagttgtggaacatgtttagttgcataaaagttcagtaaaagctaaacctcggggaacgtgtgtgctcttcaaacattaactcttgccgtccctctttcttctcaggtgctgctacccccgtatgatgatgccactgtgaatggtgctgccaaggagccaccgccaccttacgtgtctgcctaagccttcaagtgggcggagctgagggcagcagcttgactttgcagacatctgagcaatagttctgttatttcacttttgccatgagcctctctgagcttgtttgttgctgaaatgctactttttaaaatttagatgttagattgaaaactgtagttttcaacatatgctttgctggaacactgtgatagattaactgtagaattcttcctgtacgattggggatataatgggcttcactaaccttccctaggcattgaaacttcccccaaatctgatggacctagaagtctgcttttgtacctgctgggccccaaagttgggcatttttctctctgttccctctcttttgaaaatgtaaaataaaaccaaaaatagacaactttttcttcagccattccagcatagagaacaaaaccttatggaaacaggaatgtcaattgtgtaatcattgttctaattaggtaaatagaagtccttatgtatgtgttacaagaatttcccccacaacatcctttatgactgaagttcaatgacagtttgtgtttggtggtaaaggattttctccatggcctgaattaagaccattagaaagcaccaggccgtgggagcagtgaccatctgctgactgttcttgtggatcttgtgtccagggacatggggtgacatgcctcgtatgtgttagagggtggaatggatgtgtttggcgctgcatgggatctggtgcccctcttctcctggattcacatccccacccagggcccgcttttactaagtgttctgccctagattggttcaaggaggtcatccaactgactttatcaagtggaattgggatatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgtatgcgctttttaccttgactacctgaattgcaagggatttttatatattcatatgttacaaagtcagcaactctcctgttggttcattattgaatgtgctgtaaattaagttgtttgcaattaaaacaaggtttgcccacatccaagatgaccttgtgattttgtgctgattgtgtctgaggacctttccctccacatatggtctggcagatgcacccagttcagcctaaggagtaggcttttttttgggggggggaggtcgggtgggggggatttttaatcttttaattttcaagatggttaaaatattgaaatgtttaagtggataactatattattcataaaatgactgagtgaaaactaatacactatgagatgaaaagtacttgtcagggattttcaagcttttgctcaagtaattactatgaaataacaatttctagaaatgaagaacaatccgtggagaataaattaccattggtgtgggggaaaaaagccaaacagaagtagaaaaaggtgtagccggcatacaaatgttatctacagtgtatttttagattttttatacttgaccaggtctcttatgtcctttttctggaaaactgtttttaactactaaagtgattataaatgaaaaag

SEQ ID NO: 130677 - DNA, 1108 bp, Homo sapiens
atggcatagggcaagatctataaataagcaaaaggcccagtccctgtcctcaggagctcatggtccaagtcaaaatcacataaaaacatttgagtcccctttgaaatgagtattgttttcttgaacaaattttcaacttgctgtagtttttttcctgatcactttcatcctgtctttccaagatgggatatgtttatttagaaattacttcacctgggacagctgcttctctcttttgctcaggcccgtagcactgcaggatgggcaagtgtcgtggacctcatactgctaggagtctctgtagtcaccaacaagatcagaagtggcatgataaacagtacaagaaagcccatttgggcacagccctgaaggccaacccttttggaggtgcttctcatgcaaaaggaattgtgctgggaaaagtaggagttgaagccaaaaagccaaattctgccattaggaagtgtgtcagggtccagtggatcaaggatggcaagaaaatcacagcctttgtattcagtgatggttgcttgaaccttattgtggaaaaccataaagctctggttgctggatttggtcaaaaaggtcatgctgttggtgatatttctggagttcgctttcaggttgtcaaagtagcctgtgtctttcttttggccctatacaaaggcaagaaggaaagaccaagatcataaattttaatggtgaaaacactgtagtaataaatgttcatatgccaaaaagaaaaaaaagaaattatgtcacctgggacaatggtgccatcagtcagcctgtcctcaaaggaaccctctggacatggacccaactgtccatgtagatggggtatcccaaagggagctctgccctgcctacagggttcccctccctgggctggagtccaagctcatccactaccttggaacattcccttaaccctgcatctccagctccaacaaatgggcagctggccggatatgaagatgtttcctctcctggccttctacttgagggagacagggaggagctctaatagtttacataggactcaaacactgtctgtcacctagggaaacagtgcacgtgagatgacattgcaattttacatgtctcc

SEQ ID NO: 130678 - DNA, 1043 bp, Homo sapiens
ctgagatggcgccactgcactccagcccaggtgacagtgcaagactccacctcagaaaaaaaaaaaaaaaaaaaaaaaaggcaggagtgcttttctaattttcatgaaggctcctgtggtttagcatatagccctgggttggggcagtagatgatggatctgcagatcccaggaaggaggacaagggggagcattcccaagacccaggcaggccctctccaagagccacacctgcccgacccttcatgtctgaacttactgcagggagagtgtgacccaataatctttacctgctgagaagaggggccaggcttagaccctgccatggaggaggatattaattaaggcacctttgaagggagggaaattcacacaagactcgcactctgagaactctcttcctttggagatctttggaagtagcagagcctccttggattgggcctttattatgggtcttagtcatggtgtcaatatctatccaagcatcacaatcaatttaaagggaagcctggaagttccatggagaattgtgtgctaaactggattctctcccttcaaaacaaatgggtagtttccacaacacctgcacatgtacaaaaacgccacaaaggttcaaaatgttgttggaggttccaagaaagctgtaattctgagttgaaaacaccaagtcctggcagcccaagtaactgaattttcttcaaaatgtgtccttgggtcccttgagggctcagaaccacagtctcatagcttgtccctgaaagggctagttcaatggttctcaaactcaagtgtgcatctcaactctctagaggacttgttaaaaactaagaccaggccaaatgcacagtggctcatgcctgtaatcccagcactttgggaggccgaggcaggcagatcacctgaggttgggagttcaagaccagcctgaccaacatggagaaaccccatctctactaaaaaaaaaaaaataataataatacaaaattagctgggtgtggtggtgcatgcccataatctcagctattcaggaggctgaggca

SEQ ID NO: 130679 - DNA, 1227 bp, Homo sapiens
gcggaaaatactacagagtgtgcacactggctatcattgatccaggtatgctttttaaatcataaagtcttttttttttttgcctttctaatgtaatgtctggacaagtatttcttactacgcaaatgtctttggttcctaaattcagatagaatatggatctagcaaggcatatcgtgtagttgtattttgtagagaattggtaatgaatgccaatacattataattggctttattataagttaaaatttttactgtcagataatgaatttcatttgatgaagtacctatgaaataatgacatagatttggtaaaaggtgaaattataaggagagaataatctggcaaaacagaagaaagtaattcttgcttcttgagaacagacatgtaaaattagcttgagaaaaaaaaaagtgccaaaaaatctacatcattctgttttccaattgtgaatctttgattcatagaatactgcgaatattctcgctgttctgattttgtaatagtcaggacaggctaaacattcgctatattaagaccatgcatgtgtccccaaacctagttctttccctaggtctggttttataaatgctggtgataaaccaattttattatatgatcattttatgtgattatataatggctgtgattctaggttatctttggtcaaccttaagaaaaatgacagtacagctaatgtgataacttttgcaaaaagtcagtgctaatttgcagaccattgtctacagaagggataaccaaaggtagagaaattttatggtaccagttgctattaaatgaattgtaaaattactgtttttttatttttattttttaggtgactctgacatcattagaagcatgccagaacagactggtgaaaagtaaaccttttcacctacaaaatttcacctgcaaaccttaaacctgcaaaattttcctttaataaaatttgcttgttttaaaaacattgtatctatttcagtatttttctctatttttgtttcaatacaatttcctgaaggttggattagagaggatgaggcagatgtggtggcaagacttttcagtaaagagttacacatcctgggccgggcgtggtggctcacgcctgtaattccagccctttgggaggccgaggcgggcggatcatgaggtcggaagatcgagaccatcctggctaacgcagtgaaaccccatctctactaaaagtacaaaaaaaatta

SEQ ID NO: 130680 - DNA, 2733 bp, Homo sapiens
gcgatcatggctcactgcagcctcgacctaccgagctcaagcgacctctccgcctcagcctccggcgtagctgggagtagctaggactactggagcgcgccaccacgcccggctaatttcttttttatttcttttttatttttttgtagagacaggggtggtctatgttgtccaggctggccttgagctggacgcaacagatcttcccgcctcaacctccgaaagtgctgggattaaaggtatgagcagccgcgtacggcccccgcagccattctagctagcggtaccaatagcaaccggcagctgccctccgcttttgctccgccccttctgcttgcgatctgtttccgcttccggtcccgcagttccggctctgccgtgaagagctttgcattgtgggaagtctttcctttctcgttccccggccatcttagcggctgctgttggtgagtgggctcctaccgaccgaggtttaggcagcgcggggagctttgcgggttgccatttgtaactccggatcctaaaattcctgtcctgttctctgtctcttctaggttgggggccgtcccgctcctaaggcaggaagatggtggccgcaaagaagacggtgagtgaggcgggccaggcccggaagacgattcacgtggagagatgtcttggccagggcgggcagatgtgagcccacgggggtgacagcatgcctgctggcatttggagggccccagaaggaatcccagtggccctctcaatgacttggggtcctcgacttcggaagtttaaggggctcggcttcaaaaagctgggtccggttttgaggcggttgcaggcgaggcccttaggtccgtatttaatgtttgctttgtagaaaaagtcgctggagtcgatcaactctaggctccaactcgttatgaaaagtgggaagtacgtcctggggtacaagcagactctgaagatgatcagacaaggcaaagcgaaattggtcattctcgctaacaactgcccagctttgaggtaatcgaagagactgaacgggcttcgcctaccgcgaattcatcgtgaacgaatatacaggagtgtaaacttgtaatctgagtaccatgaactcgaacacttgcaggataattacggtagcgattgtggtgtttggcccttcattcccgtctccccgacccacccccaaatcgtgtgctccccttctgtgagcttatttttggaggagaaatgtgtgtgtgtggcaggagtgaaaacagaacatcgaggtttaatggaaacacagacacattactgttttttccatgtattttgtgtcctgcttttttggttcttttagctttgaggtgctttaatgatgcttcattgtgtgaacttgttttagtgtcaaaaaactaggtaagaaaagttgaggctgggctatggagttgcaggctatcatagaatcacctagtttagcccgctaaatcagttctgagtcaagatttatgcttgactcactgttttgaaattgaacttagggggtgttgtaaataagccaaacaaacttggaccttgcagagtataagctatgtgagcaaattttctgtggtgatgcataagctgcttacagcattttatatagggtgtctgtagttaccgtcaaagcctggagggccctttctgtcttgtcccatgggttcggcttttccctaaccattctttgaaactttctttaaagcctgtcttctatagtagtgcttctgaaacatgactgtgcaaaggagtcacatgggtgatgttaaaatgcaagttctgatttcattggatctgggatggggcccgaggtgccatttattattttattttttttaagacagagttttgctcttgtcaccccggctggagtgcaatggcacaatctaagctcactgcaacctctgcctcccaggttcaagcaattctgcctcaccctcccgagtagatgggattacaggcacctgccaccatgcctggctaatttttgtatttttagtagagatggggtttcgccatgctggccaggctggtctcggactcctgaccttaggtgatccacccacctcggcctcccaaactgctgagattacaggtgtgagctaccgtgcccggcttgaggtgtttttttaactaatacattgtagcactattgctggtatgtggattcacataattgagtggcaagatagtataggactcctttccgattcctaaaaccattagtatctactaatttgacgctgaaattttgtatttttagtagagacaaggtttcaccatgttggccaggctggtctgacgctcctgacttcaagtgatccggcctcccaaagtgctgggattacacgcgtgaggccagaaattttaactctaaaacggtatcacttcccatctggaattctgggcactgaggggatggtgatagaaatggcttatcttttaaaggtttagattctggatcctccacttactattctgtggctcagtttcattagattaaaaaaaaaaaaaaagaatagggctgtgtgccgtggctcacacctgtaatcccagcactttgggaggctgaggcgggcggatcccttgaggtcaggagttcgagaccagcctggccaacatggtgaaaccccatctaccaaaaatataaaaaattagctgggtgtggtggtgcacgcctgtaatcccagctacttgagaggctgaggcaggagaatcacttgaact

SEQ ID NO: 130681 - DNA, 1404 bp, Homo sapiens
ttttcactggttctcacatggtggaaggagcgagggtctctgtgagcactcctttataaggatactaatctcattcatgaaggctctaccctcatgacctaatcgcctcctaaaggccccacctcctaataccatcacctcgggggttaggatttcaacactggaattttgggggacataagcattcagaccatagcagggagcttagatttgaaattcatgttgcaccgtttataggagaaaatttcacctgtatctgttatatccaaggtcctttatatgtcatcctgacatgattaccttgtgtgctacctactagctttgtgacctcgagcaagttaattcaccttcctacgtaagattcctctttaaaaataagtagtaatagccaccttacagggtgactataggattaaaaacatggtcaatgttgccacccaacaaatattagttctccactataatgtttatctctgataaaggtgacatgtttctttttgaaaatatactagagcctcatcctggaacttcacgacagcggcaaaccagagtcaacccccattctctgcctgaccctgaagtgaatgagcagtcttcctccaaagggatgtttagaaaaaagggaggatggaaagcaggtcccgagggcacgtctcaggagatccccaagtatataactggtgggtactcataaagaggtgcagtttgcttgtattttgaactctcgtgtctagtgcagcaacaaactgccctccttgtggtcctggctctgcctcccctacctctcctctcctcctcctactttagacccttctcgcctctagcctggactttggccagagcttccttgggcttgatggctctcccttcttcagtttctctccctgtctcttactcttcttcttacaagtctttgtgaactgttcctctttgtcttagcccccgtgcccctcttgttttaaatatgccatccacactcagcacagcattctccaaggatggaaaattgagtacacacaaatggcaaccaaacctttatttaaagggcctgtctccaggccctttccatcctcttctgttcttcaccctatgatccccatccacactaccacaattaaaccctatattccttgtaccttgtacctataccttagatatgctttctggtctctctttacgccttcttggtggaggaattcagttaagtttccccagcagcctgtttattctccagtgttaattcaagattggtgtttaatgactttgtcatctccttcaacagcttctacttttgctcaagcacgagctgctgaaatcagtgctatgttaaaagctgtgacccagaagtcttcgaattcactggtttttcagactctgccacggcacatgcgacgaagagccatg

SEQ ID NO: 130682 - DNA, 1055 bp, Homo sapiens
ctcattcacattgaggaagctgggttctggagagatgaagtgacttgcctgggctcacacagcttgttggtggcctacatagcacttgggtggctgattcccctggcttgtgctttttccactgtcctctgccaatgagttacttttcattttgggcataatttttgctgaagttatcagatattttctctaaaatttgatcagccctaagtaataaaactaatagctaataataacaaatattagtgagtgcttaatatatgccctaccctgttttaaatggtttgcatgtgtttactcatttaatcctcagaatagtacgaagtaaggagttaccattatttccattttacagatggggaaactgaggtacagagaggttaggtagtttacccatgattgtatggccaatgagtgttgaggttcagatttgagcccagttgcctgactccagggttccacactctgaaccattattctctgctgtcacttgtttgggtgaggttcctctggccactgacagctgagagctggtcactggatgggaagatttctttgtgtgagtgatcatattgattgacatgcgttgtcagaatcatagctataatttcccttttagttctagttactgagtgcactgaaattgcttaaagatgctatagcagaagggttggtttggcagatcactgagcctgattagaatgctggcttctccacttaatgactgtgtctttgttcaagtaacaatctctgtgtcacagtgtccttgtctgtcagataagataaccatactaggtacatctggttgtcaggaagactaaatgactgttcatgtaaggagttaactcattgctggcactcagtaacccttcaatgactattaactattataggccaggcatggcagctcatgcttagaatcacagcattttgggaggctgaggcaggaggattgcttgagccctggggttcaagaccagtctgggcaacatagtgagactctgtctctgcaaaaaaaaaaaaaaaaaaaaaaaaatctgggtgtggtggctcgt

SEQ ID NO: 130683 - DNA, 1033 bp, Homo sapiens
tggttcgggttggtttaaaaatatttgttaaggtgacaggaatggacaggtttagatattttttccactaaaccatcgggcaggagaaggtttagattttgacttatgagaacatagctttagcaatttgttttgtgtcttaggcctctaaaggttttgtgatacggcttttggcttcttagcagttttgcctgtgtaaattcctaagtacttaattgtgtctcccgctttgtgcaggatttatcctattactgttgtttggagttgaaaggcaaagaggaagaaatactaaaggcgctttctggaatgtgtaacatagacacaggtaaacttgttttaaagctgagttctattttagtctatgtatatttattcatttcataaagaagtgtctactgtaagcattttggaattcaaacatatagaaaagtgtgtgagacactaatcattcccaatgaaaatgttaacttaaaaacagttgggttggcttttaaataatttctaacattgtcaagtgtaaagtgatagagtcatttttctggtggagtgaacttgacagaaagaaacttgaagctctcattactcatttaacacatatttgttgagaacttattgtgtgccaggctttgatctgagcaatcctcacaaccaaaacttcacctctcatggaggcagacagtaaatgacagtgtggttatcaggaaataggactgcagtctcaacacccggaattatggaattttgcttttgttgatgtcagggctgacgtttgcagcagttcactgcttgtctggaaagcgccaagggagccttgtgctttatcgggtgaataaatatcccagagaaatgcttgggcctgttacgtttatctggaagtcccagaggaccccgggtgacccttctgagagcaggcagctgtggatctggctgcatccaacccttaaacaggtataatccttcaggttatctcccgtcattctgaaactgcatttttaattactgctggaagtcaatactgtagaaatgtaaatag

SEQ ID NO: 130684 - DNA, 1095 bp, Homo sapiens
ctccatcttcactgcttctgctgtactctcaaccagtgttgtctcttgcctgaacaattgggggatcaggaaaggattctagagggaaccttaagtttcctccatccttcctccttttcagcccattctccacacaagaggcagagtgattttttgataatttattccctcttgttgcttcctgatgaaaagtttttgaatagcttctcattgtaattaagataaaatccaaagtgctcaatgtgacccgtgtaatcttgtgccttcttgcctctgaggcctcatttctcctcacccttctacacttcagccaccctgaccttctttcaggttctggaatgtcagttcttgtctcccttagagcctttgcacctgttttttccttccaactactgagcattctgcctccaccactctttactttgctgaaccttcctcattcttcagatttcagtctctagcatttccctctagcatcctttcctgatcccccaagttaaactagatccctcctgttgttttcagagagagcatcttgcaaattccctcaatttatttatatagatttgtgtatttatgtaatgtccatgtctctcatgagactgtgagcttcataagggtgaggatagagttggtcctgtttttcactctctccccagtgcttagcacaatgtctggcacagagagggtgccccgtagtagctaataagttgtggagcaaagatttgaaccaatgaagtttggttccagagcctgtactgtaaaccactaagctgtgctacctgagtttctgtgagtaaatggtacctttgttatgattgctttttttttttttttttttgtttgagacagagcctcactctgtcacccaggctggagtgcagtggcacaatctcagctcactgcaacctccacctctcaggttcaagcaattctcatacctcagcctcccgagtagctggaattacaggtgccagccaacacacccggctaatattttttgtatttttagtagcggtttcactatgttggccaggctggtctcgaactcctggcctcaagtgacccgcctgcctcggcctaccaaaatgctgg

SEQ ID NO: 130685 - DNA, 1015 bp, Homo sapiens
aaacaaatggtatgttcatattctaagtaactggcattctgatagtggagataaatgcatacaccaggtactgacctaaactctatgcttacctgcacacaactgcatttttgctcatagctgctgtagttatcactgatagaagcatatgtgttcatttcataaaagaacctttttttatgttggcctcatgttttttgcaagaaacctcattctttatgaatgttaacttattctctaaaagtatcaatgggaagagagggaatacatgtttttaagtaattagtccaagaaaaacgtttcattaggaaatctgaaagatttaaaaatacaagcaaatacagatgtattatgaatgactttctgtaaacttctttttgttgttgttaaaggaataacatcaccagcagaaattccggcaggtactattctgggactgacagttggggatcctcgaataaatttgccccaaaagaagtccaaagctttgcccaatccagaaaaatgccaaggtaaagttccaaaaacaccccaggttttccttactatttcgagcagtccagtcttattagaagaagagttctttctctgacacctctccagtaacttcatctgtaaaaaattagggcagtctccttacctgcccactttacaagctgattatgatctaaggaaatggtaggtgtggaagtgtcttttagcagtaaaacacgtagcctgatacttatgttcattttattttccgagttctctttttttagtatctagtaaaacctgtctctctgcaaactacgttctctgaaaatgtctggcgtttcagaattttaattgtgaggaagggatctgcacccgaagctggtcttgtgctcagtggaagcctctgtctgaccatacagatgatccaggttcgaatcctggcaaggccatcccaggtgctgaagtataagatgtcttggtttagactaagtagtactagaggcctgagaaagttgtttggctggggtggcacaggagg

SEQ ID NO: 130686 - DNA, 1022 bp, Homo sapiens
agattggcagcaattttgataatgtctcattgtatttactgtcatttaaacatgattaattggaagaataattaaaattaccatgtgagtctttggagataaagtaaaggtttgtgttgtaacgacttcagaatttttttttttttgagatggaatctcgcttttgtcacccaggctggagtgcaatggatggcgtcatcactgcaacctccacctcctgggttcaagtgatttgcctgcctcagcctcctgagtagctgaaattacaggcatccaccacaacgcctggctaatttttttttttttttttttgtatttttggtagagatggggtttcaccatgttggccaggctgatctcaaactcctgacctcaggtgatccacccacttcagcctcccaaagtgctgggattacaggcatgaaccaccacgcctggcccagaattttttttttaatgtagttagatagcttattgatggggcaataaattactctgtcagaacttcacataaaaggtggattggatgagagaggagtttgaagatatataggtaagttagttaattatgaagcctaagactttactcaatgagtcattgcctctttcttttcttttcttttttactacgaatgtggtctggtgcaacgtaaaagttgcagcatttactacaccattaaatgttgactattataattgccttgaagctataaactctacttagtttctcttgctacctcaaatccttttttggaatgaggtgattattaaatcctctctaaggcttttgttttaatatgaatcagctcaaggaaaattaaagtctatcttgaaaaacgtgatttaatttgacgcctgaagtcaagcaatccttctgcctcggcctcccaaagtgctgggattacaggtgtgagccaccattcccagctagagagcttttaaaagggaaggtacatgaagaaaatgaagtgataatgcatattcttagatgctttgaaaaagtttgcttgatagctggttct

SEQ ID NO: 130687 - DNA, 1551 bp, Homo sapiens
gatgagaaaaatgaggccagcctcctgatggaagagcaggcatttgaactgactctcagatgggagccagaagtcaccagacttcttgggggcagggtcaaggtttcagtgaagataagattgcaggaagtaagaaaagcatgtacaggagcccaggcaaaaaccaggaagactctacaagtggatcaggagctaggaatcaggaatggggtgagagaggaagctgaagacacaaatggggctacagcatgaaagaccttgaagccttttcaggatttggactggagatgtgggacacccttgaaagttttaaggttggctgtgacatgatgagatttcactctgacagcagtgtggggttggagatggggggtgaggaagctggagagagactgtgggttggatggccttaaaaagacccttgaaatattctaggtatgacataatgggggcctgaattgtggcagtgtggctagagtggagagggtgatgtttaacgcatattcctggaaggtgaaattgacaaggcttggtggttggttggaagataggaggtaagaaaggaggaggtgtgtcgattaggtcctgatattctagcttggatttaggatttcagctaaaagagagccagaaccatgtcttacttgctcactgatgtatttccaggttctagaaaagtgtgtggcacatagaagtgctcagtaaatatttgaatggctgaatgaatggagtgtgtgaattgtggtgtcattcagctaggtgaggaatataggaagagagcaaatacagtgggaagggtgatgagttcaatcttgagcttgaggggctgtgggacttcccaagagcagaggtccaggagacaggttttgatcccgggaggaaaagtcggggctaaagagatatagtttggaattactaacacatagatggtagtggaaactccgaaagtgaaaaagaagaatcaggattggacctggcttgaagagcgttcatgaggtagcagttagactatggcctggaggcagtctcttgcatagtttttctaaacagtgatagccctcttacctacctgttaatctctttttacagctccaagaaaagtctgaaaggatgttatccaccccctacattccccttaacaataattttaaacatcttctatttaattcttgaagatctgatgagcaattttctcaagaggcagtgcatttctctagttgcccatccttgagaaggtgtcacttaattgtttatatcttttttacttcatgacaccaaatcttaatcaaaatcaatgtaaggacagaatatcaacatacaagattaatcttgatataagagatcagcagaatgaatactgataatgaatgatataagataatttcgaatttctacctaagcacttgtatagaggaaaatatctgtaggaggaataccttatacttaaaatggctcacatttatttatttagaacgtttttctcttgcttttttaaaagagcatttaattttctaaagctgcttatagggagacccaggaggatctcccaga

SEQ ID NO: 130688 - DNA, 2437 bp, Homo sapiens
gtgaagatcgactaggctggggaagtggctgggatgtcctactcccaaagggctggggcatggctttctggattccatttgtaagttactttttgattctaacagttgcaatatttaaaatacattcctaataaatgctaagtactcaaaatgttccagactttatgtacaacttaggaggaattgagtggtgtatttctgcccttagagctatagtcctggatacaagatacttcatacatatagtccctggagccaggttctcattataagacctgtgctgacatatcgtcaattgttgaggtttttaaagtggcctgatattcgaatagtagtggcaacaaaaatgttgaggtatttgatttgaagaaatttgttataagtttaaaagcaaaggacttaacttttacagatggatagaatacttttttttttgtttttgaaatgttaactataaccatatactcctatttatcaactgcagctaaaaattttattagaatcgaatgtgtcttttttttcctggttatttcaaatattactttgaaggctgggtgtggtggctcactcctgtaatcccagcactttgggagaccgaggtgggcagatcacttgaggtcagaagtttgaggccagcctggccaacatggtgaaaccccatctctactaaaaatacaaaaactagctgggtgtggtggtgcatacctgtaatcccaactccttgggaggctgaggcataagaatcccttgaacctgggaggcggagtttcagtgagctgagatcataccactgcactctagcctgggcgacagagcgagactctgtctcaaaataaataaataaataaaataaataagtaaataaataaataaataaatattacttcgattctagagagtgtaaaaggcatgtgagacttttagattcatgccggtaattaatttttagcatgcctagtgcaagggacatccagttaatcattcaggagtaggaatatttaaaaataatcctacttaattttttactatgagatgctttcaagcatacaaaaaagaatagatgctgatatagtgaatgcctgtgtgccatttacccgccatccggcttaagaaatataacattacagatgcattgatgcaccctgtgtacctctctccagtttcatttccctccctccttttaaaataatcactccgctgatttcggtatttgctactaccatgcatatttttatagctttattaaagtatgtttgtatcccacaataaaataactatttagacttgacatgtttttaaagtatataccttactgtatatatgattttgcaacttgctgtattcacttggcattgagattcttttccatattggttaatgaagcatgacgaagctcgattttattcatttttactattgcatggtaatccattgtgtgtatttctatccattctccttttgaggggcgtttaggttgtttccattttcccccatataaacattaagcaattcactttaagttggtagactgacagtatctttttgacatttcttttagatttatcgaggtgtgagagtcggagggttgaaagagtctgcagtgcattctcagtataagaggtcgcctaatgtcccaggcgattttccagactgccctgccgggatgctgtttgcggaagagcaagctaagaatcttcttgaaaagtacaaaaggtaagaaactggcttctctaatttgataatgtattaaggaaaagagaagtgcctgcttatattggtatcccaaacattaggatggctttggtaatttcatagacttttcagtgagttcagcattactgagaaataattaagaagatattacttaagtgaggagattgtcttatatctatttggcttttgtaggcccattttggttataaacccttctgtttgttatttatttctatcaataatgatgtacacttaaacttggacatgagtctcagacacttgttaatagatttctactaccaacccgtgtctccctccaaaatggaaattgtgtttttaaaacttattatagaagtaatatatagttatcaaaatttaattaaactatgaaaatatataaaaagataaattggtatagtcctgccacccagagagataagtactgtttgtttgtttgttttttgagatggtggtcttgctctgttgcccaggctgtagttcagtggcgtgatcttggctcactgaaacctctgcctcctgggctcaagcgattctttcacctcacccgtgtagctgagagtaaaggcatgtgccattgtgcctggctaacttctgtattttctgtagagacggggtttcaccatgttgcccaggctggtctcgataccaattttccatagatccaccggccttggcctcccaaagtgccaggattataggtgtg

SEQ ID NO: 130689 - DNA, 1268 bp, Homo sapiens
tgtgtgtgtgtgttttaaaatagagatgcattataatggttataattattttagttttccaatcctaaattgttcaacattggttctcctgtatgtttttctttagacgccctcctgcaaaacggcccaactacgttaagcttggcactctggcacctttctgctgtccctgggagcagttaactcaagactgggagtcaagagtccaggcttacgaagaaccttctgtagcttcatctccaaatggtaaggagagtgacctaagaagatctgaggtgccttgtgctcccatgcctaaaaaaactcatcagccatctgatgaagtgggcacatccatagagcaccccagggaggcagaggaggtaatggatgcagggtgtcaagaatcggcagggcctgagaggatcacagaccaggaggccagtgaaaaccatgttgctgccacagggagtcacctctgcgttctcaggtaagtgtcggtgacttctgggtacattttggattatttattttaatattgaagaggctacaggatgtaagcgttatcactgtttgtttatgcaaaatccaagtgaatttataggctttctggaagggaaagccagtcttttatatttcatagagggctcagggaaacagcttaataatatttgatgtaaggcatgatgctaattgatgaaatgatttacaatattgtcatcaatagatccaagccaaggcagttttttttctgacatattttatgcagtttgagcaaggattctttgctttaaattaccaaattagatttcttctagttccttttgaattatatggatttgtgttagagcagcaacccattagatgtaatatagtcctagccagagaggctaccggatacactatgttctcctctcagtattggtgtgggccaggttctgctcatcagtgaccctgcattctgtgctttgctctgattttttttttttttttttttgagatggagtcttgctctgtcacccaggcgggagtgcagaggtgtgatcttggctcactgcaacctcggcctcctgggttcaagcgattctcctgcctcagcctcccaagtagctgggactacaggtacatgccaccacgcctggctaattttcaccatgttggccaggctggtctcgaactcctgacctcaggtgacccgcccacctcagcctcccaaagtgctaggattacaggtgtgagccactgcgcccggcctgtgctttgatttttaaaaagtgcttatccctcta

SEQ ID NO: 130690 - DNA, 1116 bp, Homo sapiens
aaagcagtcataatttatggtgtattttaccgaattggtccagcatattggtcctacaaggctcagccaagaaatgtatctggtgccttaaactacagatttctggtgactcttaaaactggtttacaaagattgagaaaacaattagattgaagagttttgcttcaagtagacctgcattcatagctagagtgcatgagattttcagcactgtagaatttcacacaggcacaagcataacaccagtactttagcagccgccaacagttgcatctattaaacgttttgagaaatgacattgacttatgcacatttaagcaatcaacaatgttttagaagtccaggtaacatataaaatatattcagacctagttttactttccatattgttgctccaaagtaaggtaaataggagttttagttgtactggcctgtaagattttttaaattacacagtgcatgacaacaactaaagccaactcagtccttctcttggcattgtgagttgaggacctttagccaactgttagctcatctgactatctgtctagaccaagggtcggcaaagttttcagtaaagacccacagagtacatattttggagtttgtgttgtctgtaccaacagacagacatggtgtctgtcccaactacccaactctgccattgtagcactaaagcagccatagacaagatgtaaacagaagagcatggctgtgttccagtaaaactttatttacaggccaggcatggtggctcatgcctgtaatcccagcactctgggaggctgaggctgacagatcatctgaggttaggagtttgggaccagcctggtcaacatagtgaaaccccatctctactaaaagtacaaaaattagccaggcatgacggtgggtgcctggagtcccagctacctgggaggctgaggcaggagaatcacttgaacccgggaggtggaggttgcagtgagccgagatcatgccattgcactccagcctgggcgacagagtaagactgtctcaaaaacaaacaaacaaacaaacaaacaaaaacaagtggccagtctgtgagctatagttcccaacacctggtctagactcttctgcccttgctctgca

SEQ ID NO: 130691 - DNA, 1227 bp, Homo sapiens
ttcttcacttgataaagctacctaaataaaaattaggattttttaattgcttttctgctcacagaattttgccaagttgagaatgaactctgtctcctggcattcaagacctgcaacaggcctcaagtgacgtttatgaccttatctccattattgttttatttgagccctttccgccaacaaactgaactgcttccaaactctctatatcattattttatttatgggttgtaaagttcctgacggcagagacttggtgtttatccatcttgtttccccacaatgcatgccagtatattagatataatttggtattaaagtttcattgaacgccatgagctcaaacaaaaaaaaattgtcattaatcatacaggctgtctttctccttggcatccacataatcaccataacaacaataataataattttgtgagcatctactaacccatgcatttttgatacaccatctcaaacctccacaagaagatgcatattccctttggtgaaaaagaaagggaggactgaaaagaaagaattagagagattaaatgaggtcacacagctagttaatgccagtagtggccttacactcccatctgtctctaaaatctttgcatttccgctagaccacatagcctaataaacaggaggtctagctttagaatgttagggttgctgagcctgcttgctgatggctcttcagttacaacttaggactgttgttggatgactttacctctttcacatttcagtggaatctatattttctgaaatggcatccttcctacatgtagaaaaaggatgcagggtgcatgcattcaagcttccaagatgagtcgtacaagatttttttcttttattattttaggatatacgtggcgttcttgtgccttgaaatctatgttttgttgtaaatgataatgtattatattctctcttatcagtctttctttgataatgattgctttagagaaacattaatcagcatggcggaaggagcctggcatcagaaattaaatgatctgggttcaaatcccagttgttcttttgcacttttgttgtcttgggcagaaataaccatttaatcattctgtgtttcaatatcttcatctgtaatacagcaattgggaagatcaaatgttctaggacatgtacaatatttagcaaagttcttgacatatgacacgtaaatactaaattaaaaaacaaacttttaactctttttag

SEQ ID NO: 130692 - DNA, 1027 bp, Homo sapiens
ttaattgttgaactatacttcaaagatgatgtaaagaatttgctgaaatatttatgttaaaactcattagacattaaagtctaatttcattgtattgattgtggataatgtggataatttcattgtattggtatctttctttctgtatctagttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatcta

SEQ ID NO: 130693 - DNA, 1030 bp, Homo sapiens
gtctttcttgggaaatgtggttgtgtggtatacattggcctttcaatgtggccattaccgatgtgtacagttcaaagtttggagtttccctgtttgtcttattctgtatctccacagtgatttgaacagcactgagcatgtaacagatgcaagatcactacttggattaaaaatcaatgaagaaagtgtataatactacatatgatatataaatgtatgttttatggcataatattaaaagctaggttctttcatgacatatgactacaaaataacagggctgattattaatatacataccagaacttcttatgcaccgaagtgagtggcattcaccttcaaagtcatcatcatggaagcctgcatactcttctccataacactgtcatttctcaaaatatttttggaactccttttttgaatttccttcagagagtctatgactcattcttttcagtatcctcagagtctttttcagctaagagtgaatttggtttttggaagcagaagtcacgatagggccagggatggcgagtaaaaggatctgctgagaaatgctactttggatgactataagtaatgagtatttttcctagcttgactcataaaataaccaaaggcaattatcttcttaaaacaaaaagtaagttgcaagttttatcattttaaaaccaagcctgagctgggtgcagtggcacatcccagctactgaggaggtcaaggcaggaggatctcttgagcccagaagtttgagaccttgtgtcaaaaaaaataagaagaagaagaagaagaaaagaaaaccaaatctggattactcttacataactgtcctactccagaattgatcatggcttcctgcttttggggccccaccaggcctattcagccttacttcccgccccctaccacagtcatcttctttattaagcatttagtaaaatggaggatagaatggttaatttaacctttattcagtcttgtcacattcttgagtgatctctgcaagtgttcatgattattgtagcactca

SEQ ID NO: 130694 - DNA, 1865 bp, Homo sapiens
tgacatagatagatcaacaggagaaaaacatagaaatttatttcttatgaattttacatggcaaggagcctttgtaaggaaatgaagacccacagatgcagttagaattgaaaacttatatactgaatttactactcttttggcgaaagagtagtaaattgtgaaactgtgacaaggcagaggagcttgggcagagtaggtaattgggcagagaagtaacgaggaagataagggttagcttaacaaggtttgtttgtacagattttcctcggtctcagcttcccgtccttgatgataagaatgatgctttccttctggtagagggaggctgtctttcacacgggaatttcatttcctgcttttatgaagaagaaaggtcagagagttcttgcagttgctgtttttcaagtaccttttactcaaaatagtcagtatgccagagtaatgtattttggggtgacatattctaaattcctttgttgtaaaagtattaagccttgcatggttgtagtggaaatcatcaagagtgatttaatttatagatgttagagaatttggaaacattttgagttgactgtgtaaaaataattttggctatggctgtttttgaaatgaaattaattatgaataattaccatttacccagaatctattattcatatcattaacaaagccacattagttttgtggtaagttttgttttatgcaacactaaaatctgttcatgcatttgcctttttcattttataacatgattgtcaactctgaactgaaaaaagggtggggaagcaacattggttccacctggaatcagtttttttcctttttctgttggaatgaaaatcctgcttttcagggggccgcagagccagaacatttacccatagccgtctaagactgctggtaaatataaagtataactttattacagtgaccccgtgtcagtgtcctttgtaattctaattagtcctgataattaccttggacttttcatcacctaaccagtaaaaacccaagtctgcccaatattagagtttgtggggcaataaaagtctcttcactggactgagttgctcccaagatttcatatctgtaagcaaatcacagcctgattctcaccttccttgcatgcctctgattttgatgaattatctggataaaacagaggatattatatgttgaatacacaggtaacattaaacttttctcccccaatgttttgaatacaaacttccagtctacacttaggtacatgttggagtaaaagtcaaatcttggtgttttctctgcccagtatccctacctttgccttgaagtgtatctaaggcctagatggaatttatagtcctaaatagtttgctttaaagtgaactagaacatcgtgatactctgcttaccgtatttgattatgacaaactgtcaaataacagttcagtcaatgaatggtgctgcttgtgggtgagctgagaaggtcataggcagaaaaagcaagaaattctagaggaggaactagcataatttgtttcgcgtctggcaaaagaatggaaaggttatcattgttaaatccgccatttataattctcaaagttttagctcataggggcatggtgacagtgttttgtttcacttctttaaacttgatgctgacttttatcatagcgtagatatcagatgatgctttaaaaaacctccttaagagagttgtctatttttatttttaaatatttcaaatggatggtgtttcaggtcagacctcatttttgtaatagtacatggagtctgttctttaacaaattgtattcaaccttattgtggattaatattctggtaatatggttttactttctaaaaaactagtcttcaga

SEQ ID NO: 130695 - DNA, 1057 bp, Homo sapiens
taaggtctttttaaaattttttcacatggtccaactgccagacagattgtacatcaatttcctgcagcatttggcaggactatgtatttactgccttaaaaacaatttgaatttattgattttgaaatttgtgattgctttctaaagttttccctcctcacccccatctaaatttactttggggaaaaaggcaaaacagagcacattggcccatttttatgccaagactttcagggaaacattttatatgattaatattgtgtggctaatctggtgtaaaaaatcaattttctccattttaacttatgagagcatgaccatcctgtatgaactatttaaagatcctgtgacatcactaatccaaaattaagtgtttgttactgcctttatttatgtgtgttatattaatcatgtaagttaatattgggccccatttctttataagaattgaattacatttcttcagcagttccatatcttttctatcacggcagcatcctagccttgacttgagcaagctgaaattagtggactctggacttggccccagctcaatgaaatacataggtcatggtacctggtcgccattttaataggtctggattcagttagagagcttctcccttatctgtctattcctttaaacccatttgtcctaaaagattgttctctctcactaataatcagaaaagaaacaacattataaaatccgtatgctttcattccatcaaattcaaactgttttataaaatattagactatttgttactaggtgagtatattattctgaaagatttaatgtcaacactttgaggaatcgagaaatacctatttgtaatgcttgtacaatactctgttatccttagaaatacggcacctcacaaataacataacttctacccagggaataattgactcaccatggaggtctggctccctgcctcattaaatcttctagaattgctgggaggtagctagcaattattcttccctctgtttgacatatgtggagagttaggcaccaagcagtcagaggtcatgcgtagagtctctaagg

SEQ ID NO: 130696 - DNA, 1161 bp, Homo sapiens
ccaccttagcctcccaaagtgctgggattacaggtgtgagccactgtgcccagccaatgtctattttaattccctaatctaagccagttaagaagttaagatgcccatgcaaacaattataatgcaataagatcattgtttaatggaagagtcttcaaaactacagttaggaatatataaggaacaccaaagttcacctgagagaaaagggatgctgttagagaagttagcatttaaacagatacctaagaatgagtaagaatgtaccagatagacaagtggaaaaaatggtgctgcagtatttacagaaggactagccataagaaagcatgttcagtgttgctagagcatgaaattgagttggaaagtggtagaaatgaggctggagagtaggcagcagcgtttataccttacaaggaggttgggagttgggcttatggataactgaaagccattgaaaaattacagcaagctgacctcttgaaacagaattgcaaaaaattgagattggaagtagagaaatcattaaggggattgttgcaatatgacatagtccaaatgagaaatgaacaaaagcaatgaaattgatattaggggacagttttgagagaatctctagtccttagtgattagatctgggaagtaagagaaaaggaagatctcagataagtcccagattacctgaataactaggtgaaggagagaagaggggttggtggatccattcaatttaaggaatagtgactttttaaggtggaatatgatgaattcattttggttatataagtaccatcagacattcagaaagagatgcttcttagacataaccagaattggagttccacagagatctgggctagagatttctggattgtgagtcatcttttaattggtatagttcaagtcatcagtatagagggagaataatattagactgagatgggtccctgtggagcaacaacagagaaaggaatgtgacatcttagatactgagggaggagaacatttcaagaaagaggaaatgaatgtgtaaaaagcttcagcaagatcgaatcataggagagctaaaacccgaagattggataaggtgttaaggagatcaatgttgcttttaagtgaagcagcctccatgagatggtgacgcctaaagccagactgctt

SEQ ID NO: 130697 - DNA, 1074 bp, Homo sapiens
tcatttcaaggccaaaatgactatggatatttaaaaattattgtgtagtatgaacttcagctttaagatttttaagtctatcaaaacttaagcatatttgcattaatagtgagacaaaagtatatacagatgtttgattatgtagtaaatctgttgctataaaagcatatgatcacatttggaaaattgctattgcatgtcttggcagtttgttaagaactaaaaactttaaaaactaactggtgttttgatagattaagttcaaggccaccttttgtttaaatgatgttttgttttatgtaattagaccatgctaggtgaattaagtatgtaattaaaaacagaaggtttggctaattcagagtaaatgagtacaaaatacaaggtcattatccatctctagtgagactccagatgaacagtgcacatggaactatttataaaacatttttcatggtcagagctcctctaggttgctgtccatggcctttgaattaagtattcacagactttcaggaaaaaaaaaagtacctgtaatatagaaatatgatcccacttaaggtgctcatctgagtggaaaaccaaaaaagattagaatctaatcttctatcccagatagaaaaggtaaaatgtattcctcctgtttgaaacgtgaacatttactatgttgcttggcacattgcgttgatggttagaactgtgaaacttttgagagtcctgactctcatttgttttcatttcatgcagcctggagatgtacgggcaaaatatccctaatttaatctgtttcctccgtgcttagtcacagtgggtgacatgggatggattttttcttctggaaagcctggaaagtattttatttgaaatatattttcttttatagtatgagaatgtgcagcttttagaaagctggtgtttaatttagtggttggattcatgaagaaagtttgaatcagtgactggaagcacaaagctgaaccttctcttagcagtcccttcacagttgggctcctggtgtctctccagttttttcctgctgttctctcttccacagtagctgtgcttcagtttgcc

SEQ ID NO: 130698 - DNA, 1083 bp, Homo sapiens
tactttgtactatttaacaatgatactatcactaagcctttagtgaagaggttagcctgagccagaagtaaagccatcagtcaagagaaagaggagatgcataaatcatagcactgaatccaaactctgggtagtagcaaaactgaagcccattcgaataaagtaggaatacagacatggagcaggccgaggtgcggggtgcagactgagttggcttagccagcaacacagaatgcttttttgcacatttcagctgggtcagagaacaggtcctaaaggcaaccatgtctgctgaacagactagtattggatatgatgcagtagtaacctaggtggtaaaggctttaactgccaagctgaggcttctaggtttagccgtaatcctatgagtaatggatagctaataaaaaatttttatgaggggaaaactcttatcaaacttgttttttggtgtcaaagtgaagcatagagaggaactggagaccctggagacctaggataactggattaaagactgttgaaattgttaaaagtggattaaggcaaagatagtggaattagagaagagagtctacattcaagaaatcatctagattagatcatttagaatcatctggatctgatcatcagttttatatagaggattagggtgaagaagaaggtttctgatttagataattagattgatggttttgctattgtttgagataaagaatagaaaaagggaagaacagattttagagactgggtgtgtgtggaggataagctaacaagatatgttatggatgtatagagttttcagtgtctggaggacatataaatctattagatagttgaaagtacagaatggaaccatgaatttgggactatttggcatggaaaaaagtatatgagatcaaccagagagacccttgaagagagatgattaccaaaaatggatttctagggtatcccaaatgtaaggtgagtggggcaggaacagtgagcagaggctggctctatctacccatggatatattgaaccaagcttaaatgtaggccgattacagctgtcacctgagaatttaccatgagtaggatttc

SEQ ID NO: 130699 - DNA, 1027 bp, Homo sapiens
ataataatgttacttttgcatattgttctggaagattttttttcccaaacaaaataactttataatcctttatagttttatttattaataaacgtatggataagtaaatacaattttagataaatataaatatgtacattttttaaatttaagaatttttaagtaataataaaccattttgcttagacaacatgactctaaatgctttgcaattataaatattttaagtacttttttcctcaatattgtgattgagtttttaaataatcagataataaagtttcaaaatctatccccaataaatttagtactaattgctagcaaatattagcagtataattcacaggttagcttgcaaacatcattgcaatgtctacttaatattttttcaatattgtagtaagcagttagaaaaataaaatcaatacatctttagtcctaataagatttcattttaacctatctacttttttaaaattataaattatttagaatgctgacatttaagctttaaattattcatgaatataatgaataatgtagagtatttagcctcaaagagttgtcttgtgtcagttggaataaatcttttttttttttttggcataaatttaagggtacgattgctgttttttaaatttacatggatatattgcatcatggtgaagtctggacttttagtataaccattacccaaataatgtgcattgtaccctttaggtaatttctcatccctgactcccttcttcccctctcacccttccaagtttccatagtctattattccgcactctgtgtccgtgtgtacacattgtttagctcctacttatacgtgagaacatgcagtatttgactttgctgtttctgagttgtttcacttaagataatagctaccagttccatccatgttgcttcaaaagataagattttattcttttttatggctgagtagtatggaatacatcttaatgggctctgagaaacactttgaaatgagctacaaagtaatgaataaattatcatggtt

SEQ ID NO: 130700 - DNA, 1060 bp, Homo sapiens
tgaggttacaggccaccatgcctagccaagtcctcataatttcttacagctgaaaatgtacaataacaatagcaatgcaggcttaaatgcaaagaaaaaaagcccaccaaaaacacctgagtttttaaaatttactttctttgagaaatttgaaataaagctgaaatgatttttaataaaattctgataatgattttactaaacttctgaaatgtttctacaatctaaacattccagacctttgcctaatcatcagcttaatttttatttggtctgggtattttttaattcttattttatttcactttgttctttatgaaattaattatgttggccttgaatctgaccagtgcaaatttattatatggcttcataaaaaaatcatacttcaaagaaaatacttccttaaatgtaagaacttataccttccttatgttctttgtttacctaaggaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttgtaagtacattttaattcttcaatttatgttttctccttctatattttatcatcaaattgagaagcatagttcatatgtatatgaactgtgtgtatgtatatacaattatagaccatatgttaatattcattatacagccatatacatggttagagaaattgtgaaactgtagcttgcttatagaaatgtacttgcagagaaatacttttttatagttaaataaatcatagctcaaatttaaataaatattcaggactccttaaaactaaaatgacaactattttaaaagatgttttcaataatgcaaatatgagatacttctgacattcagtaaactcagttgccaaaattaatgaagcaaaggtatttatgacatagagtttgagaatttgcttcaatttttaaagtatatgagttggtttctatttgag

SEQ ID NO: 130701 - DNA, 1014 bp, Homo sapiens
atagtatttttaataagtattaaaactataatatattcattctcttgttaagaattaagaaatccagctgtcatagaaaagtcttccctcattgcagtattttgcttgcaggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagtatgtggcttttttacattaaatattagttttctaattcgaaaggatacttttataggaaccaggctagttctgtgttactttttatagccaactgtggaaaattttgtttcttagatttatgtaacagtaaaaaagagtatggcacaagtcacctttttaaaattgtattttaatatagcagaaaacaacacatcttcaacttagagttatggaacttttttctgttgaaggttgctaacccacggcttaatttgcaaagtattttagagagaaaaagatagtgttcctaacatttactttcccaattaaaaaagtgaacctaaaattatcttccagtaaattcaacagactattattttatgttgtccaaattatcagttaaaccacaaagagcagtgcgagctatgggaagaaataaggtgggaaaataagaagcactagaaagaaggattaagagacagggatgctcatacagaagattcagttgcatgaatatttactgctgcttatcatatgtgaggcacagtgctgggggtgctgcagtggctaaaatgatgatcaaacattctctctgacctctgttgcttacaaagtgatgacaataggaatgctttcacagactagcacttctcttttttaaaaacagttttttaagatactgcagttaacatcgtaggtcattgtgatttcacagttataggcaaaaa

SEQ ID NO: 130702 - DNA, 1033 bp, Homo sapiens
ggcatttatgcatgaggaccatctctttatggctttcccttgctccatttgtcagggttggtttttgtttgtttttttgttgttttaaacagaaatgacttcattttgattctgacaactttcacaaacccttactgtgttttgaatactgaatgaagcactttagtggattcagaggtactctaagacattcttgtccatagggtacttacatttataaaagattttgcaaaacaattgcttgcaatatgagatcataaattgaatacagaagtgtctaatgccggttgtaaattctatggaagtttagaaaagagaataattaacaaagactgaattagccatggaagtagtagatacttgatctgaaactaggtatgatttagttaaatggatagaggggaaggaccttctggatagagaataagacgtacacaaaggaagtctttaatgaacatagcatcatatggagttatggcaaagagattcagttaaagtccagcctgcctgtattggaggttatatgaacaatgggaaaataggattggtccatagaagacattgaaatttaggcagaaatgtttagctttaatgaaggcaggaactgggagccattgtagattcttcattagaatgatagaaatagtattcaagaaaggttagtataatgccgtgtactttgaggaaggtgtgaaactaccttgttccaggtagcatgcaggcattttgcttacctttttatttaatcatcaatctttggagacaaggatcctatgcctcataagtgatttgagccaggatttgaactaatgtctgtctgactctagaaagttagatgggagagtcctcagtcaggaagcattagctgcagtaaaccacctatgatgtagtgaggattatacccagtagcagtgggaatggaaaagaagagatggagctaagagagaattatttaaagaactagttgactgatgcatatatagggaatgaaagagaaaataaatgtaagaagacattgaagttttatgtagca

SEQ ID NO: 130703 - DNA, 1087 bp, Homo sapiens
cctagcactttcagaggccaaggcaggtggatagcttaagctcaggagttcaagaccagcctgagcaacatggcaaaaccccatctctaccaaaaattcaaaaattagccaggcatggtggtgctcacctgtagtcccagctactcaggaggctgaggtggaaggattgcttgagcccaggaggctaaggttgcattgagtcgactttgcgccactgcagagctagaccctgtctcaacaacacaacaaaaagaatagacataaatgatatttttctttttcttaaccactgtgtcttttacaataattttgtctaggttatggaacgaaagtacaagcttggaccccttgttatctaattgatactgtgcttgacttaacatgtgtatctgttaagtcaaggttgttgcattgcaacctcttgtttgtgttcacagcttagcttggttacctttggcccatgaaactttctggttcttttctttttttcttttgctttagtttgagggattcatttggccattacctacttagttttggtactggggaactgactttcttttaggatatggcggaaagttttagatggatattttggtgtcccagttgttttcagtgaaatttttctccattcttttttctcctttttgattatttcatggatgaaaggtcttttcagcatggtgagagatctgtattgccaacttttgcttctgatttattttcagcccagaggacctgtattctctggcagcttttactgtagctgtttccagtccagactctggattggtccttaagcagtggtggagcaaataatgacacagagcaagtttagcattggaccattgaaaaatttcataaaactaactttttagataatgtagatcaaattttttctctgatttcagaatttcagaactgaaattcgctgctacattaagggagagatttatatttcacatcaagtattgatacttgggtctattgtgtgtggatcctgcattcttaacataattttcagaaaatgtatgggttataacaatataaagaaaaatttccaaatttaatttacttctatctagtt

SEQ ID NO: 130704 - DNA, 1125 bp, Homo sapiens
gctcagcaataatgctgatgagaagatagatgccattcagatacctgattctttgaatgtttgaatgtgggagtttttggatctttgcattgtccctgttatttaaaactttcctaataatgtgccttggtatacatcttttccccattcatcgtatggagtgtcttttgactttttaaatctggaaacacccttcagttctatgtgatttcatgtttgctatttcttggtaattttcactgtctctcctctctgtctctggatctccttttatttggttgttgaaccttttaggttagtctttcaattatcttttctgtttccttttccctctttttctctttttattcttctgagattgcctcaagtttatcttccaaacttgctattttttcatatcagatatttaatgtctaagatagctttctcttctacgttattatttcattattattattttgagttatcttttgctccctgccttgtgtctgttcttttgtgtttgttttgatctctgacatttcactttatgggctttcttcaaatgtacggggattatatttgagagaagcactaaaattacctctggcagctctgtgtgtaagagtggaactagttgaccagcaaattttgctgtaaaagatgttagggttcactactctgaattcacatgcttcttgtgacttttctctttgcaagcttaagtcttatttttggtctgctgagttagctgcttacatatttatctgttttctaacttccaaacatttttctagcttccacatttttgacatctcccatatactgttatctattcaattcctgtgctgtttgtcttttggggtttatccttttctgtggctttattgtagttttgagagggttttgagagggataggtgtaaacctgtgtgttctaatctccattttgatgggagctcctgccatttgtaatttcttggactgttctaaaattataatttttattttattttttaaatcagtctatctatctatctatctatctatctatctatctatctatctatctatcatctatctaagacagtctcactctgctgctcaggctggagtgcagtggtgtgatctcagctcactgcaacct

SEQ ID NO: 130705 - DNA, 1070 bp, Homo sapiens
tggcctaccccggtcaccagcaaaggctaaatggagaacctagacttctatccttttgaggctgtccagtccttctcaggcggtgtcagagaaggctgtcatgctaaggcattcatctccacaaggcagtgtagaaagtattccctccctaagtggggagtgccagtgaagaccatgtgggagcctagacttatactcctaccaggcaggaataagaacccaacaacctccctgttggagtggggtcagaggcagtctggtgaagggtcaggactttcatcgccaatcagctaaaatgagactacttcccacagtaccagtacaggactctgggagaacctgacctctcacccttatccattagtaacaaggagccctccatagcccaggccaggaagtggaacacagtatttgctcccgcattcacttagtcgcatataaccacctgaatgggttaagttgagaaacgtaggatccagttgggcaattgtcggtccaaccacaactctatttttggtgtatgaccaggagtctctaccacagatatgttaataggacttaatttgtttggtaagattaatctataactgttctaaaataatttattggttctttacaattgattttagtatttctgtactctgaaaaagttctttcttatagttgtcccaaatgatatgtttgccattttaaaccctctttcaagtatctatttcttcttcagcacaattttttttgtctttaaatatatttttgtgttctcttgaagtttattaaaataactcagggctgggtgcagtggctcatgcctctattcccagcacttaggaaggctgaggtgggaggatcacttgagcccaggaggtcaagactatagtgagccatgattgcaccattgtgctcgcatctgggcaacagagcaagcccctgtctcaaacaaacaaataaacaaataactcactcactcagtcaggtcacttttacctgatgctatctactgacatgtaactatgaaaattactgaaactgattgctgccccaaatttaggttatctatccaaaattataac

SEQ ID NO: 130706 - DNA, 1030 bp, Homo sapiens
tcacatttttatattaacatctaaaaggccttttcctgtccttccctctttttcctcttctccatccctttcctaactagcaatttaatacttgtttagtataattttacccttcaattgctaggcagttagagtgccagggttttttaatacgtggtaaagagtgccagggtctttttatacccagtacgggacctgataaacatccagttcaacctccttacttggaaaaaaaaaacaaaatgatactaaagccacacagtcaggtagtgatttagaactcaagccagtttttctgactcatgtccagtattggcctcatcacattgtactgtttgcttttatttgtactgtcttttataaattagtgtaattactttatttcctttccagaaattattttaaaattttatttagcttgttacctgtgtattatgtttgctatcaggaaacagctatatttgtttacttctttatagttttatagtgttttctcatcctttatctcatttatttgttgtgaagataaccttttgctcatatatctgaggttcttaaataatagcatgaatttctttgttattctggcatgcccatcacttctatacattcacagactcagctgctgtagagtcagacatgtgttgactcattccactgagattataaagttcagtcattgttgattctcattttcagccctttccacatctcctgggtactcttgcagtctaaggcatgacatttcaggcatgaagataattagttgttttgaagcacctagatttcttgcgttattaaactgcttgtgatcagagtagttcttttagaaacataatcagaggtttggtatgtagttaagcaacacattgtgtagaaacaaacacaaggataatcatgtcatttattttactaacattcttcaatcaaaatggtgttagagataagataaattatatggctgtaatgtgtgtccctgtgatttggttggtggcaagggaatgaattgttagtctaaagtgagccactg

SEQ ID NO: 130707 - DNA, 1048 bp, Homo sapiens
aatgtatttggaggtaatgaagttatttaagaatcctcttgaaaccaaactggtggtgagagggaagaaagcagttcaatagggggtgattgaaaggaaaaaagagacctagaagggaagcgtcagcaagaaagagtcaaagagcaaggaaagaaagaaaaatgaggtagttaacaggaggtaaaagtagtagtattgagaagagaagagaatgagggctgaaagggagtaaggttcttaacttcttacatagtttgggttggttgccttttgatctctcagaactaggaacagatatgtttgctttagtttgctgttgttgctgagcaactttgtcactggtgcatccactagggttattgcaagcatgaccctgcaggtactaatctcagcagcactccctcttcagttaactccatagccttctctgcctgacctgaatcaagcatattttgctccaaagctcattttttttctctaccgcacagtccagcttcaatagggaattacttttttggatttaccatatatcctataattttgctgaacttatttaccatagacaattgattttcttggatctaatagtctgtgctcatgccatcatacaaattcatatgttcagcagctttattgagatatactgacatataaagattttatatgtttaaggtatacagtgatgttttacaaatttgtattttatttcttcccacttttcctattatgtgactttagggcaatatactgattctcctaaattttactttctttatatattaaatggacacaatagatttattggaatcacaggcttattgtaaggactaaatgagaaattgtgtgtaaaggatccattacagtattggtacataggggtggtaggtagactgttattctagttttatttccatttttattgagaatgtgtctgtgtttcttcactttatataattctagcatttagttttagaaataaattttaagaaatcacattaagatactcttaatactcttttttttgcttttttgcattttaatcctgagt

SEQ ID NO: 130708 - DNA, 1101 bp, Homo sapiens
aaaaaaatttaccatcttaactgtttttcagtgcacagttcagtagcgttaaatgtattcagattgttgtacagcagatctgcaggattttttcatctagcacaactgcaactcttacccattaagtaaccactccccattgcttcctccctccagcccttggtaactaccattctactttctgtctctatgataatttaactactttagatacttcctgtaagtgtaatcatagagtatttttctttttgcaatgggcttatttcacttagcataatgtccttaagcttcatctgtatttagcatgtgattttcttcctttttaaggctaaataatattcaattatatgtttataccacgttttgtttatccattcatcgtcttcgttcattttttggttttgtttttagtatagattatctttcctttttacccactaaatttctttatctctaggcttcagcttatttagggacataaaccatttgcctggtttgttctttggaagtcattttattttttgtttttgtttttatttttatttgtttttttaagctacttcctaccgaaaggatggaagtcattttaatggttatattttccacctgttttgcagctatattgctaacttatgtattgctatgttaattatacatctagaaaactttgagttattttattagttttcttagatatttaattgattggaagtgtttttaagaaaacttggagtttgctagttaaataattatcaacaatgtagctaataaattcttttctactagcatgcaaactctacactgcatcggttcaaattatagcacctaatgctgcctcaaggcttgtgacattataacttttcaactgagcaatgcttaatttgttatgaaagtaaaaaaaaaaaaagttaagtaattccatcaaaattgtattgctgacatctgtttctgataaaattttagtaatatgataagaattaaaagcattgtgtgatactggtttctgagtctcatgatagtaaactgtagaggacttgtcttttgtgaatcatttgtatatgtaaggtgttattaagtccaaatggaaaagaaatttggtgc

SEQ ID NO: 130709 - DNA, 1010 bp, Homo sapiens
aaaagggtgaaggcagaatgacaagtacccatatttggagatttggtggaaggagataaaagagaccagagagtaagagaagaattaggagagtttcagccaagggagaaaatagttttaaggaggttgtgattgatgaccttttacaaatgtttgtcctcttctctgtctccatctccatctccgtctccttctccttccttcttccttcttccttcctcttcctcctttgtctttcttcttctttcttcttttttgcctttagtttgggtagtatgaataataggttatcagattggaggtcatggttaactttcaggagtgtaattcagtcaagtagcaggctgaagtcaattcctgggggatccagaaatgaagttcggtagccaagaagaggagtaagttgggtggcggtgggggcggggggtgggggtgcggtgagatttgaaggtttgagagtccagggaagattttaatggcatgaggagacttagtctgattttagaatgagatgtaggacccagaggagaggattaaagatgtaaggagtagggccaagggcgacagataatgaaacaaggccccagtcaggtagcagggaatgtgactgaggatttaagtctagtcatcaaccatggggaaagtagatttaagcatactatgtctataacctgctcctgccctggacatcaagtgttacatttgaagagctcactgcttattaatgcagaagcagtatcaagcattttatatggttgccagacttaggcagggccagtgggttgaaaggcagtaatactttgctaggcaataattggtttaggggtgctggttagctgtagtggtggttcagttgcttacaaagtatttagaagcctctgagcaactatattctgatctgccttaaaaataatttagagtgaagctaattactgaaagaccttaaccagcttttaaaaatattgtggaaataagcataaattcaccattttaacatttttaagtgtaca

SEQ ID NO: 130710 - DNA, 1025 bp, Homo sapiens
gctggcaacagaagtatgcttccctactgcacatgtatatatcagtgtccaaggttaagaaaaccacatttgtattttttggcaggtacaatacattttaaatgaaaaaaacatttagaatgttttcttttcaaaatgattgtactgatagaaggaagtatctaacaatctgttcattattaattgcatgttttctgatatggttaattatttaggcttgatgtaatcactcagctggttaagactgcttactgatacaaagttaaagataggatgtacaaatgcaattaaatatcagtttcttaaggttaaaaaaaataataatttcctccaatagagagttcttaacattctatgtggaaataaaatttgtagaaaagaaacagaaaaatgaaatccatagagaattgatatgctacaccttaaattaaaacttatcatcagaatacttaaattcttaaaaagtataatttatgatatttaataaataatttatgagtatgaaaaattaaaaccatggacttttttaaactttaggattaatgactagtaatggcttctttgcataagttgcttcctttcgccttaaacaaagaaaccatacattttaaagttttatcataaaaacagaatgtatatgaaattatttcactttagcaatttttaaagtattttaaggctcaaaaacttaaggatatgggaaagtgatcaagatgtagtgatagaggaaaaaaagaaagttataaaacaatgtaatctcatgattccaattttggttaaaaaccagtatgtactaatgggcacagtagatacacaaagtacacagaagcccatatatcaaaatgttaatggtaaatcttgaggtagtacaagtatttttattttcttccttatactttgttttcttcctttatacctttattcctttctatagcaaacatgcatcacatttacagttgagttttgtggaagaataaactctatatttcattccatttctgccttcctgcttatattttgataga

SEQ ID NO: 130711 - DNA, 1022 bp, Homo sapiens
tatttaattttgttaacttggttttaagtataactttcacatgaatagaaccatctttattacatctgggatcatttaatttgcataattaaatgtagttgtgctatgcaatgcaaggtaagaaataaatgattagcggtgactttgtaagcatttcggtaagtgacttataaactgaaggtcaccattttaattggaatgctcgtgaatctcttacattctgtaatcaaatgaatgatatcaaagaaagaagtaatttaacataacaattgtggcttacactgaaaatatgttcctgttaataagttgcatcatgatctttaaggacttgtatgtagttagtacattttggttcatttgatatccatggtttttcttcatttttattagtgagttgttacagtggttaacaagaaatacacagatttaagctgcaatagttttcccagggttatatgatctaacttcacaagcttcttgaacatatgtagatgcttttctattttgctttacttatgacatacaattgatataggcaagcatgaaagcttgggcagattttcattgctttttctggatcttgctcaggttctgtggtatttatgtaaagcacaattttgttacttgggaatgcatgttgaaattatcatgtgcactattttgctgtaggcccgttggcactgccacaaaggtaatacactgctagtaggccatttccttgtcgactgcatttacaatttaatagaaatattacatgactttttaaacaagtgttttggcagggaggaaatggcagattccatacaaacaagcatagcttcctttcctaaaccacactccagctactcaagaaattgtagttggtttcaagtttgggagtttaggggtagaatgggaagtcaggttgaaacaggaatgacattgatatttactgtaaaatagttatatatttttagctgctgaatttcattactgtatagtttgagtgacactagtatatttctgaataagtgctgagatta

SEQ ID NO: 130712 - DNA, 1030 bp, Homo sapiens
attgacagtttattgctagccaggggagattgctgaaaacttttaagttcttgcttatggctgctgagatgtcttctgcagcctctactggaagcaatatgaaaataatgagcctattaggactgtgatacattttatcttttctaatgatgaaaaacagttattttttacttcttcattttcccctatactgcatactagcccagtaatggaaaccatgattcacaagagggtagaatgagctgtttctggggcagagaattcagtcagcacatcttatgaaattgcacttaaatattgatgtttgtgcagatatgtatttttctggtaagatagttcatagttttccatcaaatgaaaataataactccttgaaacaaggattccttgatcgaaaataactgagaactgtggttcttaatatcagtgaccctcaagagtgtatcttgttacattgtgtatttagggtagtgttttgtttactattttctttatcatagcatattacagttctgcatttcaacctggaaccaaatgtagattatgatgtcttcctcccgtaatctttctacttctggaaagcttagttttagataagtctaattattgttagaagttcctcatcccactgatttaaaaaatcttttctttctttgaattctcatatcaccttatctataattttcttatggcacttttaaacttactgtgtattatcatagttattttgatatagttgtcgtatttccctactaaatctaagttttaaattcaagtatgtttcatctttgtgtgtctaaatgaatctagcagattctaacataagaatatccaataaatatttttgttgaatatgtgcttatttcctttcctatctcaaagatacttctgtggtgttaatactgaaatctggtaagctcagatttttctttcttaaaataataagtgttgtacttacaacttagcataagaatcaatgaaataaattaaaaagtgaaagtaattaaatgctaatcaaatccaacttgaa

SEQ ID NO: 130713 - DNA, 1053 bp, Homo sapiens
tttatttcctatttaaataatatcattatttaacttttcttgtgtttgtgagctgtcttacaaagtagagtattgaactgcaagtattggaagctgttgagatcatgtaacagatagttttatcactggtaacaagtactgccttttgttttccttgaaatgacaggttcacttggttcctttttgagaaaatgtctgtcaaatacccaagtctgtgtaaccttagttttctgttagttattcttcaagtaaaaatgatgttctttgaaaagagccttgtagtttatttagcttgcagctcagtcacacaactgctttttttcagattattgttgttctttgatatgtggggaagtgctttatgcatattttccattttgtcaatgtagaatattaaaaatacatattcaagtgtagaaatttaatagaattaataaactttactgtttcatcaaggtttacagtagttttgtggggggtatagtgagggcaatgaaagaaagagctgtccaagagagaaaaattgttgagggcccagctaaaattggtaattgggaaagtatagtgtaattaatcctggtttgtgggccttcctatggtagtgtgctctgctgtgcagtagaatgcattatggccttgatatggagggtttgggttttaatgaatgagtgtcttagaaggatggggctatagggaatttaaggatgctgctgagagacagttcaaggggttactaacagggcacagtctggaaagaaaagagagagtgtaaggaaatggggtgatcaaagaataggtagtgttctccatgcttgctgcatagccgtcatgtggggagccctaccctaaacagattaaatcagaatctcaggaggttagagaggagataaagtggtagttaagatatgagaaagctggtaggatatgacactatggtaagtgagtgaaatattgaagttttttaccaacatttttttttgtactgtagtaattttgtgaaataaatattttatcctccattgggtggattggatgaaatggataagattatgt

SEQ ID NO: 130714 - DNA, 1100 bp, Homo sapiens
taggctataactgtgtggccgacatctggtcccttggcattacttctatagaaatggctgaaggaaaacctccttatgctgatatacatccaatgagggtaagaaaattatggtttgctgaaaatgttagccttatataagtgttgccgttttgtaatgtcaatgtaagtaaatataaactaaataagttcatttaaatgtattctttttaaaaatggtaaaattacctcttaaagattagtaactgttaacttctcttccttctgcattcttaattgtgagaaaagaactgaaggctttgtatatctctaccatcactgttctcctcccccaaaaatatacttgtaaaatttttgcttgcttttcaatagaagaaagggttggtaaatcctctttgctcttcagtttattgttttcttgattgtggtagtgaaagagttggaagtaatcatttctcacttttttacccactctgtgatttataccttactgtgtgtttttttttttctgccttttctcttctttggtctgaggatggtattaagcaatcctaatttctaatattactatgcacatataaaggaattcggctaattttttttaatgaatgcatgctgagaaaatggaattccttttttgaacatcattatatgcttctgtgaactctgcaggataatttttgagtttgaaatatatattttgcatattcaagtctaattgcctgtgtttcagggtttgtgatgatatactttttaggtttattactatgtgaatcatatagataagttcatcatcataaataggtacactgatctttgtatacttattgccctctagtggctgtagttatctcaataaggatgtaggaatgaggggaggagtgtatgtatgtgtgtatttgtagaaaagagaagataatatcatggtggctggaggaatgtgaagtaaatagatagaaagaggaagaatgcataaaaattcagatattttagaatatctgaagaagaataaattggaattacatctgatattataatgccattgtgggttaaatttcgataatataggtaacagtgtattatacagaaaatatttaaaaa

SEQ ID NO: 130715 - DNA, 1039 bp, Homo sapiens
tattatggcatttaatcctcatgaggattggagaactctatgaggtaagaactattaatgacccattttccagatgagaaatggaaacatatggaggttaagtagtgatatggaaagaaaggattggaattatagctgaagactagaattgagctgagaacatgaaatgtggagccagactgccaggatttgaatcctggctctgctacatactacctctctgaacttgggcaagtttttaaacttctctgtgacttaatttcttcatctgatatatgggacaagatatgagttgttataaagattacatgtatttaaagaataacacctggcacataagtggccctatatatatttgcttttgacattgtcatccttatcctatcatctcacttaggtagataaaagtgtctttgcattttggacatgatcatctaccagatgtatttgggtagaagaatgcagagaactatagaaccaaggatagaatcttagtattcaccattggtactttggtactttgaattattgttgttaatgaagaaagtatacattccataacatagacctcacatttttaggtacagtgttagtttctttaatagaatcaaacggtggtggctgggcgaggtggctcacacctgtaatcccagcactttgggaggctgaggcggggagatcacttgggctcaggagtttgagaccaacctggctgacatagagaaaccccgtctctactaaaaatacaaaaattggcctggtgtgttggcatgcgcctgtaatcctagctgccgggagactgaggcatgagaatcacttgaacccaggaggcagaggttgcagtgagcctagatctcgccactgcactccagcatgggtgacagagtgagactccacctcaataaacatataaatacataaataaccaaataaccaaataaataaaagagtcaagcagtggctattcaaaatatactagcatattttatccaagtgcccttagaatcaataccttgcatgtaatagcctttatggtaaa

SEQ ID NO: 130716 - DNA, 1056 bp, Homo sapiens
agccagaatgaaagaaaatttaaaataactttttggcctcatggaaatatagattattttcgagttgattaatatttgactgaatgcaaaatcctttagaagacatatttaaaatgctttagttaaagggaaaaattttcatttgttcctcatgttaagtagtaagttctttgccaaaatgaagtcttattttcttcagaatcactcaaaacatttgggcctcttctggtttgtaatcctgttaaatttcgtccatgaagtaaagcctaattatgcatagttggtgaactccagatattgagaatttgatgtgcaatagaaatttacttatttaacttattggaacagtatgaaatgttgaaaatactttgtattgggattaagaaaaaaatttctttgggaattaactaaatttaattgtttatgtattttcctttagcccatatgttgtaaagtactatggcagttattttaagaatacagacctctggattgttatggagtactgtggcgctggctctgtctcagacataattagattacgaaacaagacagtaagtattttaaaattgttttgctaatatcatttctaaagattgatattttagaatctgactagttggtattttgttacacagaaaataatagcatgaaaaaagaaaaggttttaagtggtgtaaagatatctagtaggaggtgtgagaaccagccacatatctttctgtaacaaatttaggaattacatgattgtttaatttatttattaggataatttttggtgtgtcacagagaaactaccatggtacttctcttcttcatttggaatcagcgtgtgtgtgtgttgtttaataatgtgagtttcataaattatggctagaattttatttaaagtttataatattcatggtatttacgtatcttaaattttatgtattataatttatggctggaatatttgaagaaattatatacttctgaattaaaaaaaaacatttttgtatttattttcccaaatattgtcaggatgtgtgaaagtgatagaaatatatatatttc

SEQ ID NO: 130717 - DNA, 1062 bp, Homo sapiens
catgagaaacacataactttctaagagtataaaaagacgatgttcacttctagttctagttgaattttttaagaaaaatcaactttattacttcagagctaaacatttgctaaatatttataaaatgttgagcttttaaaaggcaaaagggagcaggattgaaaaaaaaaatggccaggcatggtggctcacccctgtaatcccaccactttggtaggttgaggtggccagatcacttgagatcagaagttcgagaacagcctggccaacatggtgaaaccctgtctctactacaaatacaaaaattagctgggtatggtgtcccatacctataatcccagctacttgggaggctgaggcaggagaattgcttgaacttgggaggcggaggctgcagtgccactgcactccagcctgggtgacagaccaagacttcgtctcaaaaaacaacaacaaaacctttcattttactagtttgaggtaaaaatgtacttcctgtagttgatgtagaaaagatgttttattttgtggattcaagatcagactcctcaatgtataatttagaaaatgcttgttatttaacgctaactttgagactttttgacatcgtttaataatgttacattgaaggactaaaggatgaaaacctttcatgtgttttaaagatgtatttttttttttttttaacagtattcaagatgaaactgctagggtacaagaggttttttttttttttcttttttcttttcttaaatggaacacttaatgaatttgcatatcatccttgtgtaagaaccatgataatcttctcggcatcattagtaggacttaattttaaatgagatttcacatatgagatgaaggatcatgcctagcacatagcagtaacacttatgactcattaagtagctactattagtagtgatacagctaccagcagtgtggtcattaaaacctatgctctagtggatagggaaatctgccagaagagaaaaagagattgacagttacagagctgaaatcaggtagaaggcactttatgaaaaagaaatctctgttctc

SEQ ID NO: 130718 - DNA, 1132 bp, Homo sapiens
gcggctgtggatggttagtgggtgttgcaatataatgaaattctaaatacatcattttgctttcatttattaattggaatgtttttataaaaagtaacttcccctcatcttctgtttagttacccagtggtactgttgataaaggaaagacaggataaatgtttgattctttccttttatttacaagttttcaagataacgaattagttccctgtctttctccaaaggtggccatttttttttcttttaaatgccattatgagaagatggatttaaacatacttgatggatttaatccattggaatcactttcactgaagcgcaaattgtctcacctttggttagtgggagtctcttcaggagataacatgaccctagtggtttttgatagtttccttgttgtctgctgtgatatttggggcccatcttgtatacttcttgtcctagatctggaatcatccatttctccaaaaagccgtggtttctcttagtaagaaatgatatttcaagatcctaacctggagactaatatcctaataactaatatcctgttatttttaatagcattttattcatagataggataactgattttttctttcaaactatggatattctgccaaaagtgatgacactggtggttttgagctcttttctctggatagtctctccactacacatttattttctaagtttgagtcagaaattgggcatatataaattcaaattacgtgatatagactattcagagcagacttttatctttatgttcttcctatttgctctggttgctctttgacccactataatcctaatacccagtcttacttttttctcaccactaaatatttcagatgacctagtgtcattttaaatgaaaaagatagaaaataaaataatccaagacaaataacaccactgttgataagagcagattttaggctgggtgcagtagctcatgcactaatcccagcacctgggaggccgaggcaggcagattgctttagtctaggagttcaagaccagcctgggcaacatggcaaaacctggtttctacaaaaaaatacaaaaattagctgggcatggtggtgcacacctgtggtcacagccaggaggctgaggtgggagcatc

SEQ ID NO: 130719 - DNA, 1013 bp, Homo sapiens
attatatgaggctcaaagacgttaaataacttggtcaagtggagaaagtgccagaattctgcatctgattggctacaaaggctgtgcaccctcttgttgtatacagtgatggctctttttgaaactctctttcttatcattccatgatgtagtggtcctctttttctgtaatctcctggtctctgttgcttattctgctcttaatccttataaaagtgccattttgcttttctgccttgaataacacttccttagtgctgacttttacatggccttatcgatgtcgttgatgttcaagtatgactagaagctgctgctcagttggcattttttattttttcaggtaggtcttactctttcattatcccatctagtttgtcactatagcctatcaaattttctattaaaaagttggtggattaattttttctgttttctttctcaagagtactaccccataaaacccattccatggttttatgaccctcacttttgaattgcagcagtaccttctagctggacgctttagtccagtggttttcaaaactattttgttttgttttgagatggaggggtacaatctcggctcactgcaacctctggcatcctgattcaagcgattctcgtccctcagcctcctgagaggctgggattacaggcgggcgccaccacgcccagctcatttttgtgttttagtagagacaacgtttcgccatgttggccaggctggtctccaactccagacctcagatgatccacctgcctcggccacctaaagtgctgggattacaggcatgaaccaccgtgcctggcccccgttgttctttatttatgttataggctgtgggtactcccagctttacctttattcacatttttcctttagaaaagtttgtgttactttttgcctgaagaataatctatgttttattcttccatcaaagcctacctcatcaagtatgttttctgagtactttctagcctgagatatttcactgaattcctaatgtgat

SEQ ID NO: 130720 - DNA, 1019 bp, Homo sapiens
ggcagatccggctgggttccgggaagcgagggcctcgcggggtggctgggttggtgaagggctactgcggccgaaggggagcccgcctcacttcattcttccactctgagggacccgctctcttctggtcactacgtcttcctccctcacttcgcttggcgaagggtgttgtacttgtgaggaagtcgcagctggagctgggagtccgctggagtttttctctgtttctaagaggaggcgaacggccgctttggtggggacttactgctttcggcctgagataacgaacgctctttccttcactctaccgccgacttctaacgtttctgtctactcctttcagcttccgacttcgactccttaccttaaaagatgctggagtcatatgtaactccaattttaatgagctatgtgaatcgctacatcaagaacttaaagccgtcggatctacagctttcactatggggtggagacgtggtactcagcaagctcgagttaaagttggatgtgctggaacaggtaagctatttagctgtcattaactggaaacagttttcagcttgtttagacggtaatctattgtttcctaagctttgactttatgctgtaaaaacgtaacttttctactgatgtattttgagctaccctgaaacaagggggctttattttacactattttctttttctttctttctttttttttttttttttttttttttgagatggagtctcgctttgtcgcccaagctggagtgcagctgcgtgatctcggctcactgcaacctccgcctccgggactcaggcagttctcctgccgtagcctccctaatagctgggattacaggcgcgcaccaccacgcctggctaatttttgtatttttagtagagacggggtttcaccatgttggccaggctggtctcgaactcctgagcttaggtgatccgcccgcctcagtcttccgaagtgctgggattataggcgtgagccaccgcgcccggcctgcataatttttaaaaat

SEQ ID NO: 130721 - DNA, 1356 bp, Homo sapiens
gggtcgaggaaaaaaagacaaaaaaaaaaaaaaaaaagagcagattcagatcatgaggaaagatgacatttcccacggcatcctcagagtgttgagtagatacattgagaatggcagtaaaattggaaacttctttattaatcgttttagtttcttttaacatgagatttgtctgatgcaaaagaaccgtaacttcaaagatcacatattcattaattcatttattacatttattagtaacatgccaagaaattctgttaggcttgaggatctgtgcaagctcagaagagtcagagaccaactgctttttaggagataagggaagacttaatctgacagtgatggttatttataatttttagttatagtccacagcctcttttattactcttttattaagtcaatctagacttagcactaagaaataatactcctggctgcttctttttcctcttcccaaggttagttgagtggcttaatatttaatattttcattttattttattttttaatgagcacaaatcccaagtgtaacagctcaatttttttttttttttttttgagacggagtcttgctctgttgcccaggctggagtgcagtggcacgatctcggctcactgcaagctccatctcccgggttcatgccattctcctgactcagcctcctgagtagttgggattacaggcgcccgccaccacgcctggctaattttttgtatttttagtagagatggggtttcaccgtgttagccaggatggtctcgatctcctgacctcatgatccgcccgcctcagcctcccaaagtgctgggattacaggcatgagccaccgcgcctggccaacagctcaattttaaaatgttttacacctgtgcaactactgtccaataaaaaaatggaatgtttccagcaccccaaaaggctcacctgtttttgtaagtactccaggccgggcacggtggttcacgcctgtaaccccagcactttgggaggccaaagcaggcagatcatgaggtcaggagttcgagaccagcctagccaacatggtgaaaccctgtctctactaaaaatacaaaaaattagctgggcttggtggcatgtgcctgtaatcccagttatttgggagactgaggcaggagaattgcttgaacccgggaggtggaggttgcagtgagccgagatcatgccactgcactccagcctgggtgacagagtgagactccatctggggcaggggaacgtactccccactcctaaaagaggcgactggtaatctgacttctgtcaacatagataagttttacctggttttgaacctcaaaaaaattggaatcatttatgtttggcttttttct

SEQ ID NO: 130722 - DNA, 1471 bp, Homo sapiens
taactttcacaaatagagttacaataactaaaaatgtgatagaaatacatttttttcttcctcctttgttgatttgtaaacaaattatatctagaagtgagacaaatgagcataaagcaattttggtgacatttttcatgcctaaccttttatctaatgataatgaaaagcagtcagaaaacatttaaaatttatgaccaagtagtatccagttcaattttacattaggtgaagtggaatactttttttttttttttttaagttgatcagttttcattttgtcaggttattttcaaatctccaattgagctcccctttcaacttgacttagaatactgttctattagtttaaaatatattttgaagacatatttttagatggagacttaaaaaattacatcatttcagttatttgaagtactgctgctatatactgttgcactatcatatatcagccttcatcatgtactgagtattatatattatttccattcagcaaagtaggagacaggcctagagtgcttaaggaacttattaaatgtaacttgtaccataaattattgttatttatcattaactatggcctaacaaggtatttgatgctactttttgataaacagtaattctgaaaatatttttgtgttggacattttatttctcttttaagaaaggaatttgtatattagaatgaaaaatattaagcactaaacaataagtctctgaatattcttgtgttggaaattttattttttaaaaaagaaatttgcatattataataaaaaatattaagcacttactaatttttatgtaatgttttgtgttttaaggaactgaaattaccattcacttttttaagtggacatattcatgaattgaggattcatgtaccatggacaaaactgggttcagaaccagtggtaattaccatcaatactatggaatgcattttgaaacttaaggatgggatacaggtaagaaattattgaaccaagttgtttatgttaactaattttagtagtatttgacatttctttaccttttcaaatatgccaactgttacataaacatatcttagcttatatacttttttttttttttttttttttttttgagatagagtcttgctctgttgccaggctggagtgcagtggtgcgatctcggctcactgcaacctcctcctcctgggttcaagtgattttcctgcctcagcctcctgagtagctgggactacaggtgtgcgccaccacgcccagctaatttttatatttttagtagagaaggggtttcactatgttggccaggatggtcttgatctcttgacctcgtgatctgcccaccttggcctcccaaagtactgggattataggcatgagccactgtgcctggcctttaatttgtatatgcctgtttaagtgacatgactatttgcaaagtcatttttaaatttgaataaagtatgtaaaggttgtt

SEQ ID NO: 130723 - DNA, 1052 bp, Homo sapiens
tggttggaatggtaggttcagtgaaggggccttttagagttacaggtactcaaagatatgaatctgttaaaaaaaactattatgcataggaatgtattgaagtatgattaaaaggtaggaatatgaggcttaaatcagataagatcattccaaaaataagattttgttaaatgccttgataagaaggcatgtcttgtttgtgaaggtcaatttaattctaccaacatttgttggttgtctactctgtactgcactgaaaagcattgctaaaatatttatataatctcagcaaaagacacttagaaaaagagattcataatgattgtgattctagtggtcatggttttaatatactgccttaacatatccttacaatcagttttacttatagagatttttaggatgacagggtgaccgaattgttgtgttaggtaaaataaagtccatcttgatgtttactctgaattttaaaaaatatattgaaacttcactcatgaaatagttgttaatgatttcctattcactctgagagatgtatctatgtcagtcattgccctcacttttaaatcttgcagagttactacttgtaaactgtttatcctgtttttgatttcagatacacagtttttgattcatgacacatcatgtccatgctaatctaataaatacttgttaacataactcaagagctaaaacattatcagtaacttccatttaactatgtgctcctctcctttttcatattcttttttgttcagcctctaggggcctcatctgtaaaacaggacaagacttgctatacaatttaaaaaattatatgattgatgtgctttctttgatcattgaattaagtcttggctgggcatggtggctcacgcctgtaatcccagcactttgggaggccgaggcgggtggatcacgaggtcaggagatagagaccaccctggctaacagggtgaaaacccgtccttactaaaaatacaaaaaattagctgggcgtggtggccggcgcctgtagtcccagctactcgggaggctgaggcaggagaatg

SEQ ID NO: 130724 - DNA, 1101 bp, Homo sapiens
cttgaggttaggagttcgagaccagcctggtcaacatggcaaaaccccatctctactaaaaatacaaaaattagccgggtgtggtggcaggcacctgtaatcccagccactcaggaggctgaggtgggggaatcacttgaacctaggaggcggattttgcagtgagccgagatcacactactgcactccagcttgggtgatagagcgcgacttcatctcaaaaacaaaaaaaaaaattgatttaaataatataatcttttattatatgatgtataatcctgaaatttatggcatatgaaaatgaaacttggcataaagtggattttttagttcaataatacttttttttaacttattgaggatgttttagttcttgtttgccataagtgaaactttttggaattctgtatttgtttcacaattgggaagatttttttttctttttgagctgaaaaaggtatattttatttttagtctgtcaactattttaagtaagaagaaaacatttagatcaagacaaggaaggctttagtttcatcagggactttctaagaatgttatgaatgagtgaaaatatggggttgtaacagaagtgcaaatataaccttaattgtagtgttcagtgcttttgacactataatttatgtctaaatgctgcaaactgaaagaaccttagtttgaaactttgaagttgatggtggttgcaggttttctttttcccttcagttttatgccatctcaatgtgttatctggcattaaagacataaggaacacagattgcagcttccatttttttggcatgtttttgatttctatttgattcatatgctctggaggttccttttgaatctataaaatgcaacagttctctgattttgttttgatgattagatgctgctaattttcttttttttttttttttttgaacttgttcattttgccatgactattttttgaaacttgagatgtctggtatttagaaactgtactgagactttagtttttctatctgacctgagttttctatggacagattatagtggggtcttactagtctgacaattcctgactattcattggagtgtttacttttatttagt

SEQ ID NO: 130725 - DNA, 1051 bp, Homo sapiens
tatgtcatgcctttactagaaataccacctatcaaaaattgaatttattaggctgggcgcagtggctcatgtcggtaaacccagcactttgggaggccgaagcaggtagatcagttaaggtcaggagttcgagaccagcctggccaatatggtgaaaccccatctctactgaaaatacaaaaattagctgggcgtggtggcatgcacgtgtaatcccagctactcgggaggttgaggcaggagaattgcttgaacccccgaggcagaggttgcagtgagccgagattgcgccactgtactccagactgagtgacagagtgagaccctgtctcaaaaaaaaaaaaaaaaaaaattgaatttaccatttaaccttaaatatcagatcttaaaaaaaaaatcaattggtaatttcctgggtagtgtagagcttagagattagtgttgtcttatatgactcatggtcaggcatctgtttttctgttctgaaatttgcagatctcattagcatcattttgcaatgttagagcagacataaaagttagattatattcttctttcttaggagactgagaagataatagtgtcattaactgaattagggaataaaggacagaggattttgggggaaacaatgggagaaggggaaaaaggagctgaatcagttgcagagttatgagttttgttttagacgtgttcaatttgaggtgctcacataaaaaaattttttctcagtgctacttccctcattatttaatttctaaacttttataataatctattgctaatgtttctgcttttgctcttggccaaatactcagaagagtcttcttcctaaatgaaatacttcatctttttattctcccattcataagtttaattggcttgtttaatatatagaataaagtttaaatttcttggactaataggccctctgccatttgccctagtttctttttacagcttgatatttcactgctctctatttaacctaaattgggctatccattatcatttcagtaaggcatgttaccttgccttgttcaacttttcc

SEQ ID NO: 130726 - DNA, 1332 bp, Homo sapiens
aaagtattgcttttgtagaattagttatacatgtgttcgatagattctgaagtccctaaggacaggatacaaagataaatatatctaatttatccttgtaaatccagcaatttggcatgtaagagtattatatacatgttgaatcaggacaggaaaaaagtactcatttgcagttataaatacagggataaatttcaaaaatatgtataatttatttgtttctgttactcatattgaaacccagttaaaacttatacctaacatgaatgataatttagtatacattgtttagtatacattgtttaggagaggattataaggattattaagattaatcattaaagatgaccaagatagcttggattgaaaatagtgttttaacatataaacaacaaatggggaaaaattaagaacctttttatttattttgcacttacatagagatggatgttgtttaaaggctttcattaagtcattttttcttttgctagagccataaataagaattctttggagattgtcaagtagtttgttttgatatcagctaaagaaagaagaatttatagttttaaactatgagttattaatattttttaaatgctgtttgagaatgcaaattatgaaaattggttatgtagtttttagagctaaaaaataaaattatgttgatcttatctcctgtagctaccataaactgcatatattaaaaaattttttttcttaattcttgagtatgatcgatggttttctttttctttctttaaaataaaaataggatgaccatgaaagctgtggttctaattctaccaaccgtagtactgctgagagcacaaaatcatcaatcaaaccgcggagaatgcagcaggctgctcctacagatcctgacttaccaccaggtaacttctaatgggatcaataaaaccaaatttcaatttttggccgggcatggtggctcatgcctgtaatcccagtgctttggggggctgaggcgggtggattacttgaggtcaggagtttgagaccagcctggccaacatggtgaagccatgtctctgctaaaaatacaaaaattagccgggtgtggtggtgtgcacctgtaatctcagctactcgggaggctgaggcaggagaatcacttgaacctgggaggtgggggttacagtgagccaagatcatgctactgcattccagcctgggtgacagagtgatactctgtctcaaaaaaaaaaaaaaaaaattgatcattgttttagtactttgtagaatatatatttttagtatcataaaacttttaagctatatgtgcatatgtacttgctacatgacttcaga

SEQ ID NO: 130727 - DNA, 1505 bp, Homo sapiens
tagcatgaaattaaaagaaaaattttggagattctaagcaagccatggagaaatagaatgttcattaattacttttagtgtttggagttaacctgtatttctgtttctttttcctatttccctgtgttcttattctacttttatacattctccttccttccatacttttgttttttcatttttctgtcttcttcatggtagtattttaaaaatatttctttaactcttcctgtctacattttcttcttcattcatattttcccctctactctattttaacattaaatattagtaagtgagtagagttgaatccattatgatggtcatgtttcttctatccgaggcataacttttaaatatttttatggctaaactaggaagagatgaaggtagctggtttaaaaagaggcttaagcttaaagaagaccatcttctaatatactgtataatcagcatatagtaacattgcttcattttggaaaatgtttatataatacaataagcaaaaatcaaacaaagtacttgtagaataggataatcattgtatgggatctaatattatgttatcaaaaatatatatggtctttgtggtttctcttagtatatgaatacttcactatagaacttcttgataatgacgtttgttggggtcgatctgctacttattacctgtgtcactttggcaagccttttaacctatctgaacttcagtttctctttgggaaatatgctaaataataaccacctttctcatacattaagttcaataacactttaagaaataattatttactgagagatttgtggctaattaaattctttttttctattttataggttatgtgcagagtctgattagacgagttgtaaataatgtaaacattgtgataaataatctcatactaaaatatgttgaagatgatatcgtcctttccgtcaatatcacttctgcagaatgttatacagtaggtgaattatgggatcgtgcattcatggatatttctggtgagtaaatatggagaataccgtatatttttccataattgaaacaattaccttaactcttaacccttctttgggccaactgagttgctggtaaatgttatcaaatcttcatgcctccagtgtgggaaaaaaatgcacatatacaaaatgttgcatataattacaggaggttagtagacactccaaattcagaaatctatacttgtggtttttgtttgtttgtttttgagacagggtctggctctgttgcccaggctggagtgcagtggtgtgatctcagctcactgcaacctctgcctcccgggctcaaacaatcctctcacctcagactcttgagtagctgagactacaggcacatgctgctatgcccggctttttttttttttttttttttttgagatggagtcttgctctgtcgcccaggctggagtgcagtggctcaatctcggctcactgcaagttccacctccccgggttcacaccattcttctgcctcagcc

SEQ ID NO: 130728 - DNA, 1056 bp, Homo sapiens
ttttatataattttaattaatttaaatagccacatatggctggtggctaccatattggatagtgcaagtttagagtagcagtgagttttttttaatataaaatgaatgttaaatgaatgacttcttcaaaaaattatctttaatgtggattcttaagaattttattgttatctcattgtgtaagagaactgtagtgaaatttttcataattaaaaaaaatttgtagttaatgtgccatgcagattggggcaaactaattaggtctctgattcttcatatataaaatggggagaattgtgcctatttcataaagttgttggaagatttaaattgtataataaaatgaaaagttcattgcatatggtctggcattatgtattaaatgctccatgaatcttattttctgttattattaattttattactatttatactaataaataatagttgcctttcccctgctaattttcctttttacttaaaatgtttttttttctttttagcaactgatttggtgctgagaaaggttatcaatttttctgactgtacagtttgtcttgataaacggaatgccagtggtaaaatagaattttaccaggatcctttattatacaaatgttccttcagaactcgtcttcattttacatatgaaaacctaaattccaagatgccatctgttattaaagtaggtatctcttttttttgcagttaagttgcatgtctttattttgtttattgactcttgtggatgctaatcattattaacaaatgaagaaattaaccttgtaaatatgtatgccatttgtttttataaaaattttatttatgtttatgatttttatgttgtatttatacatttctgtataacgtattctactagagtttagagacaacttttttctgtaattgtttttttttagtttttccagctgtttattagtgtttctctcttcaagtagatagaggaaataatattaaaaggtatatttatacccacagtggactgcatatcagtattctgtatttcagttcttataatctgttcagcatgatctg

SEQ ID NO: 130729 - DNA, 1064 bp, Homo sapiens
ggatatgggaggaaaaattttaaaggatgtctatttctattctcttagttaaatccttttgacttatttaaaatgacttaattttaattgataggttctgaagatgaaacaagaatagatatgcaatatcctgctcagcataaaggtcaagagttatattcacagcaagatgaggagcagccacagggatgggtgtcatgggcctggtcctttgtgcctgcaattgtgagttatgacgatggcgaggaagactttgttgggaacgatcctgcatcaaccatgcatcaacaaaaagcacagactttgaaggatcctattgtttctataggattttattgcacaaaggcaacggtgactttcaaagtaggtcttttctcttgctgtttatatctctatcaactttaatgcttaaatttggattgttagtacaattctagctttattcaagtttgctttgcattcagtagatgtgagatagagtctaacagttcttacttcataaaattacatggctcctccacttgaaatctttgaattctgatcccttcctgtcttcttagggcattctccacatttcttttttattagcttcatggatagttttttgccctattgaatcattcagttggtgtacaaacatgccttaatattgtcattaaaaaagaaaggaacagcaaaaattttcccgtgaattcttttacctgtcaggtacggtttcctttctgtgctctccttcgtaacaatcataacaatctctctctctctttttttttttttttttttttttgagacagggtctgactctgttgcctaggctggagtgcagtggtgcaatcacagctcagtgcaacctctgcctcccgggctcaagacatcctctcacttcagcctcccgagcagctgggactacaggcacgtgccactgtgcccagctaatttttttttttttttaatattttgtagagttggggttttgccatgttgcccaggctggtctcgctcctaggctcaagcgtttttccccctttggcctcccaatgtgctaggattacaggtgttagcta

SEQ ID NO: 130730 - DNA, 1040 bp, Homo sapiens
cataattctaaagatgtttaactaatttagagattctacaaggaaagcctctaacatttttattaaattcaattcttagttctaatgtttcctttcgtcttataggcccttatgatgggagaacctttctttgattgccagattgggtttgttggttgcagagccatgtgccttaaaggaattatgggtgttaaagattttgaagagaatatgaatagaagtgaaactgtaagtccgtttcctccatccttttttggataggatataggaataattaagtgcttactgaagtgtttaaccatataatatctgttagactatatatatctcaggcttgagagaggagctttactatttctccctgtgtttcacctgccagaaattatagatctcagggaagtttagaaagttggtagcgcctaacacctggacagtagttccaactactttcttattcatgaatctttcttcttttttgttcatggcagttatttggagtttccttttggtttgtaaaaatgatctttggcaaaatagtcaatgaaggtggagcagcagcattccttatctttctgttttagtgatttcttttgactagtaaatgggcatcataaaatcaaggttttattttgtttaacaggctaatggtttttcttcccatttataaattttgcatttgttttcaggaagcctgtttcttcatttgtggtgacaatttgagtacgaaaggtttcacataccttacaaattcattgtttgattaccgaagcccagaaaataatggtactcgcgcagaatttatcttggattcaactcatcataaggttagagaatatatatttgaaccaaattctaggctgtgtttgggtggacacattgtatgaatacttgtgatttctagctttcttttcaaataatgccttctgaatgctaattgtttattaaaacatttagaatgcatttatacagtatacatgtagaaatgtttgaggagtgcacagagatcttttattgaatatgtaaacatattttgcttattt

SEQ ID NO: 130731 - DNA, 1049 bp, Homo sapiens
gaaggtgatactaatttttaattaaaaagaatgtgttgtatcaatcagaaaaatagaaaatcttccagagactttagatgtatatattgtattattttattatgtaccttattattgtattattttctattttttggaaataaatgacgtttaaaacatttcaacacttttttttttacttctatatcaatatatgatgtacttactatttcagtcttttttatgttgaaaagttagcgaaaataggttcacagttttttttggtgaatttttcatgttttataaaaatgatttcagtgtattaggtgatatgttaggtacagatgaatgcaatgaaaaccaaagcatttcccaaagagccaataggtggtgttgaactaggcatttaagtaaatgattataacgtagcatgttaagaagagtagtatagagaactagaagtgtgggtaaaaaaaaaaaaaaatgacaacttttgcttgtgagattgaaacttcgcagagttgatcttgaagtaaatttgtttttgatgaagaaagaaggaaagagcagtaaatttctggcttctgcttttggaatggtttctaaatgttgatgttttcattggtcaatccttaatttctttccctaaactttctcccaagttaatttcattcttttccatggatttaagtactttccatatgttgttgatactcaaatttgcattttatagtccaaagttctctaagattcagaattaaatatccaatgcatacttgacgtttttgcctctgtgtctttcagatatctcaaaactgattttgtccaaaattgagttattaataaatattcctatgaccacttactacctctgcttctttatttttaggcttctcttctttgaaaatcgtactatcctcttcttgttgctcaagccagaagcctgggagtcatcatgacacaccttttccctcgctcctagccatctggtccacagatgataacagtggtatcactgttaccatatggactagcatttagttcatatgtaccatcatctctagattcta

SEQ ID NO: 130732 - DNA, 1576 bp, Homo sapiens
attacaggtgtgagactatttcttaacaatttttaggagtttttaaaatttttgtttttaatatgctgtggatacaagtccctcatggagctggatcttccccctccccatctatctgtagcaaatattttctgtcagtctgtgtcttgcctttacattatctcaatggtattttactgaccaaaagctgttactcttttaaagaaagaaattggggatttcttaaagatatattaaaatgaaaaactggtaaatttttatataacaaagatacatttacattcgagaatagtgcaacttatatttgttaaaggtaacttattattttatacctgcttcattgttgaaaagaaaaacaggatttgaccttatagtttggagaactaattcatttttcagttgtttaagaatattatttaaaaatattctttattaattttttatcattttaattttagatattaaggatgaaaatgaaacaatactgaatcctgaagaggtggctcttctggaggaatatattcctactcgacatacaagtgttactctcctcaaatgtacctgcacaatttccatggctgaattcaacttgctggaccatttactacctgtcattatgggagaaaaggtatattttgtgatttgctatattttttttccctcatatatggatttttttttttttttttgtcatttactgaaagaatatctgcagccgggcacagtggcttgagtgtgtaatcctggcaattcaggaggctggggcaggatgcacacttgaggccaagagtttgagaccagcctaggcaacagcaataccttgtctctaaaaaaaatttggcacggtggcacatgcctgtattcccagctcttcaggaggctgaggtgggaggattgcttgagcccagaagtttgaggctgcagtgaactatgatcacgccactacacttcagcctgggtgtcacagtgtgaccctgtctcaaaaaaaaaaaaaagaaaaagataaaagtatctgcttatatagttatccatgatgaagtaaaagcaatgtaactatgaactaaaaattaactgttaatttttaaaatgtaattttaaatttatatttttaataaaataaacttaatcttgagagtgtataaagaaatgttgaagaatatgggcctagaagtcagaccatatgccagctataatgccatagacaattactttatatctctaagccctgattttctcttctcaaaaagaaaacaattgtattttttcaagcagcctgactattttagttttagccagtaaaactgtcagcctgcctagattcagacagtttattacttacatagacagcagaagcaaagtcagtaatggtgccagctcccctgtcccttgttctataggacaacctgtaaacaaagggccaaatgacttctattggtacatggtggggcaccctgttggcaacaattcagtttcacactgcagctaagcagtggtgtagcttagcgcatatgtggaaagcccataactcagctgaatgaggaatgctgatgagaaaatgtttcatggccgcctctct

SEQ ID NO: 130733 - DNA, 1029 bp, Homo sapiens
aatttttcctctttttagtagtatgacatttcataccttaatatatcggtgtgtgtcttggttttcccatttgaaaaactagtataatgatagtacctccctcatagagttattatggaaggattcaacgtgttaacagataaaagaaatctagaacaatgcaggtttgctagtaaatcctttctaagtgttaagaagcactatttttatttttactcaggatgattgccttgattatgtagtaattgcttgagcagtatatgtgtaggtgaatatgtgtgtatggacatcattctagtttgtatttttatattattcagagtttctgaaatagtggaacttaaagttagcagaattgcatatctattttgtttaagtagtatgtttgcatacatactttggatgtataccctttcttcccttgcaacctaagtcatttagtattttgttgtctgtaaatgctatttactgtattgcgattctttctgttttcttgtgcaggaccaaaagatctcagattgctataactgaaggtatatttgaacttccaaatctcacaattcaagctacaagagcacagacacttctcttgcaagcaatatatcaaagttggtctcatcttggaaatgtcagctcttccgcagtgattgaagctttgataaatgaaatcttcctaagtataggtaagagcacagtctttttgataactatatggaaaatttgtgttagaggcaactaatattttattatgaaaatccatatgtctagcatggtcaacttaaattgtaatatgtttctttgaatgtagatatttatagcttatgtttaaaatccagattatgagttaagccatccagttttatttcctcgtacctatttctgcatatgtttcataattgcaaaagattatttttcaccagcttcttgtataatttaccctttggataacttttgagggtatcaatgtatgtgtttgaaatgataaccaaattaagtataagtacagtatgtttgattatactggtaaaa

SEQ ID NO: 130734 - DNA, 1052 bp, Homo sapiens
tagcctgaacatttgtgttagtaagctcatgaaattattatttgcttttataatttttctttttcctagccaaacctattccatttttacttttctgaatttataaaatggactgtgctatgaaaaagcattttatttgaaatttcctattctaaaaatattctgtgtttaaaagaatggtggcatatgtattgaaaaattgattaggtaagtgacaacagattgttatttgtaacctcaagttctgtcatttagaaacctaaaattagtggaactaatttttgcatattgaggagttgaagaaattagaatgatgttaagacatttctttgccaaataattttatttttatcaaatggaatgcctataaaatttataacagattaaagagaaaccatcagctaagacagttttaaaaagccagatttccaggtggtcagttttcttgtcttttttccccccgagaacaaaacctcattctgtgctttgtattcttatggagtgcttaaaggattgtgccttcaaatagttctatctaaagatccacgaaatgtgtatgtatttagggtgtaaagttttagcattttattattttgcgtctgaggactctcattacatagtactcagcactgttaagctttgtttaatatgttttgtgtaagtatgtgatcctttgctttacaactagttttcatttcccacattaataaagagattatacaagctgtgtacatttttggatctctcagacttaggttctgataatgtgtgaaagaagaaccattattattatcattatatatatttttttgagatggagtctcgctctgtcacccaggctagagtgcagtggcatgatctcggctcactgcaagctccgcctcctgggttcatgccattttcctcccgagtagctgggactacaggtgcctgccaccacacccggctaagattttgtatttttagtggagatggggtttcaccgtgttagccaggatggtctcgatctcctgacctcgtgatccgtctgcctcggcctcccaaagtgctgg

SEQ ID NO: 130735 - DNA, 1005 bp, Homo sapiens
tcattcctgtttgcaaataagaaatgtgtatatgtttcacttttactaccaccaaaataactgtatctgacctgaattaaactgttactgatttctgatattcttataaaatgcatgtatataattgagttccagttttaccatttctttcattataaattgtgatttattagcgagttttgaaatcaacttcattgattactactaagaatttgaaaagactagaatagaaactttgtgcctcagtcttctcattctaaatgttggactaatgtgccaccaaaagcaataacaaatttaacttcaagcatcaaaactgcaaagtgcttttagtaagaaaagtttttctttgataaatgctatatccaaaagtaagagataaattttgagtgttgaatcagtcactaatttctattttgtgaatgagtttaagaggctttaagagaatatctgtggatgttgaattatgttttatgatgctacaataatgaatccttcctcagctcttgcaaaaatcaaattaaaagtatattaaaataaaaaagaaaatgttatatgctagtgcttgctagggatttgattttgtgcattgaattatagtaatctttatgttacatataaatactggtttagtgaatgtcttactatttctgttgcgcattattttcacttttcaactattgacacttaggaaagatcactgaattggagtgtgaagattttctcaataactatatatgactaaataaaggtcagtttgtttcattaagttttagttaattttctcatctataaaataatgaaaatatgtttatagctgctcatagagttcttgcaaatgccaaatatattattgtttgtgggcttaatctgttgttcttgtcctagacatagaccttgctggaatcatccatctaaagatattacctatggaagttgttctaggatataaagttcttggagactgagataacaacagtcagaattgtagtctaggtgatccgt

SEQ ID NO: 130736 - DNA, 1042 bp, Homo sapiens
tctcctgcctcagcctcctgagtagctgggattacaggcgtctgccaccacgcccggctaatttttgtatttttagtagagacggggtttcaccatgttggccaggctgctcttgaactcctgacctcaattgatccgcccgccttggcgtcccacagttctgaggttacaggcatgagccaccgcacctggcccagtcgtgcaattttgatggaagtgactgactaaatttcaggcacgggctgtgactggctttagccaatcgaaacattcccttcacctctctccttctatactgattggttgagaaacctaattgaggccaatggggttgaaaaacctaattgaaaccaatgagatgtcacagggtgttgctgggcaaattagaaatcatcttccttctgaaaccatcagacaaataggctcttttccttggaaagtgtgctgtgagcctatgagatctgcaactgttgcaatcattgtgttatcattacattacattatagccacaaagaagggaagtctgaggaagacaggtggaggaaggcagagctgagaaatctcagagaaatagagtcagagaactgataacattgtgaatctcagatctatctctgaactctgcattaccatatgatttaagctgatctaaggtggtctttttctcttcttcttccttagtgctgctcctacttttatttccatcatgaagaatcttaagtgatatagtttgtcaggataaaacccaaacttctgagcatgaaatcaaaaggtccttatgatatgattcttttctaccaatgtatgtagctccattttcagaactactactctcccctttgccttcacatctcttatatttttgatgttcttaaccatatcaaccccataaagtttctaggctaagtcacgctttcatatgcctgttttcatatacccccaaaatcttattctttctttaggattagtcttagtaagtatcctctgcaaatacttctctccctcatttaagcagatttgattattttctcctttgtgaaat

SEQ ID NO: 130737 - DNA, 1306 bp, Homo sapiens
ggcttgaatgtgatttttatttgatatatgagctgtgacataactgttgcatgactgagatgtgcttgtaagtgctgtactatgcagatgggttttttttctgaaacaaagccaaaaataaaatcttgaatgtgttcatgtagtgggaaaagaatacttcatagaaacatatggaaacatttctaagtttttttcattatatgaaccttttactttctaagcatttttatgattgttcaagttaacatgtcatttacctcatattttccaagtttagtgagacatgggaaatcttatagtactctgatgtttggaaacaaccagataatttttaggaatgcacattttaggattaggtgaaatgattattagaaaattaggattgaataatgggtttatttttcattacattattaatcataagactatagctaattaattatattaatctgatgggatttgatgaggagatgtattgagtggtttctttttactcacttttaaattaaagcataggacaacattaaaggaaatcataaaagtaaaaagatacaagtatagcatgactgtttttaattctccacattcccttccaactcatgtcttcgtatatacatttttacatgttttttatttattatatgtttaccattttatgttatgctcttcttttcataacattatgttttaaaatttctctttggtggtcacgtaccactctgattgtctctctcattgtgggaagcatacaaatagaaaattttcttagattcaaagttcctcccaaggtctcattttatcttcctcttttctgtcacagagaaatgacttagaattatgtacatgttgcctctccagttagctttgatgctgagtccggtgtatattttgtagttctaacttcctgactctgtatttgacatacgtagaactctcttctgatttgtgggctcttctcctttgtctttttatcgttgatcttaagagaatacactgagtaatctctttctcctgtgttgcttcagctacaacccatacactgacaactgcttcatttaatgctgtagcccagaacatcttcctgaaactgtgacatttatttgaatatgccaaggtatctaaaactcactatattcagaaggaaatttaactcttcttttcttttcttttttttttgttttttgagatggagtttccctctgtcgcccaggctggagtgcagtggcgcgatctcagctcactgcaaggttcgcctcccgggttcacgccattctgcctcagcctcccgagtagctgggactagagg

SEQ ID NO: 130738 - DNA, 1024 bp, Homo sapiens
ttaaagaatactcatcctcagcatttaacttttttctagatgacagtattttgggcctagggatactgatgtaaataattgacacagaattgcagataaagagaggttctgaggttaagaatcagttcagccagagtcaatctaaagcatctaaggctactaggaagctttaaggagccatgaatcatacttcagggacccaacagtaatgaaggtgtccaggttgaatccaagcattttctgtttatagttaaacagaacaataagatatgcaataatttaaagacattaaataattataaaggtttcactctttcctcctcatttactttatttcctactttagatggtattttggtggctcagttaaaataatacttaataaagttaggcttcatgtagaggggtaggatttgtatcagattaatgtaacttctaagtccctttatgcattccagataagaggaagtgtgaaccccctgatgccagagactgctgtttcttgattactaactctttgacctcaaaattcaatgaagtttagtatattaggcatagtgcattcaagctcattttctaagttatctttcatgttttgtcaactgccaggtggactctgggcattttttggggaaatgtggttaaagcagccataattatcaactgcttgaaatacttacccggtattttaaagaatattaataaggcctcatttaatttggttcgcagcttttagatgattgtacagtgatcatgatcatgtcttacatttttatatattccctagccatttaataatgtacttgagaactaaatattttaatagtatttccttacagtctgatacagcagcaatgttaggtagttaaatgttgtctactacataatattgagctcaattagcttgaaatggcaagttcatctaaagtacatatgaataaaagggattataagtatagtgaagtgttacatagaactggtaaatattttaagtatatgtactcattatgatttctaaatatta

SEQ ID NO: 130739 - DNA, 1583 bp, Homo sapiens
gatgcggtggctcacgcctgtaatcccagcactttgggaggccgaggtgggtggattatgaggtcaggagttcgagaccaccttggctaacatagtgaaactccatctctacaaaaaatacaaaaattagctgggcctggtagcatgtgcctgtaatcctagctactcaggaagctgaggcaggagaatcactcgaacctaggaggtggagatctcaccactgcactccagcctgggcgacagagcaagactctgtctcaaaaaaaaaaaaacaaaaaaagattatgagctctgattatcatcagttttgcacatatttcgtgtttgttggtactttaggcaatctattggtgaattagctagatatttttgattacctttctatttcttgcctaatagatagtgaactgtttgagggcaggcactatattttatagctctttaaaatcctcaacccctaatatagttaattttgcatagttgggtgtaagtaaatgttcgttaattgactctagttattggcctttggttattgcatgaaggtaccagtaagggacagtgtggagcttttgctttgtgcatgttcaattttttttttaactccttctattaaaatagacattattgtattttagaatattaccaagtcatcattttataattatagaaaatcccttaattttttccacttctggaattactgtcaaccttcattactcattgtttgtacttaatgtttagatctaagctacaaaacagcataccatattttcatcatcattactcttttaaaaatttgccttcattccagtttcagggagtttgggcaatgcctgtgatatttgtgtcttgaaaatatctcagtggtctgtcagatatgaggttgatccaattttaataatagttttttctacttcctgatctttaatgggttgaaattatcttggcttttactggtagtgtagtcataataattttttaattgtaggtgctcaagagagaaaacagacacaaagtgttctgtattggttctatattattcccctggaatgatgtgtttaactagttttcttttaaactatcaactacataaattttgttcaaggctggtgtcttagcatttgcgttacaactataagtagtacacatacatgtcttctatattcatttagaaagatcactatcttaaatttttttttcatttcacttgttaaatatagtgaatatgttatttggggcagggaaaaaaataaggcaatcaggcaggttgctgacggcagtccaaatggctgatcagagagtctttatatgcattggtaatgtgttgtgcaatataagctgaaatatattccacaagggaggaaaacggaataggttacatacactgttcctaagtgcaatgaatataaaactccattactcactttaggcaggtgctttttatatgaggctttaaagtaatataaaactgctggtgaaatgattggtttatacagacaccacttagcttccagtgctctaaccagataaagagactaaaactattaagatatttctttaatgattcagggattgatgtttaa

SEQ ID NO: 130740 - DNA, 1037 bp, Homo sapiens
agataacttatgataagagtcttatatataacatgtatgagatattaagaaatacttattatttatgattcaaggtagagtattaagttttggaaactgtaaaagaagccgtgttataaaataattctaaagaaactcatttggtctatccatattcttttgctcttgtatataccggaaactaattcagatttttggttctgaacaccatcaacgactctttagagaatcttttagtagctcttgtttgctgactactatataggtttcctgtatttcttttgaaaaaattggtattgaatgagagtttgacccttaaggcttgagagccaggggagggaaggctattattaagttctgtttctctctcatcatctaacatagtgattggaacagggtaagttatctattgattatagctccctgcaaccacagtagatgttaaatagagtagctcagcatcctttgttataaagaaaaatgagatccaggctttgccactttctgacttgggcctttgcaaaatccttatttctccaatccttttttaaatatatatatagaatgaaaatagtaatagctcctaaggattattttgtgtttgccgaataaatgaaataaactaggcatcatgcatggcactcagtaagtgctcagtgcatgttaagtgctatgattactattattgatactactgctgctgcttttattgctgctgctgctgctaccactaactactactactactactactactactactactactactactactactactacgatgatgattgtattagcatttttggcatcatttaattttctgagatattaaaatttcctgagacatgaattttgagaatctgttaaaaatgctttaaaatgcataaatatacagcattttagataccatttcataggtgtaatgaactctttaaagtgtgctctagaccataggtttagaactccttctcagaggataatggataccacttcaaatggacacaattcaggtggcaaatattggaaaatag

SEQ ID NO: 130741 - DNA, 1023 bp, Homo sapiens
aaattcaatcggctagtacatttgcagttttcttttattaggtgtgaaatctaagaatcccctgccaactcttgagggctcaatccagaatgttgaattgaagtactgcagcacatcattggtcaaatgtgcctctgggaccatgggatcaataaaaatttgtgccaaagccccaggtatgtgcagctggaccgtgtaaaactttattgcctgtataggagaattggccttgcgttttacaaggagcgttactgaaacaagaatttactcactgttgctatgaatcagacgttttaaatttttacttagaaatttttctaattgtgccaggatggtacttcttgactttaacaaatttttatttagggaaaaatacttagttttatgaatggttatgagggagaaaaattaaaggaatgtttattatactttttgggggaataggaggtgtatatatatgtatataatatgacacttaaaattaaattaaaaagttgttattgtaatataattaaataggagacccagttgtttttaaattttggttgtaaatgactttaccttcctaccaatattttatttcataatatattttaaaaaccatttgtgatttttttcagtgcaaactaaatttaaggtaagtttataaaagtccagatttcatttaatttttagaagacagtgtgtttagttgtttccttttataagcttttctggacatgttctgcattcattagcaaatatgaaaacttaagagttaaaaatgctttacattttatgagactcagtataattaaatgtatagctaatattatcaaataaagttgaaatgttatattatggtgttagtatattttaaaatcaaacattctcaagtgactcatgttttatttttattattgttttataaatatttcttttcagttgatagtggaaaagagaagttgattcccttgcttcagggtccttctgacactaaagaccttcatagcaccaagtggctcaatgagagtagaaagccag

SEQ ID NO: 130742 - DNA, 1060 bp, Homo sapiens
cgaaaggtgtggtaaactatttgccatatgcattttaatttttttccccaaaaagtttaataaatatcttattgtaaaaacaatattttcaagtactagaaatgtcaagttctagctaggatactaactaagggaatttatagatatttaaatacaggtgtatatttaaatgtttacacaaaacaaagcatatgtatatgtttaaaatattttttcttttttcagatcatgaaattactttgtgttagttgattttcaaatttatctttattaaagcaccaccttgcagtatttctttgccattctcctatttttattgctctacttttttagcataatcattcatttattcatctaacaagtatttattgcctattttttgtgcgtagaactataacgatgcatcaaagtctctacagtgaatcaacttctaatgaggagtaagcatataaacaactacagctgaataaatgaatgatataaaggcttattttttgggttcagcttcatccattataaattatgttactttgagcaagtaaacctttctgagtattggtttctttttttctttacttttttttttgagatagaatctcactctgtcatccaggaaggagtgcagtggtgcttgcatcctctacctcctgggcccaagagatcctcctccctcagtctcctgaatagctatgactacaggcatgagctgccacacctggctaaatttgtgtgtgtgtgtgtgtttttgtagagacagagtcccactatgttgcccaggttggtcttgaactcctacgttcaagcgatctttccaccttggcctcccaaagtgctgggcttataggcgtgagccacagcacctggcctagtgttggtttgtcacctataaaatggagatactcttatctgcttactaagattgttgtgaagattaaatactgtatcctcaagtacattgtaaactttaaaacataatgtggattttaagtattaattattcttttcacaatagtaccctatattaaccagtgattgaaaatgtaaggtttttctgagtcat

SEQ ID NO: 130743 - DNA, 1043 bp, Homo sapiens
tagttaaaaggctttttttatatttatgctttagaaactagcataggcagtagtgtggatgaggataaatgacaggaggccatgagaaaagttaggaatatgttgcagtgaaaaaatgctaatgtcaatggagagaattacacagatttgtggaatattaatgggttggaattacaggaggtgattaattgaatatgttggccaaaagaaagagcacagtaggcaagcacccaggatgtggatttgaagagctgggtggacaataaaatgccttttactgaaatgaggaacaaagaaacaagaaccaagttttctttagggtaatagaagcaatagatgtaataatactaatagttctttctacgtgccaggaattattctaagcattttacagagaacataggcagtttgaataaagaactcatattcttcaccattacgtgaaacagcacaggctatggagatttcagactctagataatttatgattcaattcattgaattctatttactttaatttattggctgctagctgcattctagaggctggtatagaaagttactcagtacagggccctggtcaagtagtctatatacacatacaactaattctaatttgactttcacaaatgatataattgattgggagagaagttctgctatccaaaaatagaggaaaaagagattaatttgaattgaagaagggaggactgaatgatattagaaagatctctcaaggaaggattgatatttaagccttgagtgataaaggattgcacatgagtggaaaattcttattttagcattgcaaatattttcaattagcttacattgttttcttttaaatggtaattattattggatgaagacaatattcccataaaagtaaaaaatatataattgttgttaaaaagtgtttagtacatatttgtggtaaggtaatttttcctctacagtatttcagaatattcagataagtataattaggaatcatatttaaaaattttaaaagattgtagaatataagattggattgttattgc

SEQ ID NO: 130744 - DNA, 1571 bp, Homo sapiens
gtactaatcaactctgtcaaaaattgcctgtttctcacttaacctagttatatcaccactgtatttttaatactttttgttaatgctgtttatttttatcagatgactattaagacaaaagttttcgcttatgtttggcgcattggttgtaataaatgtgaagtggattctttaagtcaatttaagggcatctggcaactaggaagactaatccttggagtgaattaagggcatgaagacaaggacctgtcatttataggataagaggtcagtgaactatgtgggcaggataaatatatcaattagggagtttccctgagagtgggcaagaggctaagaatctgagtcaataggtcaggaatatgtagacagtaggtaaaagacatatctagagtgccagatggactagtgaggtagaggttatatgttttcattatattttaggggtatttgactattaagtgagaaaataatgctgtttgggggaagctggccttggaaaatagtgcattcccattagaagttgatagaatatatacgtagtggaacatcttggtcctggtagtgggatactaattatgtttattgtattaaccctatttgattcaggattgtttttgcctacaaataacttagttcaaactaggtcttaacaaaatgcaagagactaatgttcatatttatttagtgaataaattggagtagttttctgtgctattggtggaacaaattaaactttcactggttgagggcttacacctacacagtatagtgtgggaggatcatcagccagtttgtcttattgttttattggcagcagaaaactcttaaactgtgttttcccatggaagaggcatctcacttgaaatctcagaacttatactaaaaaatttatgaagtgggatgatagtgaattacagaagagtcatcaaagaaagtatgtgattaactgacagtttattgacttcatcctcagggccaatttaaagaaaagtgaggcagagttagatttcaagctatgctttgaatgctgtgtgaggtctttttgagctttttggttaagctgtaattaattaactcgattaaacaagtattactacatgaataaaagtacacacacggatttttcaaagaggtaataatgggttcactgctgataaaactgtggatctgagtttggttaacattaaagagcactccaaaattcacctgttgttttaatctcttgatagagaatggtaataattagggttctatatatgtattctatatcttttaatatatgtctatctctgtatgtttgtatatatttatttgacttcagagaaaatagcattaaggtttccttttccttttcaattatattttaaaatgttaacttttaagttagcttgaccctttgaaaaattgttaaaaattactgtcctcaggctttacaacttgtacagttatataatttcactcacagatatgaaagcaaagaaatattttaaagtcttctattttcaaatgcttcctaagaaagatgcttccagtttatgaacaataaaatgaaacttcataggtagaac

SEQ ID NO: 130745 - DNA, 1064 bp, Homo sapiens
aagaaaagaataaacaaatttaaattatggagtaaggaacttcaatataagaaaatatcctgtcattgagagtaacttacatggaattattattttttttatttttgggatggagtctcgctctgttacccaggctagagtgcagtggcatgatctcagttcactgcaacctccacctcctgggttcaagcgattctcctgcctcagcctcctgaatagctgggactacaggcacgcaccaccaagcctagcagctaatttttgtatttttattagagacggggtttcaccatgatggccaggctggtcttaaacttctgacctcgtgatccacctgcctcagcctcccaaagtgctgggattacaggtgtgagccaccacacccgccctacatgaatttctttatgagagaagggtcttattactgagattgttcaggtgtgttattttaaggccaaagaaagtctagttattgttaaaattaggggcataatgatgtaatgtagtagctctcaaccctatcaaatctaatgcccctttttgtaacatgtattttcttatgtccctttactatcttgaaataaaattcataattgtactttcctaagcttatgatttatgaataaatctatataatataatcttattaagggagaaataaaaggaaagtaatttataatagaagcacacatttttatatttagagcataactagatttgaagacatgatgaggtgttcaggtaagatactcagcctgccacatgtattgtaccgggacagttacaagtcttgcctgtgtatatgtgttgcatattggcaatgaatatcctcaaatgaaatagccgtgagtgatgtgattttctaaaatggtaaacatgtctttgtcaaatgcgaaatgatataaaattttctcctatattgctgagagatagatttctggagctttctgggtctattaaaagtgggtgaaaactgctttgtatttagatgtaaaattgagttagagtctaaattcaagtaattatctacaggtttttaacttacatggaaatctgcgagaata

SEQ ID NO: 130746 - DNA, 1082 bp, Homo sapiens
tcaggcttatttcacttaatataatgttttcgagattcatcagtgctgtagcatgtatcagtacttcatttctttttatggataaatacttttccattgtttggaaataccacattttgtttattcatcaactcatggaaatttatattgatttcactttttggctgttacgaattatgctgatatgagcatttgaatacaagtttttgtgtgggcataagttttcggtgcccacatttcctcaaaaagacatatagttgcagtatgacccagttatgccatagtattttccaaagtgggtgtaccagtttacattcctaccagcaatgtatcagggtttgcattcctccacatcctttccaacgcttgttactgtttgtctgttatgtcatagctatcctacatggtgtaaagtgacaaatagcttattgttttttatgaggacttatgtaacagtttaaaaatcttgtcttttaggtgctgtacttctttgcagtatacaaggactagcagttaatattgacccaatcttatatacgtggctcatctatcagcctcagaaacgaacaagtagacatatgcaacaggtaagagatttttaaataattttttctgttaacaaatatttttcttattcatttagtagaattatatatgtcttttgatggattcttttttaacaaatgtactagatttcctttgtctccccaccttacccctttcaaacaattccgttcccttatttttgtatgagaaattgcatgtcagtataaagtttctttgattattaaaggggctttctgtacaatggcttacaaaacagaaactagtttaggagtcctatttcaccagtcttcattctttcatagtgtctacatgtccattctcatggtgtgcaatacataagaattgctcagtaaatgaatgttggcttgtttgttttgttttgagacacagtttcactctgcctcccaggctgaagtgcagtggcgtgatctcggcccactccctggttcaagtgattctctcgggactacctcccgagttcaagtgattcttgtgcctcatcctcccaagtagct

SEQ ID NO: 130747 - DNA, 1023 bp, Homo sapiens
aaaattatgttagtgatcagaaatggaggaggagaaaccagagagttcatgaaagcaaaaaatgcttagaattttgaggagctactggtcagcaatgtcaaattctagatgttaactatgtgctttacttgcttatttgtagtataaaatggatacattaaataatatttaaggttacttccaactctaacattattgtatgattcttttgcttattttataatgttgcagtaccttttagcttcatcactaacaaacttaatcttatatatcactttgaattaattgtaagttatgatagtgattttcctcatttttccttttttaatctctaattatggtaaaatacatataacataaaatttaccttccttactatttggaataaactatatggtttattttgtggttcctcaatttgagtaagcttattgagtatcagttaacataatcattgcagtaccaaataatacatctttatataggttatcttatatatgacctaggtacttggcttgcctcaccctagtcctggccctgtgttaaacatactatatatttaaacatttccagatgttaatgtatcatcaacactttaaaagataaaattagattctcattaaatgattacaatttagactgtgaaaatctgagttttatttattttatcttattttatttttttgagacagagtcttagttgtcgcccaggctggagtgcagtggtgtgatctcggctcactgcaagctccgcctcccaggtttatgccattctcctgcctcagcctcccgagtagctgggactacaggtgcccgccaccatgcccagctaatttttttgtatttttagtagagacggagtttcaccgtgttagccagggtggtctccatctcctgacctcgtgatccacccgcctcggcctcctaaagtgctgggattacaggcgtgagcttttatttttaaaaacgttgtccattttttaagatgttttatgagccaaaatataaaacagaaaaccctgc

SEQ ID NO: 130748 - DNA, 1032 bp, Homo sapiens
ttttttagggctggcactatgtcttttgtctctgtattcctgacttccaggtcagttcatgatagatattagagagtacatgaataaaggagagaaaaagtaatgaaatgcaacatacaatgttcctttatttttgttttttatttgaaactctttcctgaagagtaacatacacttatatagagaacatttggtactgtagaaattatgcaaaatataattatcactacattttcaagttgtaaataaaaataaatatattatttgggaataggaaatagttatgttattgaaaagggaagaaaatgtggcacaacatttcaaagcttttatctataaagtgctttatatgatgggcagtggctaattaagattttcagattaatgggtaaataaaacctatcttagtctcttctttttagctgaattgggatcacaattatagagcactaaaagagaaaaatctaagtttctcaaacctcacatatagggccaaggacttacagaggcatatatctttcaaatagcacataaactagaaacttcagggaaaaatgcattgcagtcatttcatttattaaaataagaataacaaataatttttactttattggtttatcttcagtatatgatacttagatatgtagcccttgacctagtaggaatcaaaatagaggtggttccacttcaagaatttgtaataatcccttcactttaacacatgaatgtgttcagtattggcaaaagaacacgttgctaccaaaactgaaacaagatccttgaaacagaaaggatgttgccatggaaaaatgaagtaacactcagtgcagctgtgatgcattcatgaataggatatttttttaaaagatcatttgtgtttggtgtggctcagagggtcccaaccagatggtttccatgaacatgatctgacccccagcttgaggacttcttactggcagattacttcattttctttcccttggattgtcagatccttacattaattcagaatttactgctgcagatttatat

SEQ ID NO: 130749 - DNA, 1166 bp, Homo sapiens
gatttttaaaagctcagatagttttatcatgtaaatataagctaataatctgaggttagcttacatttcttgtgttacttgtattaattatgtatctggggaacactttgaaattgcaggtttgatttttttaaattacaatttgcattcaaaaacaatcattaaaatttttaaacattttactattaaaacattgtttttcttgcttagttgggtcaaaactattgaatatagagaacttactgtaaatgaatctagtttaagaaaacacattctagggaaagcattaggagatatacctaatgtaaatgatgagttaatgagttaatgggtgcagcacaccaacatggcacatgtatacatatgtaacaaacctgcatgttgtgcacaagtaccctagaacttaaagtataataataaaaaaaacaataaaaaagaaaataagctcatgaaaataaaaaaaagaaaacacattctaacaattgtttgtattaaatggaaatatttgtttatatgatccttagatgatttatactttaaactatgagtaattcttttcatgctgacatgttgatggggagcactgtacttttgtgcacatatagctgcagcttcctgtgtttcagtctgagtcatggtaaagtgggaaatatgagtttgaagcttaagtactgagcttaaaacacttaatcattttttcccactcttgcattgaaatagtgggagcaaaggtagttgagaccacagcaggccacttgttactgttgacttaagtacaaacagtggtcgaagtgtttagccctttgggaagttttgtaattgaacaagaatgcaggagttattttgataagatagagtagcaatggggccaaaactatgatcatccttaagctctgaagcaggccaaggatgaagggatataaagtgtttgctcttccaaataaacaaagataaattcacctaggaaaataaacttagcatttggtcaatttgcaacaaaatggtaaaagaattgaactgtttattttagaacttggcctaaggatgtatgggaaaatagttcagcatctccatttccggcctgattttcacaacagatttggaaacagagcagaaaattaatgcacaaacatgtttaacaataccaaacaaaatgctgtaaatcc

SEQ ID NO: 130750 - DNA, 1050 bp, Homo sapiens
actctatagaaggggtagacaaatatttttctgtaaagggctggttagtaaatacctttggactttgtggattgtagcttctctgtagcaactactcaactctgctgaaaagaagtcatatgcagtcagtacatgaacggatttggctgtgatctagtaaaaatttattccccaatacagacagattagccccttcactgtagcttgcagactctactctataggaacatactcattggtttaatcttaaccttttctagatcttaactacttttagaggaagctggaaacatgcatgtgctttctaacaataaaaatcatttgagaagtgtatgtttatacattagcattatgtattggtattaacatttatatgattatcatttgcatgtaagatgtgaaaaagttacaaataataatttctgattttaatttataatttgtattttctgttatttttgtttatgttacaaagtaagatttttttttctcctcatcccagggagattctatacaagcaggtgaggaatcaccattctcagattctgtgaccttggaacaaactacaagtaatattggaggaaccagtggacgtgttagtttatggatgcagtgggtgcttcccaaaattactataaagctctttgctccagatcctgaaaataaaggcacaggtacaggattccttttctttcttccctccctccctctgtccctccctccctccctccctccctccctcccttccttccttcctttcttttctgtctgtctgtctgtctgtctgtctttccgtctgtctgtctgtctttcctttctgacagagttttgctcttgttgcccaggctgaagtgcactggcgtgaccttgcctcactgcaacctcttccttctgggttcaagtgattctcctgcctcagcctcccgaatagctgagattacaggcgtgcaccacgacacccagctaattttgtatttttagtagagacagggtttctccatgttggtgaggctggtcttgaactcctgacctcaggtggtccgcccacgt

SEQ ID NO: 130751 - DNA, 1031 bp, Homo sapiens
aattcaagtaatttctagttgcagtgctaaaatgttgaatcttattaacattaaaggtttacgtgtacatattttccttgactttgtaatacataaattttgtcctgtttgtattaaaattcatctaaaagaccatgaggaattttcctcaatggtcatattgatacattatagtattgtcactaaaagtattgggaaaatccttgactgatatcaaatataacactccagacattaactgggctttcccctttcttgaaataaatgtcttatcttaataaacaggcctatgctgatttgcttattattctagaagcttttgtgatctcagcgcctctgtacatatccagcatgcatttgtcaatgtgaaatgtaaaatagaaagttttaatattaattgtgaagactgtgttgatattactgcttgtttcttattgcagaggtttgtatggtcagtgaactagaagatctcagtgcttccatagatgtccaggatgtatataccaaagtgaaatgtaaaatagagagtttcaatattgatcactatagaagcaggtaaataatgaataatgaatataagaaaatctgtatttttctttgaacaaagttaccataagactttttctattttaatttggctggttattaaaataaatactatacaggcatacctcggacatattgagagtttggctccagactattccaataaagtgaatatttcaataaaggaagtgacagaaattgtttggtttctcagtgtatataaagttgtgtttacactatactgcagtctgtgaagtgtacaatagcattatgtattttaaaatgtacataccttaatttaaaaatactttattgctaaaatgtgctaatgatcatctgagcattcaatgagtcataatcttgttgctgatggaaggtcttgtcttgatgttgatggctgctgactgatcggggtggtggttgctgaaggttagggtagctgtggcaatttttaaaaataagtcaatgatgtcatttgccacatg

SEQ ID NO: 130752 - DNA, 1031 bp, Homo sapiens
agtgagctatgattgtgccattgcactccagcctgggcgacagagcaaggctctatctttaaaaaagaaaaatagacatagatgttactcttatcgaggagatggaagtaaataatcagccaaataaatacataatttaccatgaagacaaatgttcttatgcagaactgtcagagtgcggtgctaatgtaaattgttctattgattgcattgtcagatttatgttttagttcagtgcagtgttgtgaactttagacttatttgaaatagttatgtatgttcaatttcttaactcagaaaaattgaagagaacagataaggtgaacttatgttttccaggccaggggaaggttggcagtcaggacattttgaaggagtatttctacaatgcaaagaaaaatctgtggtgagacccatttagttactatgatttttgaaaatgtactttaaactgtttatcttgttatttcataaaataggactaatggttacaagaatttgagttcagaataaattcttattagcctgtttcttcaaaattacatataaatttaaagctatttattctttgaaactgctcctgttttgtaaccatcttcctgttataacaattaagtaaatttatcaaagaggcaaaggtaggcttgcttttgttaatatactttatctttaatgtactattgtgttgactttttggaattgtttcccaattcttatgtgagtttatgctggattgttctttaccataaactggaagtagtaattttatactaaaagcaattattttttgtttactttcattaacattgcttttgcagaagatggtccaggcagaggccatacctagcggttgctcaaacctaaatttatacaaacttgaggagaatttaaaactatccagatatttttttgcttatggcttttattgctttttgtcttttcaccttctttgctcctgtccatcacttcaagccttggggaagagtgttggtctttggggcaatgtggaggtgtcttcctttcctgtactg

SEQ ID NO: 130753 - DNA, 1050 bp, Homo sapiens
gtcacttgcatgagtacagactaattttacctcaatataaggaaatcaaagtaggacattcattatatttttttaaattgtgcatgtattgaatgatcaagagttgaccaatactgcttttgtcattcctcttacgattcttaataagattgcctttaaaaattttttttctattattatgccattgttttcttacaactaattcaaagtaacttgtgtggtaccttcttgaatctgaacaagtttgcatttctgtcattgattaggtagatgaacacaaggctgtatcagtgacttttagacgtttagaaccttgacttttttaatggtacaacatctggatatgttcttaagctaattcttttaactgatattcttaaagttaactttgttcttaaatttaatttttaatagtgtatttgcatagcaagtgttatgttctgattttattttgagcttttactagcaatagtctttaatctttagtgcaggaaaaaaatgtgacttttgtgttggaggaagtgtttagatttattttcctctctttgaatgttcattagtgtctgtgaaaaacattcttaataattttaacaaatattcataaagaaaccgtaaatttatcgttaatgttcttcagaaattttttctaaatttataaattaaatgccatttaaaaagtttctttacttagtgttttttaacattttattttaaatagtataaagtattattactgtatgaaaaaatgatatttatattacctcaactagtattcactttttgccttatgttaagggagttaaggatgcagcaattaaaaaaaaaacaccctttcttcatgtggcttacctttcaagtatgcttacattccacgtttaaaatatttttccaaattaaaacatttatacattgaaataccttttatactctttacaggattcaaatgttgctattaataaagatttattatgagttagatttttttagattagtggtcagtagtaaccctctccccagtttagacacttagaacagacaacatcactgtga

SEQ ID NO: 130754 - DNA, 1016 bp, Homo sapiens
ctttgacttccagcttaatctttttatttcacaatagatgacttttaaaaatctagcatgtctagaatgagtagttcctcatgaggctcaattttaaaaaatagagttaaagcaaggaaggaaggcattcattttcatgttgaaaatatttctagaaggaacatttcctcatatggtccaactattaaatacaggtgaaataacccaaaaaagagaagctgatttttttttgcggtgataaagtaactgaagaaatgactcaaggcactttcatgtataaatacatatttttattatttttttttacatctcggtgatatattttgataagttgaatactttctataataaaattaattattttaatctagtttatgaatgatctgcattaagtgctcttttttttaattataacttcatagtcagtataatctactgagaacacttttggccctaacagaaacagaattctgttcttggatctggctttgtatgtaacaccaagtacgtcatttctcctccatatttacctcatttactgcaatgtttctattacatttcagactttcatatggtgagtagtatctgtagcctggaagaacagttagcaaatatactaattgcacctttgtggtacggtttattctccaggcttactacgtaattgaggactgctgcttaatcagaggttttacccacatggaactatttgataaggttggcataaaatgcaagacctgtaaaatgtaaacaatgttcatattataaggacccataatcaaaccaaacctctaagtcatttgaaaatagtgcagctgcatgagaagtagttttctatttgatcttttgctatggatgtaaaaatactgtctttactgtgacatccgtatgctaatatttgttatgatagttcatctctttttttctccttttgctgtcccttctcccaccttcctactattttgcctttccctcctcccttcatggttatcttattctggttccttatttctctc

SEQ ID NO: 130755 - DNA, 1046 bp, Homo sapiens
agacaagattaacattcttttattgatgagcttaacatcattaacaattatgtttgtatgcttcaacacattgtgtttattttaaaataggaaaaccattcttttttatggacatgtttataatagcctttctttattcctgatgaatgtaactcaaggtatggcatctctcctttatgtatctttatggtttctcctaaaacctagcttatcatctttaacactgagctgtattttctagatgcagtgttaagattaaattctacaaatccccacaaaactgtttcctccttcctcctcccaacttttaatttcttcctaattatataaaggcattctcaaaataacctttgttttggtttttggcaaaggtatgtttcgtatctggtgacattatgaccctaatcctataatggttagtgttggtttcaaataattcccttttagtaagtcagagagagagagagattgggatagtaggtatttagattaacttccctaaaagctttgtttgaaaatattatcggcagagttttagtgcgtcatggtattctgctgatttagttgaaggctttgcatttacatttggccctcaccaaagtaactgcatcttttgtggcttcctgtagcaggatataggtttccatgaatatggtttctatttactgccaaaagctacctcaacaacagtgttgaaaatgacgataagttctaccatcataaatttttgaaatgttttttaaatgtatttacttttatattgccacttttatactttcttctagaaattcatgttagaagctacagaataatagaatgtttgggttcccatcataacagttttgtgttacgaatttggaaaatctattttatacttctttctaatatattttggttatattaagtacactggatatataatatcttactataaccattcctgctggtgtactttcattgaggcactaacattatcatgtgaaattattatctaaacatctctgagtttaaagacaagtgagagaaagcatagggtacctttaaaa

SEQ ID NO: 130756 - DNA, 1093 bp, Homo sapiens
caacgtgaggagactctgtctctagaaaaaataaaaataaattagccaggcatggtggtacattcctgtggtcccagctactcaggaggccaaggtgggaggatcacttgcgcccaggagattgaggctacagtgagccatgattgcaccactgcactccagcctaggtgacagagcaagaccttgtcttaaaaaaaaatgaattaacattgttcttagaccttaaaaagaaaagaattcaaagactaaaaggatatgcttatgaccctaatgaggtcagcaagacagcagttatcaaatagaaggtcagatattaaaaataggaaatgaaaaattattccaaaaaatagtaagattattggtggtaacaaaagtgatatgaaactatttgcaagaacaaaaaggagtaaaaatttaaaaattaatttgttaaaaagtcctgggatgatactaatatgaaattgcttaattacaccttaatttctcaagatgttttcatcttttgtaaatcttatggaattgaagttaagaaacgatgactgtaaaatatgcaaataggcactctcaaaataataatgtaattttgccatacatgtttgtagtacaaagacttgtacaaatttaatgaaaattgtctttgaaaataatgaaatggctaataatcttttactctatcttttagcatacggcggcatcaagaaaggagagcaattttgacccccgttttgacagatttttctgtccgaataactggagcacctgctgtcattttcaccaaagtagtttctccagaaaatttgcatactgaggttagaacataattttgattttattttagtctaaataatggaattgctcctctttgtatgttagggattgccacagtttcagcccataggacttcaaattagctcattaataataatggctactatcatagctaacatttatggagcactttgtagtactcttcagttattgctttccttgtaataactcatttagtcctcataataatcttatttgctactcctcatatccgtattttgtagatgacaaaactgaggcatagaggagctaaccaagctaccca

SEQ ID NO: 130757 - DNA, 1052 bp, Homo sapiens
agtgaaattaattagtctagctgtctttagcttcaacactccgttttcttataaatcatttagagtatatcctttggagaatattcatactgtggctcttagcaattaattgcctgcctaaaattgtctgtttacatctgtctgcccaactagattataacctcctcaagagcaggttgcccttcaaggccgacattattctttgtgatattcataggactctactatcgtacctagtacttaggaaatgctcagtaaatattagttggtttgaattcatgaacaagattatgctacacaattatattgttgctacatattgaaaacaataataatagttggagttatggaaaagtcaaataggtatgaaaaggtgaagacttcttattgttagttgtgtatatctagcacaaggcccaacacacagcaggccctcataaatatgaaattcatctgttaaattgtgtcaagtggctgtgctcaccatttttgctcttctccttaatgtatgaacttgagtcctaggaaatgtcaccaaagtagtgaaggtcaaataagtaagaatgataaattatcatctgaaagctatcatgtttctttatctgtattctaccgtttttgcttcaggagattttagtgtgtggccattccttagaagtgaatataaccacaaacctggacttcttcctaagtgtggctcaagttcaactcttacatcagttaatagtagcaaatatgactggactggaaccatcaaacaaggctgcagaggtaactgttacctgattttgatcaggcttactgcatttgttccaactttacattcacagtaggaaaactataattaagctgactgctttctgcttaattattctgtgtttaactttattcaaaatatagtcataagtcattttggattgatattctttattttagaaatttgtttggtctctattcctcttatttatcatgtacctttgcaaaattgctgtggactgacctcagaggaacctctgttatatacataactttattagcctgctgaagttcta

SEQ ID NO: 130758 - DNA, 1154 bp, Homo sapiens
agtgttctacagatttctgggaaagtctttactttctttctcctcctcctccttggaataacagtgatggaagtgaccagccacttgtgaccatgtgatgacaaacaagaggagaaaacacagtaaggataacaaagtggacagagaaaatggtcctaagatatcagtgacatcatgcagctactgcaccagccctaactttaggttatgtgagcaaaataaacctaaacagttaagtcgttggtatttggctcactattacataaagccaagcacaatccttactgatcagatgttcttacagtattctaagtctgagatgataaaacccagggaaaatactgagcacacaatggacttcaatgctgaataaatacttgctgagtgaattaataaatggattcctgaattcatagtaattctcatttctgttcctagaagtagaaaaaataagatgtatacaacatatacttcaaaagaattggaagaaattgttggctaactccatgtttgagggagacagataggttaagtacataccatggagtgctttgaatatcagattgaaatgttttgcttaagtcagtgagcaatagagagaagttggtgtttgtgcagctagacaatgacttaaacaggtgtgcctgaaagttcagatccgttttagtctgaagctctcagttgtgctcccacatcgataatagtcatctgtaattatgtgatcttcaaacataaatattatagttacattttacctgttgtattataatgaggacctattatctcattatttagtaaggaaatatctgtactatgtagtatcacccattgttttcagaagctacaattgttattgattatatagaagggcgagagtgctgagattgccctgggttacgttcatttggctgcagtaattattcatttattcctgaatagcaagtaatcatcttattaagtctacttacagaggtagtgtatgtaaagactaacacatgctcattttcaaatcagtgattcagaataaataaaacttttgtaggaaaatataaaccatgtttttaggggcaaagaatagaaccacatcattggagatctgatgtgggagttctttgatctctgcactacatatcctggagaagaaaataaagaca

SEQ ID NO: 130759 - DNA, 1052 bp, Homo sapiens
tagctgtatgattttgagcaagttgcttaacttctctgggcctcaatctttttgccttaaaatggggataataatagaaacttctttagtagagttgttctgaggattaaatgagttgatgtacatggtgcacatagaaaagttcctggagcatactgtgcatccagtaagtgttacctatatgttggcattgttgctttaaagaatatcagggaatcaactaattaggttagcattgttatcatcttaatcaccatcatcattgccatctacagatacttatcttgccacatttatgtgcattgtgcccaagatttacagaagtggatataacatgctcttggactcaagaagcttacaatatagagtgtaaggattaaaagaaaattgcagtatatatactaagtgctagataagtgatagagacagcttgttctacagcattgtagggaagagagcagttattgtgggctcataaagagaaggcctctcggaggaaaatggactcttatgagggagagcattctaggctgaaagaacagcacaagtgaggatttggacataggaaggtgaatgtgaagttccagaatggagactttgaatagaggagcagtgaggtgtgggttaaagaggaggccccagcattctggttaaaattatttagtaaacagtaatctgccatgtccagattctgaggtggagtaatcaaataagatttctctaattcacctgaggcctactagtttacatattgccttatttcaggttcccataattgtcatctagttgattgctttccaactggtgttgctacctgcagtctctagtcacctactcccctctgcacatttttatcgcattaatttttctcaaacatccttttgtcactgacttgcttgaaaagttcttagagttctccattgtgcatagcggtgtttctgaaacattaacgtgcataagaattactgggagttcattgtaggtgcagatcactaagtcccaccttcaggtcacatgcttatgacatggtgcctgagaatctctatttaaac

SEQ ID NO: 130760 - DNA, 1844 bp, Homo sapiens
taagaaagaggaactgatgttcttggagccaaatgattataactcttgctgccaccaagttgctctttgttctatacatggggagtcattggtggaaaattttgagaactagtagcctttattgcacaaaggaataatctaccctcaagggtttaaattacttaataactgacttgattttactttatcacttatatttgtccttgttttaagtcctattgtagtaggagaaaataaacatcttttgaaatggcatgcatttattttagtgtacttttctttgtccttcataatttaggactactgatttttccctttcttactgtccaaaaacctataaatcagttttataagaaaggtaaggagtatagcataaactacttctacgtaaaatgtaatttcaaccaccagtaatcatgattttgcagacagtttattatattgcttgagaaatcactataaaagtatgtattaaaataattctttaaagagacattttaaaagatatatgctattctgtattaatgcaaagaaagaagatctgacattcaaaaatatattttaatgatggaaatgaacattagatgctttttctcaagtatttccttggcatttttaggtgattttaggggtctggtgtagaaaatgggcacctattctatttttctgattactgttttaagttatactagactcatttttaaaattttctctttgacaacatgtttatataacattgtttatatgacacttggcatgtaactagtttgaaatattttattacttttttcttacagatctctaaacaagaacagaaaaaagtggatatatttgatggaggcatggctgaaacctcatctcgctacagtggtgctcaggatagtggaattggcagtgacagtgttaaaatcagaatagtgcaaatagagcagcacagtggtgccagtcagcatcgcattgcccgtccctcacgccagtcatcaattgtaaaaaatctaaattttattccctttgacatatttattactgcaagtagaatctcactaatgacctattcctgtatggccttatccaaatcgaaatcacaagaacagaagaataatgaaaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtataggtaagaaccttcaaacttactggagtgctaataattactatctaataagttgtattcccatagtttccagattgattaaacagaaacagctggcagacaaaagtcttttctctacagaatatggaaagttcatgttccacagctgaatcctgtttaagtaaatgtttgaaatgtattgaggtttagcttagtattcttactatgcctctgaatattcattctttttccaggaactgaatgaatcaggaactctttcttgactatagagatgcttaacagtttccagtgtttggaaagcatagctcgttttcatattaatggcccataggtatgctttccatgttaatgcttctattcag

SEQ ID NO: 130761 - DNA, 1951 bp, Homo sapiens
cccttcattaagttcactcagctacagtcgctctataggtgggtggcccgtactaaaaatcatcaggagaggcagaggaaagtaggagggggaaaggggccgagaggaacagctatgacctcttcctaaatttgtagatatgcagagatcacagaagcctcattttgcttacttcaagcccaacctaaggatactctgtatataacctcaacctttgaaattgttaaactgaggcaagccagggaccacagtaatagaaaagaactgccaatgatggacttgtttccactttctgaaattgtaagagaagattggcttcagtctgttttattgatatactcccaaatcatgtgtttatacattttcatctaagtctgtattcagcaaagttataagagctcataccaaagataggcatttgaattataatcaattcctaggttaaaataatagaacacttgtttaaagcggggaaaaaaccttgtatgtaaactgacgtggaacccaattttggtacatgaagctagagtggtggtcatgggctagatttaatataggggtggggggtaaatgtaggaggaaaaaggctcacatactttctaaggagcattttctgcataatattctcatggatgcctttccctacacagaatgcatctacttgaacatttatattatctcagtagtatgactcctggttagtaataagcaaaagttatcaatatgcatgataatatttcttaaaaatgaacttagtgatctagggaaatttttttcagaagacccaaaaggaggcaagtaattaaaatacaatggctaaaaataaaattcaactagcatttattgagtgatcaccctgtgccaggcattgtcctaactgctttaacgcattatctcatttcatgctaatgacaactctatgggaaatgttctatcttagagattaggaaactaaggtttagagaagttaagtaacttccccaaggtcacagacctagcaataaacagagctacaattcaaagctaagaagtgttggactcctgagtctagactctcaacctctatgggtcccctgaaaagaaggatctgaattggaggttctctcagtcagcctctattgtcccacttcagaccatgcaaaagattcctgtctaagttttaactgatgaatttttatgttaactgtgtctgtgatgtgattacacagtactcaggtatggaaaacctgggttcaaattctgtcacttatatgtatacctatatcattatgcacttatggaaatgaaaagagataattcatgaataattctaaagtacttagcattgagccagcaggcctaggccctcaaaaatgtgtgctggtactattttagctgtcaatatcatatagtgaaaagaatacttaactaggaggcagaaaacctgggatttttattcatggccctgccatcaattagtaaagtgatcttaggcagtttactctttgactttctgttttcttatctgtaaaatgtgatgattataatagatatcaacaaagtccattccagttctgaagtttcatcattctgtaatttggaattctgtaatttggctttggcttcatggagttgacatctgtaaggctctgcagtatcaggtagaaatttattttgatttgttttgaagatgcagatttcctttgatattctagtggagctctaattagtttattcagagttttaaatatataagttttattaaatgttaatgaaattatttttcaaaaactgatctggaaatgtgttttatatttgtccacttgaatgaattgtctaagtcccattaccaatttggctatccagaaacactttatgtagtactttctttcctgaaaaaagcactgttccataactggtgttttctggaagccccaagatagtaaccttaaggataagaaaaaagagaaaa

SEQ ID NO: 130762 - DNA, 1049 bp, Homo sapiens
tgtttctttaattattaagatttagtatattttaatgtttgtatttttaaaatgtttatatgccatttgcttttattgttttgtttagtaattttcatttattgcttattctatcctccactggtttttctgttggtacctatattgaatatgtgaactctttatatattaatggtatcccttttcttttactgtcacatatgttacaatttcatcttttctgtcatttgactttttattctgttcatggtgttctttcacaaaagttttgtgtggtcatatatgtcagcccttatgttttttagttttggtgtcttattgttattattgttgatatacaataggatagttaatgcacgttacctcagtatacattattttgctacttggaatctatttctagaaaaatgtagaaagttgattaaatatgccacaaggataaccattctcagcgccatgtaagtttgaatatgcagttactctaacttgttttacttatcctaagtcttacttgtcagttttttatacatcatattaacatttctacatcaatttaatcatctctgttcattattttgttatttatatcacttaagatctgtgttttctctattagatcactgttttatctccacattgtattctcttcaaaatgaagagttatgtctccttgtttagatctatcacggtaccacttacctgataataaccacttttgatgatagctgtggtggtgggacccaaaatagatgcccaggtcctagcaggttacatagttcctacaaactggttgtagatcctaccagcaacagactttttaatcatcctttcaccagacttgaccattatatttaaaagagagaatagtacagtgttactatgaaatggatctactatgcatattctcactgctttaaaaatcactgatgatataaaaagagaagactgcactagcttagtgtttgatcttgaccatatagatctaacgtcatgatcaattgctttcagcattttctttgaaatcacataaggttcatatgtgccaaatt

SEQ ID NO: 130763 - DNA, 1067 bp, Homo sapiens
tcagatttgaacatttttttcctctttgttctggaaaacatggttttgtcatcccacattgtacagtgatagtttatctttttcagcgcgagtgcttgtttactgtatgtgcacaaacaaatgaaacaatgaagcttgcaaacagttatttaaccagtttttctctcatttattaactcaaactcatatatcaaaatgagatatttgtgatgtaactgatgtttttaatttcaattttgtcactttagatcctgggaagactctgcctgaagcccttgattattgcactgtttggctacagacagtgcctggagaaatagacagcaaaagtggtattccaccttcctttataacactacagattaaagactttctgaatggaccaggtaagaaagtcataaaatttacatgtgtgtacattttttatgtgaatatattagcatgtatataggatctgttagtaatcttgacattccgtgcaaaaaatgaatagttcattttttcccagaggtgtatgcttttcaggctgcccattttagagatcaaaaggcaaatataaatatgcattaagaattaccttcagtctgacaaaaaggtagttatcaattaaagaatagttgactggaagccaaagccccaatattttatttctacctttcctattaattaactgtatgatcttaggtgattgatctaatcttctatacttcagttttcttacctgtatatgaagaggatagactagatggatgaatggataggaaacatgatatatatatacataagatagtatacatagatagattagatttgatagttaaatgtacctgtttcacatgcttagcaaagtgcttgaaacatagtaattactcagttttagatagatacagatatcaaaaatttttgagagctaattatgtcccaggcactatgcattttaggagtatgtactatagttattcttattttatgaataaggaagctaagacttagaaaagtgaagtaaattgcctaaggtcatagtgacagaggagccattcaaacctaagtctttatgactccaaaga

SEQ ID NO: 130764 - DNA, 1354 bp, Homo sapiens
cccaactagttttttttatttttagtagagatgaggtctcgctatgttgcccaggctggtcctgaactcctaaactcaagcaatccgcctgcctcagcttcctaacgtgctgggattacaggtgtgaaccactgctcctggccattaagaatttaaaataggctgggcatggtggctcacacctgtaatcccagcattttgggaggctaagataggcagatcacttgagaccaagaattccacaccagcctagccaacatggtgaaaccctgtctctactaaaaataacaataaaaataaaaaattagctggccatggtggcacgtacctgtagttccagctactctggaggctgaggcacaagaattgcttgaactgggaggcaaaggttgcagtgagatgagatcacgccactgcgctccagcttgggcaacagagcaagactctgtctcaaaaaaaaagaaaagaatttaaagcaatgattttacaactgtcttaagatctctagcaataccccgcaaggcatgaattttaaggaaggaaaaatatttatatatagactttgttgagtacatgtgttgtggcgtgctagtgtacttatgatccatactacagatggagaaagccagtcatggattaaacagagactgaaaccatctccactgactttgtcactggggacgaattcttcttcagcatgtttttctagtgctgggattgtaaaggtgtagaagtatgaagaactatttctaatcttgataaactctagatatggttttaaatatatgaaggaaagcaagaaactgaaggataagcaagtcattaaagtgtaggaagaagcctttggagtgaggtaatagactgaagaaggtgagtgctagtatttggttagtaagcatgaagtaccatatttcattccatctaagccactagcaattgtaaaaaaacattctatatgccactaaaaatgaaaaaaacatatgctctttacactgtgatacagggcctttttattacatcagtttgaagacacttcctgatttcagagttgttcacacatgaaagactgaacacaatagaatagatgcaatagggtaagaacacgtaattagttcatggaagagtgacaggggaaacttggatttacttatttctcagttttagtttcacattcgttttgtttttaggcacactttgctcattttggctagaaaattatcttgtagtttacatttgattgatttgtttgtaaaacaatggaatttgaaagttgatggtaaattagatacaatattttcaaggcaaccaaatcaattgaattttaagagaaatgccaatgaataaatgaaaaatt

SEQ ID NO: 130765 - DNA, 1040 bp, Homo sapiens
agatacgtcttatattgaaaaatcaatcatacttcttgcaaattcaaattcatctgtgaagtgtttggtatgacatcatacagaaatgtaggaatgtgcccacttgatcccattttaaaagtttttttaaccataggattccttaactttgaaatgcaatttttttttaatttaatgagagctgacacatgagaagaagaactggaaatggtgcagatttttctaattaactcagggttatttgcaaaaacatttgagctctctggtatttttttcattgttctttcacgaatttttgagccactgtcattgtagccatgaaatgacatttaaatgacaacaaagaacaaaaatgccacattgggaaaacattcccaagtcatttatgttttattataaattaatgcttagcatgtcacattcatcatataatttaaataacatggttatatcaaacacaagacaatgaatgcaatttcacatttcttttagtgtagtatatatggtgtctatatttgaaatgcatggccactggtctttttctcctaatagaatcacttctttagtctcaccctgtttaactcattcattaatttacctgtctagttgtcagtgtttctgatttcattctggcttctgattggtttcatctctggttttatttgattttgattttaagaatctgttgacttgaactggttataatcctgttttgaatacagttttctccttatattgtatggattaatgtaactattttataggttacaatgattttcatttctactttaaaataattcctaaacatccttaaatgattgcatttccacaaacctttctgatttgaatgaatatttgtacttaaatgctataaaatagtaaaagagttcttaggtacagtaacacagcattcaaataggtttgtttatatgaatataaagtagaaattttaagttgtttacccccaaatagatgtattttttgagtgcttttgcctttcttggttaaccctgcttttatgttattactgaatttattac

SEQ ID NO: 130766 - DNA, 1053 bp, Homo sapiens
agggtttacacctctgaactacttggctaagtaatagacctcaaagagtcatagaggctggttgtgcagttggcagggaggtagggggccagtactaggtctcatgcagagaagtcagtagagtcgcagtcatttagatttttttttatttcttcatctagcctaattctgttagaattatttcttctacagaaaagagtgagagtaattgggaaatgtcttcctaggaacatggagtaagccaagttagaagagataaagaacattttctggcttatcctaactctaactttccaactttctgcctgcagtttttttccttactctccagccccatgcctttccattgacacagtcttgagccttcctttcttatccctgtacaatagtctcttttatgccaacaactcccaaatgcagctcttttgacttaatatctaactctaagactatttctacatataggtattaggtatactttgttatttaaacatgttcacagtaaattaagccattttctctcttctctctccttgctcacttcttcctttatcatagtcttcaaacttttttttacaactgctgatgataggaaaaattttctggtcatgtcctctcacaatttactaccatcttcaggccattcttatttttatttcaagtccttctacttttttctttgaaatagtcctcaattatgcctgctacttctctggtgtaggcttaatccttgattacttcctcattctgtttactggtagcactaacttcagattctcttatttactcaataatgctgtcttctatgcccttactagatttgcctcccctgccaaatttatttgaatcttaactacccccttcctcagttgatccagtcaaaactctcctcagcccccaaccctttgtgcacctgttcactgtatttcttacatataaattgcttatttggcttaatctgattctgttttttttttttaagaaaaactgttttgcaagaggttttgtattgctctatcaggaggcatataatgtccaaaggtctctcttttt

SEQ ID NO: 130767 - DNA, 1047 bp, Homo sapiens
cgtgcctcctgtcttttggtggacctggtacttttgaaaggaatacctggtattacaatatagcctaatttcaactgcttttttggttcttggcctatcatcttttccaacttgcccaactgggactgccctagccactctgttcacacattgcacagaatatgttttgcaagaaatgtggctcagcactgtctctatgtggtccagtccctccagggtgagggactttgtggcctactaacgtacgtcttgtacagaggttgcactgtatgccctgtatggaaacaaatatacaaaaaacatttgaaaagtgaattacttaaatgtcttaaatagcaatttgtttcttattaaaccttaacagaatcatgtgagtctaggagtttgagtctgcagtgagctaggatagtgccaccacactccagcctaggcaacagaccaagaccctgtcttgaaaaataaataaataagttaacatagcaactgtttgggaatacatatagctctgctagattttcaaacgttctaaaaactttcatcaactgctgctcagtgactgagaggttgcatttgtaatccttaattactaaatttaaggtaatcaaaagaattaaattttgatacataaataacacttttgacataaccttataggaaagatagatcaagtgaccaagtgtccaaataagtaactcccttaccaatccactggtctgagaaagggtcgtccagaaaccagcaccacaaaaagttaacattaaaaattcactgttcaaattcacaaaacaaaataaatctataaaagatttaaataattaaacttttcaaatgatgttttttaaatcagcctgcagcatttttatgctgctgaagttattaaagtttaaaatcacactgagacttttgggacaaactatgagagacagagatccaagattgcttcagatttttcctaaaatatttagtgctgtccaagcatggtggctcacactttaatcccagcaatttgggaggccaagacgggtggattgcttgagaccaggagtt

SEQ ID NO: 130768 - DNA, 1214 bp, Homo sapiens
tcactatcttgaaaaagggactgttcaggtgtggttacatttttggtcttctttccggtaaagaataatgagataataaagaggggaacaagaacaattgttctccttggtggggcggtttcatctttatatagatagcagaaatgtctcttctagtacttgttaatctctaagagtttttaatttaaaatactcatcacaactgggaaccatattttgaaatgaaatatttttacctccttcagcattcagttagtacttcctgtagatcaaacagtagtttaggtatttagaatattaaaatataggacagtccaggagctcacagctcactgaactatgacagatacctaagtaggtaactacaaaaataatatcagtaggtgcctggtaatggcaaaatgcacaggatattccaaaagtaatgatgagaggcacctcactcatcaacaagggtcaagaagggtgtgctggccaaagtgatccaaagtctgagtctcaaaaaaaaagttagcgcttggcacagtggtgcacacctgtagtcccagctacttaggaggctgaggcgggaggatcacttgagcctgggagtttgaggccaacctgggcaacataatgggatccaatctattgaaaaaagagaaagacaagttaagcaagcagccagagttataaatagtttttttctgtgtccctgggaccacaatggtgcctgagatatgagggtagcaatcagcagctttagtatttacctctctatggatgctttgccagtctgcagtcagggaaaatggatcccttaggttcagcagttggtttatgtggatatttgggcaacctcctgggtaggttactaaattgtttctacagaatgagtacttctgacccttctttagttttcattttatacacccaagaaaaagacagtttcaggatcgaacatctgagtcttctttctactttagctttgttttgtttttgttctaatgatcatctgttaaaattgcaccttttttttattgttgttaaaggtattattttctgtgaggtcatagaatttggaagcccacatacagggatgcagaggcaaatgtgtgagtcattttagccatccaatttatctaaaatatttttcccaccagcctcttccagtaccccaaattctacaagtcaaaaataaaaataatgcctttcaacaaatgttgctgacataa

SEQ ID NO: 130769 - DNA, 1046 bp, Homo sapiens
tcatggtgatggagtgcaaaagatttcagctcaagaaaacatgtggagagctgtttcctgctttcaaaaaatttctgttcaaactactcagattgtgatctccatggaaactgtaccccataccagcaaaccatgcctgttagcatctctctcaaacctcaatggaagccttagtgtcaaggcaacacaaaaagtacctggtaagtcacagaaaaggggaggggggagacagaacaagtaagatgatttgttaacatctgaaaatgcatcattttgaagatttatattatgtagaagttaaaagttgtaaaggccattagagatgaggacatttctggtttgtgaccttatttttagagataattttagaacaaatcctttaagtaatgtctaaacagaaatgttcctgtcctcttgaggcatgttcttccaggtatctaaaactgttaattcctaaattcctttttacctaaaacagctatagtggaacaacagtatatcaagttttatgaaccataagaagagtgtttctcaaagtgtgatctctggactagcagcatcagcatcacctgggaaattgttacaaatgcaaattctcagaccccacccatgacctactaaatgcaaaactctgggcatggagcccagcaatctgtgcttcaacaagccctataggtgattctgatgcacagcattaagtcactggtaaccatttacttaaaaaagaaaagttggtgttgtggcagatatgctacacaaagtgtaacagaagccaaggttcaactttgcaagaatgctgttgaggcattttatcaggcagcaacacctggcaacgaaaagctgtgcttctgtgcctagcctagcaaagtggggtacagactctgcaaagtgactgccattgatgggaggatatgtgagaaatcaactggcagtgacatctacattttccacttctgttaccatgactaaattgttatatactttttcaaaaagcatgggaagtgtgggcagaaggattgtgaggaggggaagaggaaaggcaagac

SEQ ID NO: 130770 - DNA, 1030 bp, Homo sapiens
cttaatagtaacaattttgttatgagactataatgaacaccaaaatctatttttagtacagttttttctttatgcatactcaaacagtttaggatgataacaaggttagcaaaataataaactgtaattacatgaaataagatttattaacttctagttataaggactgatttcttggaaaattgtgattaagagattgccacatatttttttcaaaaaaattgattttaactgtatttttaaaataaaacataacttaagttttgaatgttaatttcattgtgtagttgaatgtcttaaaaattcatgctttgcaatttggataaaatacatgcaaacatatattcaaagtataattttgataagtggtaaaaactatccaccaccaccaaaaagcaaatatactcacataaaagcctcctaccagtagtcatatttctttttgtagttttcaagtaacattgttctacattcaactgaaattttttatactttagtatatctttgagctcaatggagttgatgtcagatttttatagtttgaatctaatacagaaatacttaactgtgtctttgattttacagtttatataactgttgtgaccatctgcagcagctgcacttttcagaattatttgctgaaccaaattgagcacagtgacaaaagtagtcatctcagatgtactattaaacgaaagaaaaaggagcattgccttggtacagtacagccatctgctgtacagatgttattgtatagaatgacttcagataaaataattgtagaaaattttcattaaaacctcaacaatttgcacttgtttatgtgaatctgcataactccccaatgagagaacacacttggggtttcttcggttctcactcactttctctttgatcctttttgatgtgctgattttaataaacacagtcaaaaacactgtgcaaaaacatcatggaaaaaactacaaaggaacaattatagcagcagaaactactctaatccctaacttatgcaagctatttttagtga

SEQ ID NO: 130771 - DNA, 2629 bp, Homo sapiens
attgagaatgtgttttagatatgtttctttgtcaaaggtacaaaaatatttgatttcacctaatgattatatgtttttatcatctaaactgtcataagcttacaggaagtgtatgtggaaaggaaataatatgatcaaaagtggtaagttaattttctcccccgggcattccgaatacatttaaatctgtgctttcagatttatttactgatttataaaactaaatatttataaattattgactgaagcagttaaaggaattcctcttattatcatttggaatgaaacgaaatggttaaatattttctactttaccaaaaatatctaccagttcttcttagcctcctatgttattctttaaccctaaactatgggagtttcataggatttgatttttttttaattccactctgcagatactggtatagcagtgacttagaataaactaactcccatttctgttagaatacttatgttctctcatgaatctttggtaaaatgacccaaaacttctgatttcagtagaggtaatgcttgtatttttaaggttggtgtataatattgctgaaaatcctatgattatattaaaagtacatctcctttagaaattatatcatatattttaaaatattttaaggcagataatatttattttgctattcattgaacccatcccattctatagtattttctgaaaacaaaacaacagaaaaaaagcctttcccttacgtgtatatacaacgcaatcatttttgccatttgaaatatgtagctttggagaaaccaaaagtatatagctataaattgcgaacttgcagtgtagcactttccagaggcagggtggagagtgagctacagactttagctccccttgtctgagtaaattatggctctgtttgggcggcactccttagatttcgacaaacgagcacacagttgagagctgtgaaatagctgaactttaggctgccttgctctttctcggggcacttagattggcagcctccatatatgtagataaggaaaaggaaaatagaatatgagcaagttaggtgccacaaaagattgggggaagaaccttaatgaggtcatcttggttggcattttagtcagaatagggaagaagttagaaggatcccctgtccataaggacttgggtgactttttacccaagccaaaaccagtgagttgaactccttctagtcaaaggactatggtttatgtaactttcactaccccaggctctgtcatccagatgtacttatctttttgaataaacaaaagtagagagagaaagcataaccacattatttttcacatatacaaaatgccttttctcatgttcactgaattcaggaccaataaaatgtaaagaacctaaagttccttttcatgtattgaaaagtgaaaccaggtcattaattgataaaaagtggagctccaacttttcattctatagttaactgggtctcccagggaaaatcttataaggcattgtcataagctttggatgctgcagagatgcgagttagcctaaggggaaataaaatagtaaattagatatgactacctaaaataatatgttgcaataaccagccaattacagcaccccaaagacttttgttacttttagcaagaaatagcatctctgtctaatgcctgaacaataggaaatgagttctttgacagttaaagccagaggacaaacttaacttttaagcagccactgaggattgaagtggaagtacagcttgtagacagctatacaaatcactaacaaaccttaatgaatattgggtgtgggcatcagggtcctgtcatttttgacactatgtcccaagtagcttaaacccaacacttaaggaaaggtggagacctcattgggtctgtaacatctgggtttttatttgtcattttggcataccccacaagcgcaaaagaaagagtaaaaggggattatcttgacaatgaaatgagttactgaatcttgtgataatgaaaagcagaagaattctaatgcctttctatagtccctgaggtagaggtgcgtttatggtttagcagaagtaaaatgtagaggggaagaacagatggcctaccgtccgtgaaacatgacacctcccctcccaggactgagtaccactattaatcctggtcagattccctcctattactttataacaaggttcaaagttgctactgataaactggcatgtacttcttttttcacccttagattacctgtagattactgataatttttgactatgatatatctctgtatatcctggtgaaccttgaggcattcgacaaaaagtagaacaggaatttctaaaaattggctgggaaataagaagaacaagtaaaattatcttaacttttttcaaaaaatgtcccatattatgttttctaatatgacgagaataaaaaccataaatgtatgagatactgtaattctcctgtcctcttagaaattatatgaaatggagaagacatctcaacatacaaattatattctccttgctgtaactgttatatgattagatacactaatcattattaattaccactaccttagaaaagatttttttgacaccctcaagaaaggagattaaaaattatgactgtt

SEQ ID NO: 130772 - DNA, 1064 bp, Homo sapiens
agaagttttagatattttagaaatgtaatgctgttaagtcagaaaattatggcttcagttatggactgaagttaataaagatggttttttatttgggggtattttggggcctgtttctatttcttttattttctggagtgctttttttgcttgtttatttgtttgtttagactaagtggaagctttgaatcaggataattgtaaatgaaatggtagtttcagtttcacaatttgatgaaacattttaagaaattgatttccaccatgattatttttaaaccaaagtcttatctctaacacttttgtgggtgtgatgccttctgtggaggattagaggttgaatatcttatttctgcagtaggaatatacaacatatatgaaattttcaagtctctacagaattgaaaagtcaatgtggttactgtactttaaaacatgtgtatactgtgggcctaaggtgttttttaatctttcatcttttttagggatcaaatatcattagaaaaataagccatgggcattacaaacgtggtctggtgaaattcaatattcactatgacaatttagaatatgagctccttgggaggaaagttaactcaccactcttaactttgcatctaaatatcctaaaatgtgccattggttttatgaaaaggttttgatctacactcctattttaagttcaaaagaaagcctacattttaaagtgtattccttttctgggtatatttactttgaactatagcatatagtttttctcataaatctaacctgccactatctgtttttaagactttgtaaacttcaagtggttatgatgtgtgaagtttggattaaactaaaatttttagaaaacacacgttatatattttgattgttttgaattttaacatgggccagtaaaaaacttgagtgtctagcagagtaacatactgcactctgttactgtaggaaatcacagaaaattaccctttcccatcatgttaacaatagacaaatgaagcagctgttcttattcttaatgtagttgcttgaaaaacttgcacaatttaatgaaaatgtct

SEQ ID NO: 130773 - DNA, 1040 bp, Homo sapiens
gagatataagtcatataccagcaatctacctatttcaagtatacaattcagtggttttttagcatattcagagttgcacaatcattaccacagtcaatttcagaacattttcattaccaccaacaaaaaaacccatatccattagcagccactcacattaccctctaacccccttatcaggcctaggaaaccactaatctactttctgtctccatagatttacctattcttaacatttcgtataaatagaatcatgtaacctgtggtcttctgtgaccgacttctttcactcagcatgttttcaaggttcatccatgtttaccaagtgtcaatattttattcctttttatggccaaatgacattccatcatatggatataccacattttatgtattcattcatcagttgatagacatttgggttctttccacttttggctgctatgaataatgctgccatgaccatttgtgtacgactttttgtgtggatatatgttttgatttctcttagatatataactaggagtggaattgccgggttgaatttttttttttttatgggtagacttttctttttgagacagggtcttcctctgtcacccaggctggagtacaggggtacaataatagctcactgtagcctcagtcgcctgggctcaagtgatcctcttgcatcaacctcctgagtgggtagaactatgtgccaccacacccagctaatgttttttattttttttttcagtagagatgaggtctcactatgttgttgaggctatagatttttttaattattaatacaaagtagtcaacctgttgcaagcacagtgtcactagcaatatataagaacaatttcctaatattaaatattttacatgtgatgatatctgattacaacacttgataaattagtcacactgcaagctcttaatgcatttgtcttaacagccaaatatagaatgtgtgaaggcatccaacttatttcttgattattttgtatttggatagattttaatttaatcttcatgtaacttgatgccac

SEQ ID NO: 130774 - DNA, 1019 bp, Homo sapiens
atataagtatgactattaccactattacagattcagcagtctaatccaaaaatctgaaatctaaaatactccaaaatccaaaactttctgagtgttaacatgatgctcaaaggaaatgcttattggggtatttcagattttgaatttatggattagggatcttcaactagtacgtatttgcaaatattccaaaatctgaaaaatatctgaaatccaacacttctggtccctagcattttggataagggatactcaacagatattatgatgactattgtccaaactcctttcatcaagtagaagcacaggctagaccaaggagatctggagtatgatggatgactctacagaccagctggagtagtccaggagatcagagagtcccagggacccagacagtagccttggcatataagcaaaacacagcctggcagatttcagcaagcaaagagttggtatcaaaaaggtcttgctatgtttcatattttgttggagaaatgaagatcctatatgtgggcaaaattcaaagacagggatgctggcctagggagcaagacagggttgtaactaccagaagttagaaaggagggagagctggatcctagtggtgagaaggagcgcactcagaatctacaacttggatcgaggaacagatcaagactggcaacgaggctgacttgataccaagctgctgagctctcagttcaattctcatactctcccagataggagcagagtttgtcccagagcttggagtgggtctcatctgtggaaacaactctcttgagttgcaatattagaacgatacaaaatattttgtttcattagaacttcagttgaggacagaacatatgtaacatgaatcacaagtttgatttaatacaacagctttctccttgaggatctacagtgccaggccctgggcttgctctgggggatccagagacagataagacacaatcaactcattaaaagctcaatccttcagtctagcagggaaatttctgtggtcgtgtggg

SEQ ID NO: 130775 - DNA, 1079 bp, Homo sapiens
caccataaactagtaaagttgcccctgctctaagttttaactcagaagttctgagtatatttttattctttctctttaaggaaaaatattttcttgaaagatgtcatattacacacctgcatttgcttgaaacctggtagcttgataaatcgataagataactgggtcatatgttaagttttttgaaaaaccaacccaaacatagattctaataaaagaacgttacacatttccttttaaagtctaaaaagtatttctcagggctcttaaattaccatattctgataccaggggaaaataaaatctggacttagagtcttgtttgtacttagagggttttccggacaggaaggcagtcttgatgcaatgcagtaagccacaataccagtggggcattacaggtgaaaaatctgcagctgtaccccttcaccacagtgtattacaactgtatgctggaatatttcctgtacaaaaatagggtttggttaactttgtttcccaagagtagatcacattaaaatgttataaaatcatgatttcctgcatttgaatacttgtggtttctcaactggttccaatagtataagggtttttttttttttttttttggtatgacttctattagttgaagatgtatagaagcttttcttttccttcttcaaaatcaactaaaaagcagatacatataaaaagaaataatattataagctaaaacttttgagattgcaagcacattcatcttttatctcattggtagattttttaaatgatatagaaactcaaaatccaacttccattaccagaatacattttatttttatttagtaactattgaaaagtatctctactcaatttgcatttgttttgagtgatgaatatgtgtctcctactgtaaattataaataactgattgtaagaaatactctttatgtttaaaaggacagttaagccctaacacattcataaagagaaacctcccattattgtacaaagacaaagccggtttcttagcctattaaggttttgatgttcataatgctgtccatttatccctatctctagataaggactgtctcttt

SEQ ID NO: 130776 - DNA, 1017 bp, Homo sapiens
tatgtatttgaataaaatctttaaaatattgtactcagtgttgtttttaggttttatttcgatgtgttaaggacaaatagagttagccttttgtatccatcagttctacctccatggattcagccaaccaccaatcaaaaatattcaagaaaagaaaattgtgcttctactgcacatttacagacttttcttgtcattatttcctaaacaatacagtgtaacaactatttacatagtatttacattgtattaggtatcatgaggaatctggagatgatttaaagtatatgggaggatgtgcataggttatatgcaaatactgcagcattttatatcagggacttgagcatccatagattttggtatctgtaggtagtcccagaaccaacccctcatggatactgaaggatgattatatattcttataatgggaaaaaagaataagtacgtgacttttatacatgtatttaaaggcatacaacttaaatttttaataggggtttcatttggtgtgaatttattaatatgcctttgttaacagagtaaaatagggcacataaaggaaaattctgacgcataactgacatactttggtatgtatctccatagtaatctattgttttctgaattttcagagtagctgagaatattccagctgaagtatgtaactacagagccagcctcacacaagttgtgaactaaataaagtttttctttggcattcttccacatctcttactttaggctcccagaattcctccttccctaaaccccactgttggtgcagtccacattcattgcccctaggctacctaatggcttcccacagcagttcccatcttggactgccttatattatgtacctactccaaccctcgccttgtacttaaaaacttagtggtgctttttccttaaggtcctactctgccttccaatgtgccagctaatttttataagctattatatattaattttaatgcagaatttcaggagatgatgctggaaacaagtattttt

SEQ ID NO: 130777 - DNA, 1381 bp, Homo sapiens
ttgtggcatggcaagcagcatgagcatcatgttttcattggttccccttgttcccaagtcccacaagcgtgatgcagaagtgcccccagggggatgctctgcttgcagtagacatttggcacagttgaggaacttgtaaaatctaccttttctctgtgattatgtatcattttctcattgatttgtaagagctctctcctatcagaatgaatattccttcacctgtcatcaaatgttacctgtcttattccagtttactttttaaaatttgattttatcatgggtttcatgccatacatacaaaagtctaccctattataacattttaaaaatattaacatgtttcttctcttacactttcacttcttagccttcagcagttttatccttttggagtttacttttgtgtaaagaatgatgtagggacccactttggttttaccaagtgactagttagttcttgcagcttcattttccgtctttctcctacttatttggtgtggcaccttcattactttttttttttttttttttttttttttgaggcagattcttgctctgtcgcccaggctggagtgcagtcactggtgtgaccgctgctcactgcaatctctgcctcctgggttcaagtagttcccctgcctcagcctcccgagtagctgggattacaggtgcacgccaccacacctggctaactaatttttgtatttttagtggagatggggtttcaccacgttggccaggctggtctcaaactcctgacctcaggtgatctgcccgcctcggcctcccaaagtgccgggattacaggcacaagccaccatgcctggctggcaccttcattgcatagtaagattttgtctgtacttagccctttctctgctattttattcttttaatctatttgtatgttactacactagccttatcttttacttactatgggtttataatacatttaacaccttgtagaatttgttctccattattacttttaaaattttggctgtttttatatattattcttgaattggtctttaaaaataaacaggatgaatatacaataatatgaaaagaaatcctaaactactgtcttttataaccttattctcctctaaaggtcttaatgttataatttttataaaggtttaatttgaatttcaacaaatataaaagcatagtttctatttgcaacttctaaattttttttattttaacataggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaatt

SEQ ID NO: 130778 - DNA, 1958 bp, Homo sapiens
gtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacaggtatgcacattccataacagtttacagtttggccacatatgatcttttattaggttctgtatgctatcacttctgataataagttcaacacaaacaaaaatgttagagaatgaagaatttgatgggcaccattatacttgaggccttctctgttttggcaaagtgatgcatgttatttttgaaaaactggagaatataggttctctacacatgcattggagatcatgcccacatttttgtgactaatgcaccacatctgtgtggaaagtaacatattcccagaaattttttccaagtattgtggctttagtttgccaaagcttcaacttagctatgtatcaaattgtctaacggtccattgcagaaataaagaacctgtgtgaccctttctaatgataagcattcgatcttttcaaacaaacaaacaaaaaaagcagcgagatgaaatatgtgagtacaatacagtcttagttttttcctctactctttctgactttttgattcactaaaaagtactagataatggatttttaaatcaattagagagccttgattattttaataattttttaacttttatttcttatcagaaataaaccaaaccaaaaaaagggatgaagcgtaagtctatgataagtggcatatttaaaatgggaaacctgtccatgtctgctagcacaaaagtaacttcacagaatatttggatgataatatgttcaatgatttaagaacaaatcacttctgcttcccttactgattttagtgttatattgtatttccatcaagtttgtgttgctatttaagctgaaacatttccccacattttgtatatattacatttgtgtgaggctggctacccgagagaaacggtgcttcatcccccactgacctccttttgggatggagcagttaaggggaagaggagcttttgttctctaacttaagaatttgtatgagaataaatatttttctttatatgcatgaagacctatacaagaccaaggaattaattacctaacatggcactataatagcaaagggaaagaagataacacatctgttttatgttttaaaaatattttttaagggcattccatggttttcttgttgcaaaggacatgcgtaaaataagagctagtgtgatctaaatctttgcagctggttcaaatagccatgtgaaaaaaaagacctctatggctccaatttctgttttttggttgtattttgaacaatacatttaataaaaaacaaacctagaaaatataaaagaatcattgatagaacatttaaacccaggatatttttgtcttggtatcagaaccattataaggggactcatgtgtagcaactactgcaaaatggccttcagaaataccagtttcctcccagggtaaaaatactctcttagacacagctatacatataaataaaatatggtgcataaatatttaaatgttttaaaccacatcagagtgtgaatgactgactggctaacatagtgccttgaaggaatattctgagtttttttaatggaattgtatatttgattaagtagagccatatgtcacgtagcatattgctgacaggtacattctatgaatagttggttctgatttatacagggatttggcaacgttaacatgagccacaagaggatatacttctgtaattgttgctgtaattttcttgtttcctctcatgtcaagggtacttgccaccaagttttaatgtggtaggcacctaaccctgtgtattctaaagtaaatatgaaagtgcactactttgaa

SEQ ID NO: 130779 - DNA, 1064 bp, Homo sapiens
actgtaaagacgtggttgctgcccttctgcagcatacagtctaattatggagacaatattgaacccataatggtacaaattaacaagtgctctgaaggtgaaatatagaatcttatgtaagcgtaaaataggagaacctaccttgaccttgggaggatctcagaaggctgctcttaaaaccaaccttaaaacaggaatctggaagttgagtagaaacaagttggtcaagcaagaaatggagaaaaagatgtccaagcagagggaaggctctgaggcaggaagtagtttgatgtgttggatgagttggaaggaggtcagcgtagtgctggaggagctggaaaaggctagtggagctggagtgtcctgagcaaatgccctcagcaaatggagagtagctcaagatgcagttggaggcatgggcaggggctgggtaagatgattcatctaaaactcaacagcagtcaagttttgaaatcattgctaccaattaaaatccatagtagagagtattatggtagatgacagatgcttgttgttatgagtactttggtctcacttagccagaaactcttttggcgattagtgtgactatgaagcaaggttcggttcaatgggaatagatggatgatgtgagagggcttagaagtcctcaagggcctctggaagaataaggtatgtcagggccacttcaccacctgcagcatagagcctgcccacctacttcaagggcattctggatgattaggagtagattctgtttcccaagatgagtctgtaccctaatgggtacaagtctggtcatggcccaggctggattccaagtacattcatctgtagtctccttggcttcatgcctcctccgtacttgaatcacaatgcttctgagttgtatctctgtttactcccccacttctcagtaaagtggcaaatgatggagtgtgacattttgacattatttagatccatagccaggaaatagaggccaactggagaagcatcagttacatgttatctcccattatctgcaaattaattagctacttatgatgtttttcttatattct

SEQ ID NO: 130780 - DNA, 1045 bp, Homo sapiens
ccaggccttagccggtagaaagcaaagcagaggaagcttaactctccagtcatttgaagatgcatagcttgcatatccctcagagaccctcaggattctctggacactggagccaggatgggaagggtgatcataagagaacaactggctcaggagtgtggggagcagtagtcttcatgctatagacatacagtttctgggtggagaggaggtcagcaggaaagaatgaatagacaaccactgtcaccagcacacctttcattttcatactcatttgcactatttcaaggcctttttgtatttattacaagttttatattcacagcattcctgtgcagtattatttgttatgcatattttatagataaggagacaaatagaaatgttaagttaggtagtggcagaattaggactgaattccttatcttttaattctcaatacagtgtcacttcaatgttgtctcactcccctaggttttggcagcatgatttgtctgttagaatagccaagctttgaagtttgaaaagaagggctgagaaatcactggaatagtaggccacatctaaggctaaactaataggggattcttagtccaagtatgaacccttgcaaagtcttaactgtgttaccaaaaataataggagcttcttaatcacaaactctaaacataaaacaggtatctaataaactttgttttttcttttaaatttgtaactgcatcttgtggatgcaacttttaaaataagctgcagtcattataatcttcttaagactaaaacctagataacctagataatatttataaaaaacgacgtcttcttactatatttctgtatgctaatgtaagtgggttttaggaccctctgaagccagaagccttaatgggcccagagggtcttcatgggattccttacattcattacattcacagttgaaaattctgctgtgttctaatgagaggctacatgaggatcagaaaaactagccactcagtttcaaactgcacctggagcttgtcatagatgcacaattgagcaaaatatt

SEQ ID NO: 130781 - DNA, 1037 bp, Homo sapiens
acaatatggcacagaaggataacttgactaatttggctacagtgtagagtacatgtgtggagctgcaagagggggaagtaggctaaggccatgagggctcctgtatgctgtgctaagaagttttaataccgtcttgaggccatgatagcacaaaggtgtgataatctacgtacccagagagatcaaagttagctttccacagaagctaagtttgaacagtaagtataggttggcccagcggatgacagtggaggagtacaccaagaagaacaagggaggtatatataaacagcaagttatggtcaagggatttcaggttttgtgcagtgtaactcaatcataaaaattgcagaagagatatgtgctggtccactggctcttagagtggtagtggtggggaacccctgattgtagggatggccaactttcatggtgtaaatactccaaagcttatttcaggctaccaatgggttgaccaccagtttgcaaaatctctaaacacttaattgctggttttcacaaacaagtatgagccagctccagcacaccactgtctggcagagttgtgttctcaagagcctgggaatccatttcaagaagatatacatctatgtgatgggcagctcttggctactgaatgagtttaagtagaggaatgccaggatcacagatgtatttcagaaaagttctactaatgtatttgagaagacggtctagagaagattgagaatacaaacagagactactatggtcactgctgcgtagtgcaggagtgagagagattatagtaactgagctaagacagagtaagggcattaaatgatataaatgcctaagaaactgatatttctgtgaataacagcaacacattctgaacagaacttaaaaaaaaaaaaaaaaaaaaaaactacctgaaggctctggagactaaacaaaggcagattttggaggggagtcaaaattttgagcaagtaatttgcaggatgactttcccatttttttggctttgccttgagggcaactgcagtcacggcagc

SEQ ID NO: 130782 - DNA, 1002 bp, Homo sapiens
agaaatggcaaagataggattgtgatagggtcctttatccagtcccagggctgatttctggagttttctgcaagcctgcatgaaagagaatggggatatttcaagtgcaaagcgcccagaggaatggctgctggtgcggctaatggtctctctcttcctcccctggcaataaatctcagatattgaaatatagctttggagaaaaatatactgaagatttcttaagctttttacaagacactcaaagccttttcacaagccagtgctctgcaaatgtaaattcttgatgtctaaacataaaggtcctttactgagctaattttaaatgtgaattttaatacagagtacttggagaaaggtaatgcagctggcctattaaagcatggtattttgccatttttaagtaatgggaaatactgattaagaatgttataaagatttcagcatacataatgttgttgtctttaatcataacctgttaccatgagtctgtgtaacaaaagcattaactcagagacaatggcatacctattatactgtggcacttattatttccgtgcttttaaattatttccagaatattgaagagcttgttatttaaaggtcagaataatgcccaggacatggccaagcccactgagtgtcagatgcatggaatgttggatgacttcatagttataaaattatttcatttctcatgataattccggacttgccaagttagtgaattttaagaactctgagagcagattttaagataaatgtgaaataatccatacttctggagtcagggacttcccttcaggcattagttcatgtttgacttgcttgacttacacttggggataaaatgagttaggacaaggtcttagataccacattcccttactgggaaagaaaaccaacttgcacaactttggctggctcatatttcttgttatacaggcactaagaagcagcggttgccatgaaatactttatttaacctttacaaaaatgttt

SEQ ID NO: 130783 - DNA, 1018 bp, Homo sapiens
tatgaaagaaagatttaaattgtttgcatatgatataaatatatctttcttaaaatatcagttttcagccaggtgcagtggctcacgcctgtaatcctagcactttgggaggccgaggcaagcgatcttgaggtcaagagatcgagaccagcctggccaacatggtgaaacctcatctctactaaaaatacaaaaattagccagtcgtggtggcacacctgtagtcccagctactcgggaggctgaggcaagagaatcgcttgaacccaggacgtggaggttgcagtgagctgagatcgtgtcactgcactccagcctggcaacagagcgagactcaaaaaaaaaaaaaaaaaaaagtcagttgtctttccttgtacttacaaatcatagaacgttgttttcatttaaacctgtttcctacaaaagtactaattattattattttttggaatactcatatagttaaactgattttcttagctgcagttagtgggtaagagtagaaataggacatatatgaccccaaaacaaatccaaacatgaccagacatggcaatgctacatgaataaatataaatatgtatcaggaggctcagttggtaaatgttacaataagtacataacaaaaaaaaaaaagaacaaatacatcatatcttacatttaaaatgttgagggtatttctaatttgatatatctgtgatctcataaggaaagtatattaaatgaattgcatcttcaaactgctattttgttctttatcaaaagaaaaaaggtatgacaattgatgattaaaaaaaaaacccacaaaccaaatttagctttcattactgtctagccataagaaggaaaaaaccgtcagccaataccaaggttctttgatctcacgcttcaacctttttgtcctccagatgaatgaaatgatcttttctcaaatgttcagcaggccttttaccatttgataggaaaattatttttaagaaggtttaaaatgtgatctgaaaaaccacattgactctat

SEQ ID NO: 130784 - DNA, 1415 bp, Homo sapiens
atgcccagagatcccctgtgggtccccagaccaccctttgaaaaccagtgttctgatactattaactagatgggtatgtttaagcaagaaacatcttctctgagcatcagttccttacataacatgataaggtaatgaaatgatacatgtagtggttaagagcagcaccacagagccagactgcatgggttccaaccccctagttagaccctcttcatctttgtgaccttggggaagttacttctttgtgcctcactttcctcttctgtaaaatggggttaataatagtaactcccccacgtaggtactgtgaggattttgtgagttaatatgtatacagcacttgaaactagtggaacacaatattgcaatatatgaaggtcaatccttattgtcttcattgtcgtcattactgaagttctcagaactctccttggttcatcataggcattagtgaggcagctgctgggagaccatgaggaggaggaggaggaggagtgaggctgggtggaattctgccaagtaagatgagtggcatttatttacatatacatgctttctaaataaacactttgtgaggttactggtaaaataaccagaaaacaagtcttttatctgtcactacagaacagcagcaaaagtaacagggctgctaaagcaccatgttgtaggctaaatactgacaggggccagaacatttctgagaatgaaaggaacgccattaaatattctggggaaaaacaaaggtaaaattggtactgtcctggcagacaattagataaaataaccttttaggaatactcaagagattttgatatgccttacagtattgtcaaaattattttttctcaattatcttgtagttatgtcagttctgcatttcctccatggtacagcaaggtatacaaattattcagattgaagacaagactacaataatcaataatacaccatatcaaatattttataaaccacagctatctgtctgcaatccccattctggaaaggaggtaagcaaatcataacgattcttttgtctaagttttgataaagaaacaataaataggatcaacttctctttaacctatagcaaatgaaaagctaaccctgaatgtaggtaaagagaaattcacttatttttgttgtaattaaaaccatgaatgtcatggtcactgcttccaaggtaattaatgagcagaaatcctaccaagaaggaggccctgacacactgctggattagtcctgcctgtgccccatctgctcagaggctccagcctagtcctctagcatgctcactagactcctacaagcagagacatagtcatgaggactggctcctgggtcacatggaaaagcacatctgtctcacaggctgcagtgcctgggggagccatgcaggcaaaaggctagggcct

SEQ ID NO: 130785 - DNA, 1016 bp, Homo sapiens
gcgtggtgactcacgcctgtaatcccagcactttgggaggccaaggtgggcggatcacttgaggtcaggagtttgagaccagccttggccaacatagcgaaaccccatctctactaaaaatacaaaaattagccgggcgtggtggcatgtgcctgtagtccctgctacttgggagactgaggcatgagaattgcttgaacccaggaggcagaggctgcagtgagccgagatggtgccactgcactcccgcctgcgtgatggagtgagactgtctcaaaaaaaaaaaagaaaagaaaagaagatatgctttaaaaagtttaattctgctgtattactgtagctaatgtgctctctgcatttttttttttttttttttttttttagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccaggtattttatgtttatataaatgtctgttcttctttgcttgtcagtctagctgttcatctagatgccaagagagatacaatggtcgcagggctccccatatgtaatattaggctttatttttaattacttctagacattgtatacagtgggtcaagtgttataatcacatatggcttgtcccagcatactacttaagggatttttccccatatggagcttacgctggggggaaatgatggtacttgtaccacagaatgtcattatatgaaaagatcatatgtatcatcatacaaatagcatcgtatgaaaagatcatatcataatgaaaaaattacctgttatgagttc

SEQ ID NO: 130786 - DNA, 1086 bp, Homo sapiens
agtgagctatgatcacatcactacactccagccggggtgacagagcaagaccttgtcccaaaaaataagattgagtggtgggaaccatgtggtctcagggtacgttatggtaatcggcatcacagtgtgtgttcttgagccaggttcactctaaagcagttttaatttgataattgggttcccagaaattcaagcaaagaacagcatccagagttagccttgtcagccctttccaataaagaacatggaaatcttactttctgaaagtaacagaggagagagcctttgttctatcctctttgtaaagttgtactttgtgaatgcgttcccatgtaagattaagattgcagcagtaaacgacctgtgttattgccatattggtcagattacattttctccataatgaaattcatagacttactagggttatctagactcttttataaaagataacaacaagatcagggagagggtcctgccagacctgttgtcttgatagcttgcacaacaatgaagaaaacatttccctattgctaaaaactcatttaaaaataagcagtccacatttcaagtttaatagatgggtgtatttataaacagttccagaaactttcccttcaggcagcctttgctttttcacataagaagcaggcacgtaggttactgagctccaatctgaggcctggcaaggacgaaggctcccattcagtctctgcacgacgcagcagtgcagtaagcagcagggaaactctacctgtggcaccaagtaacgggccctgcagcccgtgtgctaaaaacgagctctctttgttttggtttatatttttaatgagctttcacaagaacattctatttgaattttatagaattcacccaaaaatcctctaagctgccgttccaatctcactgtataccaagataagggattctaatatagagggccaagttttcagagcctgttggaaactctgtcactaaaaatctatggacaatctgaagaccatctgaaagaaagcagtgattgaaggagtaggaaatgggaagatgctggaggctccagactcccaggttagcatccttgtcgag

SEQ ID NO: 130787 - DNA, 1274 bp, Homo sapiens
aaagtgcttcccgcaaggacagtgttttagttttatctgtgtgtgtgtgcttgatgttattttggtcaggttggcagagacttgggaactaacaagggccatctgagtccccttttcttctcagcaggaggcaaggaaaacagggcaaagggcttcttcccgtaaaaggcatctgactataggccataggacaggtctgtgaaagtctctggaaggcctcaaaagaagacttgatcttgaaataggagaatccatgatccatagagcgggtgagggactgtgggtgggagggctggcaagagaacagccagagtcataaaaacaaattccacggacaatgaaaaggacactcccccaggcctcaaatcatctgggaggactgggggctgagctgcagaaactcaccccatgagtcactggcagactgctcactcttgacactggaatctctgtggttctgttgtttttatgttaaaataagacaactaacacctgctaaattgaacctcagtggtattttcagcctactgactcactgaatgttttttacacttgttcttttcttctcttagcaaaatctttttggtttgttggcatccctatgtgtgtgcgcacacagatatttttcttttcagattactggtaaagatgcagctgcaaaaacgacattgagcatttcttcctgaaactggacctgcaataacagatgagctagtttgttagtgtccagatctgtccatgaaagtcgctcagtttcgctcactaagatgtgtgcagacctgctagaggaattgtggctattgtgagcaaatgctgaaatagcccttcttaggaaaaccagacagattcacggctctcacatgatttactccctttattcccctcactggtttttcagttaacatcctgaatatcaaaattgcacatattctccatggcacaataattacatcctcagaatggcaaatgataaggtttagtatctccccctttgttatgactgaagttatatggagggaataaaatttattcctaaagctgaagtatttctttataatctttctaaaacttagcaacataactttaccctttaaaatcacagcaggcagattttaaccttcaaaattgggcctcagtgaaggcatcaatactgttttaaccaaaccttgacaaattaaattatagtgaaggatagtttcatatgaaactctaggctgtgttctgcacctgcgattcttaccctttgaagagtgtcatcacccctgtgggcaagt

SEQ ID NO: 130788 - DNA, 1124 bp, Homo sapiens
aaacctcaattccagtgagagagaaaggttttccaagattggcaaagaggaagagcctgttttataaatgggataagcgagtatcttggtggttaagagctatgctgtgactcaaactctctgtacacttaacagctgtgtgaccttgggaaaaaactccttaacctctgtgcctcagtgtccgtatttggataaaaacaatgtatgactcctaggaatatgaggatcaaatgatctcatacaaataaagctcttagcacagtccccagacctagtaagcattcaagatagattacctataatccaaataataattactatatcaataattactcttaagtattaatactactaaattatgactgttatcattattatcaaaagtggagagttagaaaggggctaaccccttccagtttttcatcctcatgaatcagtgcaaatgtattgggctgaacagtctttctctgctcctgaggaactgttagctcctctctctcaactttgttgcctgacttctgaggaaagatgtatggatgacactctgaatagcctgacaggtttgttaaattctgaactaaacttcacagatcctgactgtgtggaccaaactccgtctgaacattgtattttgatgacgataataaatgtctactgcccttggtgtacttagataactggtaaacaaatgggtagtaaagacctttataatgagggtggggactcattttcaatccagataaaactgtgttccagatggagcctttcattttccgaggattttaagcctctgtccttactgagggcttttgttattccaggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtaagtcggtggaaaacccatcaggccaacccagacgttactgatttgcatgcttataccaagggttccctaagatagtgtaacctttcacatggcagacagtggctatctttcttacctctctat

SEQ ID NO: 130789 - DNA, 1110 bp, Homo sapiens
cccaacataatccacagacatgaggaagcctgtctgccgtgaacacttccagtgaagactaaaagtagtattttaagatctataaatgacttttctggtttttagcttttgcctagttcctttgaattttggaaggaattaatttgtagatgacatcatgcagtacatttaaatatggcaggattgagatttattttttaagtcagcatttgcttttcttggttaaatgcaaccagtttaggggtaataactgcttaatatgcctggcacattattgaaatcccttatgagtggctcaaaatgagtcagaaggtcaatttagtccttggctgggttcctttcacaacaggggttttcctgtgctgctgttcaggaggagcaattaaaactttttgtgtattcaaagctttccagctgaattctggccccatcaaatgatatcagagctctggcttttgcctggtggtgcagagctttcgtctgttagtgaatctttggggaccgtttttccccaagcttaaaaacacaagattcaaactctaagggattccttacttattcttctagcaagcctctttactatctctctgccatcgcacggactttctccagcttttaagacactttgatagcattgttactggaccacacgcagaactagaaacaagtctttctttaccacttcttccagagtagtcttgccaatgttcagtaggcaaaaaccacggaaagtttggtggctacctgagattcacaaatcagtggcttacaattgcaaacttcccactccacttgatctacacactagatagctaaaggacttcagggtaggaagaatttatagcttcagctgcctttgatgagcgctttctcagaaaatctcactgaagaacctagtgtatctcagttctatttgtgttccactgaagatgagccagacttttatgaacaataaatgtactttacatcctctttttttccataaaaatttccccttccgctgcccagcttctctattttctctggctttaaatcctaggatttagaaaagcagaaaatgttacagttcaaaaggttttttaatgctccgtccaaagccactggtttgaa

SEQ ID NO: 130790 - DNA, 1082 bp, Homo sapiens
gagcatgcattttataatcagaagatgttaataggctaatttaaatttgttagatttttaccatttttaagattatgtttaaaaacctgtatgagagaacatatttggagacaggaacaaaaatatggcttggaacagaaacagtatgtggctataagggttaatggcaggggggtgggggcggtggtgggcatagaattgagaaggaaaaaagcagaatttgttcaatgcacacaagcaatgagagtaaggtgtggtatgcccaaaatggaaaagaggctattcagagtggtcagggagcttagaggagcgtaaaggagagtgaaacttggagtccaggtagcctgaactgtgctttttctgtggctgagggtgagtgatcaaggtgtgaagtctactagtaggaatagacctcagttgatcctcaaagatggtgagtattgagagagtgtttatctctaacttagcctttgtgtttctcttcacagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagctaacttgatttccgtgttttgttaaaatttcattgttctagcacatctttaactgtgatagtttgtccgtttcattgcagttacttggtcttgggctatggattaaaaagtgttcttcatgagcctgtaagactactgtactgtgggctctaagaagagatagaatcctaataaaatctatccttggccttcattgccactatttggtagctgtgccaccaccacatagttgaaataggtaattcaaatgtagggtttcttactcagtattgctttattaataacaagctaacagtatgtaatagaatttggatatatatctaatccagaaaaggttacttaactagaattgagtaatgtctcctaatgacaagcagagtatggta

SEQ ID NO: 130791 - DNA, 1035 bp, Homo sapiens
gaagcagctggcagcgtcgctcgctgtgtggcagcgttttaaattagagctggaaaactggaggagggtcaccgtacctgccgcaggaggggaaggatgggcttcctgcaacctcccttgccccacggcttcccatcctacccccggccgcgttagctgaaggccagcagggacgcaaaagtttttaggccccttaggtctttaggtgaggctgggcaaaggagcagttagggaatttgggccctcatggtatttgccgcgttcccgtccaggttttaatggtataccgtgtgaccgtggaaaacacctgcctcatgatctgacagggttgtcgcgaaggtttaacgagtggacagaaaatttttagaagagaaagtgttgcataaatgggtttgcaatcgttaattaccaatgcggagctactgcttatttttcttgttgttggaaagatttttgttgcctttgctcgtccattactagtgtgccgcagtttgtcgcgtttatttagggtggtcgctcagtatatggggggcggggggaagatgaaacaggctaagccaagagacagcttaggctttgtgggaggaatccatccactgtcgtgctgtgcctctctaggtagtaaaatgtactatgcatgagaattccttttgatatcttttctgagtttttcttttattattttacccgagaaagggaaaaaaagctcagagtagtgagagctacatgaggtatgcaggacgcagagacctgagtattggacttcagtgccgcccctcacccatgtctcaacccaaatcttattcctgaatttgtgatataaaggacagcgtttagtcagtcaatagcttatgttattttaatgtaaatttttgataaacagtttaggaattgcctctcattttttcttaactcacttgtaggccggaatcccagcactttgggaggacgaggtaggatgatcacttgagggcaggagtttaagaccagcctggggagcatagctagaccctgtttctgccaaaaaagaaaaac

SEQ ID NO: 130792 - DNA, 1049 bp, Homo sapiens
agatgatctgtgaagtgattttggtctctttggggtccagacactgaatcaagatccattagtaccatttctatttctcataatgctttaatgtttcctcttcaaatatgttccttgtactttctcatcaggccaagctaataagattttccccactaaactcttacctcttctgattaatttatcagactgaggataaatgtaatatttgaagcttagttttgaccttttctaaataaggactattcagaatgtaaacaaacaattttaaagaaaagctgttgaccctcctcttctggttcagctttactctaactattaacagggcctttactgtatatttttttaaatggatgtctgttaaacagagtatgtaagtaaactgttataaattggcatattctggtgtgacttggtatatactggtatgtagctttgctgccagtaaatatttgaagtagctggtgtcatttgttttttcctactttatttctctttctttagtgatcatgataggaagagaagtatatttgccttataatcagtgctatgatgagaaatgtttaacaaccagatctctaggggaaaaagcagccctgatttgtagcatttgctgatctctgggtatactctcaccatggatgatttcaagctgccaaagtgacgtcactgaatgcagagttgggaagagatgtgcagtagcaccccatcatataatatttcccccatacagatacacctcaagaccatgggtaatattaatcgcaaaacagtaaaatcaacaagaagtaatgagttttgagtagtcattatttttgtttttaatataacttctttttttcctgaggcctttggacttgaatcataatttctttaattgtaagtttatgtgatttaatttttggtaatgacagagtttaacaactgactcacaaaattcctgaatgtttatgaatcggctcttgtgagctggtacaagctggctccagtaaaccattgcttataagggaggaagagaagtaataacaagaaaagcatcactgtgaatc

SEQ ID NO: 130793 - DNA, 1079 bp, Homo sapiens
tttatttatttatagatcctcttttaatcctcttgtttccagaaaggccaacacctgaacttctctgaaacaccattatctattatacctgacgtttcgttaatgtttctgttaggttctgtggtaataactttatatggataattttatttaattctagacaatcctaagaggtagattggtatccttattttacagatttggaaactgagacttagggaagttgaatgctttcctaacgccatccatttagcaattggtgaacttggaattagtaccaagtattctgactccagaccctatactcttaacttctaagccattgctttcttattattatctctagaaaaaagagtatctgtttatcaccttgtttaatctttcactttaatatcttaaactatctttatgaacattaaatgtcaaacatcacctttaatattttttttctccgtgagactgtaggtccatgaagacagtctgctctgtttaccttgtatgctcaggactgaaggtgccatataaaaggtgctgtgataggtattgaaaaaattcatgaactcattggcatgtttatatttgtagcaacgtattataaacctaatgaaagatagtcattatttggaaatgacagccagctgagtgtttttatttttttaagaaaaattttatgtgaaaacagtttaatgagcccccatataccttcactaagcttcagcaatgatcaacattctgtctttccagtttgctcttggctgggcttggtggctcacacctgtaatcccagcactttggaaggccaaggtgggtggatcacgaggtcaggagttcgagaccagcctggccaacatagtgaaacccatctctactaaaaatacaaaaattagccgggcgtggtggcgctcgcctataatcccagctactcagcgggctgaggcaggagaattgcttgaacccgggtggtggaggttgcagtgagccaagattgcgccactgcactccagcctgggcgacaaagcaagactctttcttggaaaaaaacaaaaaacaacaaaaaaagggagctcttaataaattgt

SEQ ID NO: 130794 - DNA, 1029 bp, Homo sapiens
aagttcttaaggatcctggaagacatcaaaggtaattctatttttttatttttcaatagttttaaaaacaaattatgaatattaatttgggttatttagcacagggagaaagcccaaagtaaattttaaaaaatgtaattttttactcttggaggaatgaatgataataaaacttattataatagtaaatattgatcacactagttttctgatttcatagttttcagatactaatgataacagttatttgggtttgcgtaatgtttctgcccatacattctagaactactttcaaattaattattctattttcatttttataacattaaaatgatgtataatttttatagaataaaataatttatcagttatataaccacactagcataaaatagacacctactctccctagcagcctgcttggttaacaaattccataaccttggttggatgccaggtagctgggtatctggatgagtctctccactagagaacttcttggaggtctgatggggctcaggtctttggtcagctctgtatgttttagattactgtaagttgaagaaccttaagagaaccctgttttaggaaagtctttaacttgtgtttattctcctgaatattcaactacattttggtagttgaatattctaccaatgtgtgtgtgtatatatggaaatgtgttttatttcagacatcttgagaagatgaaaaaatgctatctagtgagcaatggagattactacctttctgcagaaatcttatcaaaatttaaactgttagatggatcacagtggaatgaagagcatttaagaaatattcagtctgaagttttaaaacctttacttctgtattggtaagaaaacatgaatcagttacttactttcactttccttacgccagttatgagttatactttttttgtcttacggatatataacttatggaaacataaaatgacaagactattgtatctttggccttctttaaggtacttgtcctttagataatttggatgtttgggtgact

SEQ ID NO: 130795 - DNA, 1045 bp, Homo sapiens
atacaaaaattagctgggcctggtggcatacccttgtagtctcagctactcgggaggctgaagcaggaaaattgcttgaacctgggaggcagatgttgcagtgagcagagatgccaccactgcagtccagcctgggcaacagacaagagactctgtaaactttactcatatatatatatatatatatatatatatatatatatatatatatatatatatatatatatatgaaactatgtatcattgttaactatagtcatcctacagtgctatagaacactagaacatgtgcctcctatctagctgtaattttatatcctttaacaaatctctgcctgtccccctcttccccctaccctttccatcctctggtgtcctctgaggaaccctgtcttatacagcttcgtacccctcgaagcataatagtcacccgtggtactcaataagttacctgcctggatggtaaatagctacataaataaaacattgttttccaccatgaagtaataagaagccctttggcaagaagctactattagtacatctaaaaaagaagaagtcatgtcctagtttgactaacacagctctggcttactcctgttgtctcatataacactctcagaaactctagtttgaacagtaaattatgtggacactgtttataaggtgagtaatgtattattgttttcattggctgtatcagtttattttgtttttttgttttgttttgtttttgagacagagtctcgctctgttgcccaggcgccatctcggctcactgcaagctccgcctcctgggttcaccccattctcctgcctcagcctggagagtagctgggactgcaggcgcccgccaccatgcccggctaattttttgtatttttagtagagacggggtttcacagtgttagccagaatggccttgatctcctgacctcgtgatccacccgcctcggcctcccaaagtgctgggattacaggcgtgagccaccgcgcccggcccagtttattgatatgggtaaagcttgctagtatctgtgcctaa

SEQ ID NO: 130796 - DNA, 2036 bp, Homo sapiens
ggatcacttgagcctgggagttggaggctgcagtcagccaagatcacaccactgagctccaacctgagtgacagtgagaccctgtctcaaaaaaaaaaagaaaaatttggtggtagatttctaagtctaaggaataacattctgccaattttttcactgtccttgtcacattttatattataaatcgttgctacagctgcttcagtagacattgaagcaaaggcagtacttaagcctagatcttacctctgtgggtaacaacagccagatattaggagatgggactttggctgagtcctgggaaacaggtggagtcaggacatccaggaatgtgtgaactgggaccgggataatcggctagggtccttttatgtattaatgcttgcttactttgttctcaccaagtcttttatcaatagccatatagataagtaggaaaaattatcttcccctgtttctctttaattcactatttttcacttaggcttattagccttgctttttttaagtgtaggggagaatacatgaattaaaagataaattagacatcttatttttaggtagtttgccttttaaatacaaactcttaagttatagtggtatatactacctctttttaaaaaggcaaatgttggttgggctcagtggctcatacctataatcccagcactttgggaggccaggttgggaggatagcttgaggccaggaatttgagaccagcctgggcaacataacgagaccctgtctctaaaaatatatataaataaataaagtattaaaaggcaggtgttatttatagagtcattttttaatatagatgcccaggatttttggattcattggtgtgtcatgtttaatgattaataatgtattctaactttgtgttttgcattgaaacattacaaagtgccatatgctgagtgagaataatggagtacatttaagtgaaaatcctttgtgtcttttttgtgttatttcattaccactttacttggcagacagctgatgttccccattttatttggatggctggtactatgcagtgtgctgcagtagaatttaaattaaataaaaggaaataaaaaataatggttcctaaaatagcttctggttactagggttcttaactgaattatttaaagatacatattacagtagtgctgatattaaatataattttggtgatttcatacccccctttaaggttggaagtacaagcagatgtacagaaagaacggtacagtctaagtggagaatctggcacagtcagcttgggaacagttagtgataatgccagcaccaaagcaatggcaggatccattctgaattcctacatcccattggacaagtaaggaaaaaactgttaaaaaattgaaagtattttttaaattaaaggaataattcctatcattagacaaattaccagtgaaaagtggctaccaactattaagttctctgagaaaaggaaacagtgagctgtccagagtaggcaaatctgtatagatcataaagtggatttgtggttgtcaagggctgggaaagggaagaatggtaactaactgctaatggatgcaagatccctttttgggatcatgaaaatgttctgaagttaggtagtggtgatggttgcacagctctgatcacaactaaaaatcactgaattgtacactttaaacaggggaattgtatctgaataaagctgttctttaaaaaaaggtagcatagtgtctagaacagcataagcaataaatgtgtccaccactattttaaaacattgaagcattataaagagttctgttatatcaagtatgttttttaagtagaacgtgttctgcgttaaggtgttctcatagcttatatatagtctgaattttccacatagaaacccttcccccagtcatctgaacaaaaagaagtcagcaattatgtttgtatttgttactcttatatttcagagaaggcaacagtatggaggtgcaagtagatattgagtcaaagccatccaaattcaggcacaacagtggaagcagtagtg

SEQ ID NO: 130797 - DNA, 1092 bp, Homo sapiens
aaaaaggtttattgacatactcctataggcagtctatgaaggcttttttattcttcttaatctttgctcgttactgttctaattcacatttctttgaataacattgagttgaagatatttttgtattattggtcatccgtatttcttttattaactgtattcctcttcatatcctttacttagttatttataatgtttcaggcaaaatttaagatgaaaagtttatgatttctaagacattatattccaattagaggtcagatacccagaattacccccacctctttcatccatacactcctccttggcagtttattcacttatgtacttctgaatgaatactattaggcctagtaaaaggatggcaatggaaattctgagttgcatgttatctctggcctccccactacttacactgttaataagcacattttcttcctttgcttaaaggacttacctacagctgtgttagttccaccaacatttatatcattttcatcatcaaattcaatcctaactccttttccattgcctgctgagactccacaacctccgcttcgacaaagagaaattggaactacgccatagacataagctaacataataggaacaccgatacctaaagagaaattaaatcagtcattacaaacaacaacaacaaaataactcacagaaacatgagttttagaaagtcttttcaagagagtcatacagagaaaagcgccagggttctgaagagttggctggaacatttgccaaaagtagatttacccagttgttaagcaaattcaaggttcccagcctttcaggtaatgcacataaggggaaaaagagagagatgcaaacttttttcttttgaagtgccaggcctccgaactgtacttggggtggagtggggaggaagggtatcagccactaacaatttaccaactactttaaggctaggctcttgaatctgtaatactttcaaccaagacttactgcaggctcaatttaaattgtcctcaaattaaaaaacaattaaaaaaaatccttccacaaaactttaactccataaaattgtaggtaattagtacttttcagcattttctt

SEQ ID NO: 130798 - DNA, 5115 bp, Homo sapiens
gatataatcagataattgatgcctaaaaatatgcatgttttgcattaatttactattaaactgacttaagggtatgagggtaatggaagactagggataaatttttaacctgaatttcagttatcagtatcttgttaatataatatagattaaataataaaatataatataaaataagatatatcaatatcttgttaatataatttatagtggttcttaccttagtttaatgaactcagaatttaaaggggaaaaaagctcctaactatgagaagtttttaaaaatagtcattgttttaatatagtgcactaatttgttattgtggtgttttgcagcagttatttacattataattttttccgttagtccatcaggatgtactttttgggggaagaaaccctggagccgaaagaagaaaatattgtggcaactgggaacactggttggtgctcctgtcggaatcgctttaatagctggcattgctattcctgcaatgattattggcattcctgtgtatgtgggccgcaaggtaaaatgcatacttcttgttagtccattatcttattctaaatctttaggtgtattcttttagtattgatgatttttgggtttttttttttttttttttttagacaaagggtatctttagtttcttcagtataaaacagttactcttttttcataaatttttagtgtttggcaagcatatataaatacgtataaagcagacttgctttaaaatgttctgaatctgaaaattttagtatgtttgtattataaaactttgagtataaaatattgaaggatacacacctgagatttttctcataggtatatccttgtaaggtcaggtctatgagatctttttaatgaaagttaatagctaaataacacatgccctcaggcaaagaataattagccagttcttgaattatttctgctgtagttcaaagctttttttttggattactgcttttaataaatacactattttgcaaattataacaatcttgtgaaagtccaaacaccagtgactaccactggcctctaattgatgaattatatttcattagctaagcaaatagttcttttgttaagggttaatgggataatttatgaggtcctaagaagtctgttgttgcctaaattaatagaatctctggattgagaagtaactttcagtagaatatagctaaaagaaaaaaaaaagaaattttctttggtatccaagaagatcaaaaaaattaaaactttttttaaaaaataaaaagaaattaatcccaaccttgtacccaagcagaacaaaggatagcaattttcaaaaagggaactaacaggccaggtgcggtgcctcacccctgtaatcttagcactttggaaggctgaggctggtggatcatctgaggtcaggagttcaagaccagcctggccaacatggtgaaaccccatctctactaaaaatacagaaaaaattagccaggcatggtggcaggtgcctgtaatcccagactcgggaggctgaagcaggagaatcacttgaacctgggaggtggaggttgcggtgagctgagattgcaccattgcactccatcctaggcaacaagagcaaaactccatctcaaaaaaaaaaaaaaagaactaacaagctgggcatggtggcttactcctgtcatcgtagcactttgggaggctgaggcagaaggatcacttgaggctgggagttcaagaccagcctggacaacatagtgagaccccatctctcaaaaaaatttaaaaattatctgggtatggtagtatgcacctgtagtcccagctacttgggaggctgaggtgggaggattgcttgagatgggcaagtggaggctgcagtgagctgtgattgtgccacttcactccagcctgggtgatagagcaagatcctatctctaaaataaaaaaaggatctaaaggttgtcatactgtgtcataggtgttgtatgtacttttacttattttaaccctgcagcaacctcgatatttcggtctctgtgtgttaaaatattgagatttaggaaagtttatgtaatatatcttcagttacacacaaagaagcagagctgagatttgaactcagatgcatgaattcttaatataagttccatgattaagtttcagtagctatttgggaactcagtcatggggaaaccaccaactcatgaagcaatccattctgttgtaaaatggctactaattgttacaaaattgttacgtttgagtcagatctgtttccttttgtttcctttatttctgtttctaacttctgggacccgactgggaataaggttgatcttcttctgtaaaacagctgaattttttatattcaacatacattttataatcagaaaaataatatatactatttcttaaaaattagttttggggctgatgacaaacatatttataagtcacatatttatttctgaaggttttaagtgagtaaacctggactttaaaaaatgttgggccatgtgtggtggctcatgcctgtaatcctaacacttggggagggtgaggagggaggattgcattaatccaggagtttgagaccagcctgggcaacacagtgtgacaccttgtctctacaaaaaactaaataatcagctgggagtggtggtgcatgcctgtagcccccgctattaaggaagctgggatgggaggattgattgagcccgtgaggttgaggctacagtgagctgtgatcgtgccactgcactctagtctgagcgacacagagagaccctatttccaaaaaagagagaaaaaataaaaaatttcaaaatatattagctgatcgtaatttttcatgtagttattcaaagcaaggctttgctgaaaacaaaactattcagatacttagaagggaaagagagactgttgtaccacatgtacctataaatcatttatagagaagagattatttacctcattgttcaggtcatagggtacagttacagatctccttttttcaaacatgtacccaaagggttgtaaatgaatgaattagttttccattgaaataatattctgtggtgctttgggatcccaaccagcctaggaaaacctgctaagtcaataaagtacccaaaagctgagccttcacttaacaataaaaagtagagaatgtggcaaaaaatagtaaacagaaaaattaagttgaaccagaaatagtgggataatgtgatcactaatcaaacattggtgcttgaggctgaaaaattttctagaagactcctttctcttggcagcctgcctttgcaagtctgctccatcagttgtgccttttctcttcttcagtgctaagtttcccaggaatgggagtggggaggagcaggaattagctgcagtgctgaaggataatgaaaggtaccttgggaaggtctaccatctctgcctgcatggactgtgtagggaagtgaggaggctcattgacaaggaacctctagtcaatgctgggaaatgggattctgactaggaaatagaaaggtttcttgtcccatacatgcatcacccacctcccaccccaacctttctactgttttccacaacactcatcgtactttacagccttccaaaggccaaaggtgttattataccatgtaataatagattattttataagtcccatctgtagtattgtttataagtcattttattttagagagtccccatacttttgaggctgttttgaatttgttttggaacagagggggaaaatgtgccatattagcccttgcaaaccatgaaaataaagatctcaaagttcatataatttcacaagccagtttttaatcaccgcttctatgatgatatcaaattctacttattaacacctgtcctgtacagagattgctgagtgaattcaatcctgtcttctggtagccattatttatcatcttttttctttctctgccatttactttgagctataaatgagagccctggaatttgagtcatttgtcaatattgtcttcataaaaaggatctgagaaaaaaataatactgtttattcatacttgtttattagaactgctttttaaggtcaatttttaaaaagaaaccttccctagaagccaatttttaccatttagagaatattctttagaaagaaacctttagaatgctggaagtatcctgttggtgaaccatgtaactcataactgtgttgaaaataataatcttaatttcttcctctttgctcgatacataattacactacttttgattaagattataaagatgacttttactcagaacttttaagcacaaagtaaaatccattaaatcactgtcttaagcaaattaataaggagcaaattatttgtgagaatatataatagtttaaggacactagtaggtttaccttgaactaagatactcagctacgaacttctatgaaaaatcactttagcaagtatagatctttttcaactaagttaaattgtaatgtattttctctttaatcccccacccctatttttattaattcaagattcacaatcgctatgaaggcaaggatgtttcaaagcacaaacggaatttggccatagcaggtggtgtaacgttgtctgtaatcgtgtctccagtagtagctgcagtgactgtaggtaagaaaatgctgaaaagtactaattacctacaattttatggagttaaagttttgtggaaggattttttttaattgttttttaatttgaggacaatttaaattgagcctgcagtaagtcttggttgaaagtattacagattcaagagcctagccttaaagtagttggtaaattgttagtggctgatacccttcctccccactccaccccaagtacagttcggaggcctggcacttcaaaagaaaaaagtttgcatctctctctttttccccttatgtgcattacctgaaaggctgggaaccttgaatttgcttaacaactgggtaaatctacttttggcaaatgttccagccaactcttcagaaccctggcgcttttctctgtatgactctcttgaaaagactttctaaaactcatgtttctgtgagttattttgttgttgttgtttgtaatgactgatttaatttctct

SEQ ID NO: 130799 - DNA, 1036 bp, Homo sapiens
gtaaacactgaccctgtctcaattctaacaagcattttagacatgagtttacatcggcaaatgggttcagatcgagatcttcagtcctctgcttcatctgtgagcttgccttcagtcaaaaaggcacccaaaaaaagaagaatttcaataggctccctgtttcggaggaaaaaagataacaaacgtaaatcaagggagctaaatggcggggtggatggaattgcaagtattgaaagtatacattctgaaatgtgtactgataagaactccattttctctacaaatacctcttctgacaatggattaacttccatcagcaaacaaattggagacttcatagagtgccctttgtgccttttgcggcattctaaagacagatttcctgatataatgacttgtcatcacagatcttgtgtggattgcttacgacaatatttaaggatagaaatctctgaaagcagagttaatattagttgcccagaatgtactgaacggtttaatccccatgatattcgcttgatattaagtgatgatgtcttgatggaaaaatacgaagaatttatgcttagacggtggcttgttgcagatcctgattgtaggtggtgtccagctccagactgtgggtaagaagataatgtttgatttttcttgagttaatttttttctctgtggataaaataatttgctattactcaaaagaaaaatttttacatgctggagaattcattcaacagacatgttgagtgcacaccatatgtcaggcactatgctaggtgttaaaggcagtgatcctatcttactcatttctatatcgtctctgcgttacatactcactgagcacttttagaaggaaagggtaaggtggtagagtacaggatctagttgtatacaaaattggttttctcatccatttggagaatttttattttggaataacagatgaaatgatcaggtttgtttatgatgagggggttatttgtggtcataaattcaaatgaccttctttattttttttctctttgttgacatgtttctc

SEQ ID NO: 130800 - DNA, 1028 bp, Homo sapiens
aacagctggctttggaatggagaacactacaattcaaatttgaagtatattcagaagaaaactttggaattagctttacatttgtttgtaaatctaaacaaatatgcaaaattggtcaaaatgtaagtatatagcatttttaaagattaatggttccttttatgtgctgatttctttgtattctgttctctgcattcatcattcaggaataccaccaataaatgtatttatatatcccttaatcacgatttctcttttttttttttttttttagtgtattatagttttaatttggggattttgtaatggattgcaattagctgctttttaaaacacagctttttttcaaacctaatgtattaggtatattgagtttcatatatgtttgccttataaatactgtgaaattaatttgagtgaattgctcgtagatttaagggtgatgatcataactaccacaattaagcccctcccaattatgcaagtttttagcatgcaagttttaccctacgcccccttgagcactacatgaccccagtttataagatgagaaaatggacacagggatggctaagtaacttgtccaaggtcaaacaggtaggacctggtggaagagggattccagattgaggctccagccccaattatgcttgtgctttcctcctgtcccgctgtctttcatgaatctggaaatggaaccatatttatccagaacctcgcctgataccatttcagcaggacattactaaattttccactcgtggtcctatatacttactttttttcctttcttacacatcttcccagtggtagaagctttaatattcaagctccaaccctggcttgtcagaaagtcttccatagttaaccgtacttgactgcctccttcccaacccctcctttccccaccacttaccacactcagttttattacttgtattttgcattccttgatccgtttctctgtaaacatgattttctttctaacttgtttaattgtaagcttcatgagagcagggacttagtct

SEQ ID NO: 130801 - DNA, 1052 bp, Homo sapiens
cttctcaagacccaactatatatatcctgtcctacagttcttaaaagaacccctgtacactaagtacatttcccctttttattcaggatgtctcagccaggcacggtggctcacgcctgtaatcccagcactttgggaggctgaggtgggcagatcgcttgagtccaagagttcgagaccagcctgggcaacatggcaaaaccccatctttacaaaaaaaattaggatatttctaatgagtttctaggactagtgtctaaagagttataagcccacatctcactcctataggtattctaagttttctcctcacatcaaattagatagaattagatcagattacatcataaagccacactgcaaagcaggatcaactcctgcaaaattgccttcaaggggtccggctcagggtggggaggtaatgtgttgcccttgggtttaatcaaatgtcaacacaagaaacaactggagctgtggttcaaattcaggctgggactctcatcagctgtgtttctttaggtaaattacttcagactctcctgatctttaaacttgggacaataataaccatgacagctaactgagatgatcgaagacaaatgtgcttagctcagcacctgggtgtaagtcagggcccaaacattgtttctcctatgacttcccctttcctccttaccacatttcaagaaaaggaaagtgggtggggcgtgtgtggtggctctcgcctgtaatcccagcacttcggtgaggctgaagagggtggatcacttgaggtcaggagttcaagaccagcttggccaacatagtgaaaccccgtctctactaaaaatacaaaaattagctgggcgtcgtggtgcgcatctctaatcccagcaacacaggaggctgaggcaggagaatcacttgaacccgggagtcagaggttgcagtgagccgagatcgtgccactatactccagcctgggtgacaaagtgagactgtgtctcaaaaaaaaaaaaaaaggtggggagaggggaggtaaactccagtattttcagggtgtttagctgtta

SEQ ID NO: 130802 - DNA, 1006 bp, Homo sapiens
tggctgctctctctgcctaatgttctttcccctggtggccacatggctcatccctcactttcttcaggcctctgttaaaatgtcacctcctctgagatgccttttctgaacatcctatgcaaacccctccatgccctcctctcaccccttcaatcctgccccgcttaccctactattcttctatagagcacttattgccatctaacagattatatactgaacatcagaggcatccaaaaaagtcacactgacatgacaatgggaaatcatattacatttagaatgatgtcagcattaattgttttatatatatataaaatatatgtaatatatatatattttaaataggaacaaggtctcactatgttgcccaggctggttttcaaacttctgagcttaagcaatcctcctacctaggcctcccaaagtgctaggattatagacatgtgccaccatgcccagctgttttatactttaacatttattattcatatgttttaaaaaatagagagcagcaccttgtaaataaaaactaacaaagctcttccagttggtaggtatcattctaagtaatttaatcacttaattctcacaagcatgttagttggttattactactagttctatttttcagataaggaagttgaagcacaaaaacaagtgtgttgcccaagttcacacaaccacaggtggcacaacagggatgccaggccaggccatctggctccaaggcccatgttcttaaccactttgctagaatattctattgaaggccccttccctgtgagagatagagaacaagtctaggctagtctctgccaccagtcaacagggtgaccttggacaaactaactgcttaacctccatcttatctgcacaatgactccctttcagctctgagtcttgattaattgacatcaaataacaattatctgagttgctgcagaaaactcaggataagagaaaattgatttagaagacatgaaggatctggctcacatgccca

SEQ ID NO: 130803 - DNA, 1052 bp, Homo sapiens
atcagggtgtggtggtgaatgactggtaatcccagctacttgggaggcttaggcaggagaattgcttgaacccaggaggtggaagttgcagtgagctgagatcatgccactgcactccagcctggggagacaagagcaaaactccaagctccatctcaaaaaaaaaaaaaaaaaaaaaaaaaaaacattaattttatttagctgggcaatgccccccaactaaaacactagatttccctgtctcctttgcacgcaggcatgtgactaagctctaaacaatgagacattagcagaagtgttctgaaagacttcggggattaaagggacctaactcaacaggaggtgaattcttttgctcccctcctccttcccgatggccgaaatgaaacgtgatggctaacatgcaacatgacggctgacactcaaatagctagattggacagtagagtctactctgtaggtgagcagtgcttccaaagctttaaagtgcatgtgaatcccctagggatcttgttaacactgcagactgattcagtaggtgttggatatgtttcctatattccctagttctgttcataaaggcagcctaggttcagtgactgccctaacgtataggagcacacctggcacccagatattggcttctaaatgccacactgcactaaaagaaaccagggcttcttggaaaaatggctaattgcaaagcaggagcagggaagatataagaaaagactggtacatcttgtgccataaagccaggaagtaggccgggcgcagtggctcatgcctgtaatcccaacactttgggaggttgaagtgggcagatcgcaaggtcaggagttcgagaccagcatagccaacaaggtgaaaccccgtctctactaaagctacaaaaattagccgggcgtggtggcaggcacctgtaatcccagctgttcaggaggctgagacaggagaattgcttgaacccgggtggcagaggttgcagtgagctgagattgcgcatcagcctgggcaacagagtgagactgcgtctcaaaaaaaaaaaaaaa

SEQ ID NO: 130804 - DNA, 1017 bp, Homo sapiens
aggtagacattcttcctatgtcctatatttgtagtagctgttttgaatttcatataaataaatgcacacatattgacttgtgcttgtctgcttttgttcaacatcatgtctgagattactccgtattatatgtagcagtagttagctcctatgtggctgcatagtactccatgtatgaatataccacaatttattccttctgttgatggaaacttgggtttttagttgttggctcttagacaaaaagcaagcttgtgactaggtctctgaatcacaataaggcagcaagctggatattatgtgctgcagtgataattgctctgctaaggccaccagcaatctacaacttgatttattgcattgaaacaaggccaaaaactccagagacaatgtaacattgataattgcaggacaatcaatgttttcatattgattcccaaacaaggggaaaatgtcttcaaaagctctgcaaaatcagagcaagtcttaaaatgtgaacaattactgtcctcataaaatgaaatgtcttgaaatggatgctattactactacttcgtgactttaaacaaaggtacatataacttcgtttctcttaattcaccttttctcaagtgttaggaaggggttttgctatttaaagaagaaaaacactacaacgataatgacaactacaatgataaaaacaatgacgatgattcagggatttgcattgatacccacccctgatatttggatcctagatgaggtgactccagcaaaattggaaaaaacacatagagccaggcctatctctgtaagagcacttaagagtaggggcatgactggggtattctgtctcgctttactgcttggcacattcagtaaatacttgttgaatgaattcagtaaatacttgaatgaatggttcaaacatgagataccatttttcttcagggtatgcatttctgaaattagaaactgattactaagacttggcatacttttgttttttacttttcattgaaataattcaaactt

SEQ ID NO: 130805 - DNA, 1374 bp, Homo sapiens
cccaaagtcttgaaattacaggcgtgagccactgcgccctgccagattttgtatagtaatatatatataaaatgacctgtcacaggttggctttcatagttttacctttcctttttgggtggtgcccttgggtctctactactgtctttcatcactcccaagaaattgagtagtgcagccaggatcaggaccagggattggcaaatgttttttgtaaagggccagataggaaatattttgggctttgaggactgtgttatctctgaaatgatcttgttccagtgttaccatgtcaagacaaccatagatagtatgtatacaaatgaacaggtatggctgtgttccagtaaaactatggataaaaacaaccacattgcatttggctaagggctttaatttgctactgacaagtgatagtcctggtcttaatttgtttttttaacatttacagattgatcagggaccatgaaaagaaacttgtgcttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcagaatgtcagttctgttttaagtaacagaattgataactgagcaaggaaacgtaatttggattataaaattcttgctttaataaaaattccttaaacagtgcacggatttgctttttttcaaagtctttataattgccatgcataaataggtaatatcttaatggtgctgagccgacataagaatcttttatgaaaaatgtactgttaagttcagggggtctattggttttatgtaaaaggcacaagacaattcctgtagtgcattttatgagttaaggtttccatacggattattgaaacaatttgttacatgtatttgttacatgatcttaatatttcatgtacaagactgacacccatccacttttgaagataagccagtttatggggtttttttttttgcgggtagaggttgggtctccctattttgtccaggctggtctcgaattcctgggctcaagcataagcataaggcttattcctgcataagccaccatgcctggcctgccagttgatgattatattgaggtttctaggctatgagattattagcttaaacccttacatgatataaaacaa

SEQ ID NO: 130806 - DNA, 2727 bp, Homo sapiens
gtgttttgtttccaataaataacagtgcagccagacattcagggccactactggtctccgcgtcttggtggtagtggtcccccgtgcccagctgtcttttttttttaaatctctgtgtctcgtgtctttatttctgcactctctcgtcgctgcatacagggagaagcccaccgaccctgtggggctggtcgctacatataagtactcgtccttgtatgaattaatgtttttacttattgatgctctgagtctgggaaaatggcaagtgttaagactcagctttaaaaagttttgtcactttttagtcttttatgcaaacctcagatcgaagaagacagcataaacacttttcactcagtaagttttcccagttaatgtatattcacatctttaaaatgcagcattccaaaatatgcccggtgctatccgcccagctgctcctagaccaccatttagtactatgagaccagcttcttcacaggttccacgagtcatgtcaacacagcgtgttggtgagtcttaatccttcctttaaaaattgatcaccaatttgaaagagcaagataaaaatacaaaatgttcttattttttagctaacacatcaacacagacaatgggtccacgtcctgcagctgcagccgctgcagctactcctgctgtccgcaccgttccacagtataaatatgctgcaggagttcgcaatcctcagcaacatcttaatgcacagccacaagttacaatgcaacaggtatggatttaatgatttcttaataaaaatcacatttcttgggtgaaatcaaaggtgtgaagacagctgggcacagtggctcacacctataaccccagcactttgggaggttgaggcaggcagattgcttgagaccaggagtttgggaccagcctgggcaacatacaggaccctgtctccacaaagaaaactagctgggtgtggtggcataagcctgtagtcctagctgctaggaaggctgaggcaggaggattgctcgagcccaggagtttaaggctgcagcaagctgtaatccctgctgggtgacagcaagactctgtctcaaaagaaaaaatgtgaagacagctgcatgatagattcttgagagcttagcctatctggaacattctgctaatatgatagtatgtaaaatgtcttacgcttttggaattggacaagcagcgagaaattcacatcctaaatcaccacgcctggtctgaaacaactattacaagtagctatgggccaggcgtggtggctcacacctctatgtaatcccagcacttcaggaggccaaggcaggtggatcacttgaggtcaggagtttgagaccagcctggtcaacagggtgaaaccccagctctaaaaatataaagattagccaggcttggtggcacatgcctgtaatcccagctactggggaggctgaggcaggaaagttgcttgaatccggaggcggaggttgcagcgagccaagattgtgccgttgcattccagcctgggcgacaaagtgagactccatctcaaaaagaaaaaaaatgtatctgtgatacatagtatataataactactttggcttctttctaattcgctcactcaacttctccacctcatgtttcgatggaagtctaccacttcagcagatgtccattgatgactatttgtatttgccatctttttctgtgctttaaacttaagagttctcattttctgtctagcctgctgttcatgtacaaggtcaggaacctttgactgcttccatgttggcatctgcccctcctcaagagcaaaagcaaatgttgggtgagtacttctgtcccaccttgtcagttcagaaagactagaaaatataggaatcacttaggcactaggtcaatcaattgacagctagggcagtggaattgatctgaattggcatgaatgattatgatagtacagttggtctgcctaattaaaaccactggaaagccaataagaaaatgtattgttagtaataaatagggtagtagggcattactcaccatgggccctcactacatttttgagagaaggaatttgaagcaaatgagaagaaaacttgtgactttgcctgaacaccgatttaacaacctaatggtaacattgcttaattggcaagctgataatatcaagagttaattgccttgtggcagattttattctgtcttcccatgaagacataatgaaattgtggattatgggttattatatacgtgagacagaagtatggttcttaaaccccagtttaatgtggtaattcaatgcagttaaaaacttttttttattgaagggagtttttgaatgtttctgttcctaggtgaacggctgtttcctcttattcaagccatgcaccctactcttgctggtaaaatcactggcatgttgttggagattgataattcagaacttcttcatatgctcgagtctccagagtcactccgttctaaggtgatttaaatttatttaccaagttgcctcttacacagttattacgtggctttttatggggacttaattgtacagaacacttacatcgtgttatatataagccatgtacagttgtaaagtctgcataataacctgtggcgctatttatccccattttatagataggtaaactgaaacaggctgaataatttgccaaatgctcacacagctcttaagtggcagagcctggcttcaaatcccatcagctccaacag

SEQ ID NO: 130807 - DNA, 1377 bp, Homo sapiens
ctgggatgtatttatttagataattaaatttcaatattgaaaatccaatcaaattcagtatctaaaatctttaaaagtttctgtgcagccttcacttctgtcagttctctgacctggctagggtaatgcatatgtgtagtttgcccttaataattgggtattaaggaaaaattgtgaactcaatgggtaaatacaagatgattaagcattaacagggtttagttatttgattcagtgatttataattgtctaaattgtaacgctctttttttgctcctcattctaccattacgttaactttttttttcttttttttaataggttatgatggagggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggctcacctcactaaccagtatatgcagagaatggcaagtgtacgagctgttcccaaccctgtaatcaacccctaccagccagcacctccttcaggttacttcatggcagctatcccacaggtaggttttagaaggcaaccagaaccatgaaggttttcgtatttggtcatttctagtgttttttgtgcccctcgccccgcaaatgtgaaacattaagaaaggggaattatgattgagtaggaaaaaatgcttgagtgtgaagtcctggtaaatgttttgaaaaagtacatataatttattgcattatttgcttttttcttcaactgataaactcatgtgctttttttccctgcagactcagaaccgtgctgcatactatcctcctagccaaattgctcaactaagaccaagtcctcgctggactgctcagggtgccagacctcatcgtaagtcttttttcttttaattaaggttggggattgagttaaaaataacacattgggtaaatcagctcttctatgtcaatgttaggttaactattgcatttcacataatttgtggttatggatgttcatttttatagcatttaaaagcagtgctaagatagtaatgtctacagtggtttgatttccctttataaaagttttgggaataggtacagctcttcattttttatttatttatttatttatttattttcgagacagagtctcgctctgttgccccaggctcgagtgcagtggctcagtttcggctcactgcaacctccacctcccaggttcaagcgatttctccctgcctcagcctctggagtagctgggattacaggtgcccgccaccacgcccagctaacttacgcattattagtagagatggggtttgaccacgttggccagggttgtc

SEQ ID NO: 130808 - DNA, 2566 bp, Homo sapiens
ttagcacaatagctcatgcctgtaaccctagcgcttggggaggtcaaagagggaagatacttgaagccacaagttttagactagcccgggcaacatagcaagaccctatctctacaaaaaataaattagccaggcatggtggtatgtgggccagtagtcccagatacttggtaagttgaggcaggaggatcacttgagcccaggagttgagttaaagtgagcttattcattgtgctgctacacttcagcctgggcaatggaatgatatactgtctctatagaaaagggaaaaaatcaaattattgggtaaaaaatgcaactcttttgtgctagagctgagaataaaactttttacagccgtttaaagtgtacctccttaaatggaaggaggaatccttcaggggagggaaggtgtttaccttcttaataataaaaggtctttcaatggaaaagtatacctacctggggcatagaaggctgggagggaggagtcaagttacggagctttgaaatttttttcatggctttgtatgttgaaatttgaaatgtataacgtgaatgttgtatggaatatctttgatttatgtaaaaaaattttttagggcctgccttaagtgtgaaagtaatgactgatgaaagtggaaaatccaaaggatttggatttgtaagctttgaaaggcatgaagatgcacagaaagtaagtggtctgtattcagcaggaagaagggggtacaaagttgagttgctcttgtgttgaagtctatgtgcatactaatagctatttgacatgttcttatattttcagttatttgcattttatgcattaggtttgagagtataaattggtaacctatattgtcccaaaaccttgagattttgggatgggtttgtctttagcttttgtgacttaacaaatttgtcttaactgttaaggaaatgaactgtaagttgaaagttttgtgattttttttttttctttttttttggggggaaggctgtggatgagatgaacggaaaggagctcaatggaaaacaaatttatgttggtcgagctcagaaaaaggtggaacggcagacggaacttaagcgcaaatttgaacagatgaaacaagataggatcaccagataccaggttcatttttaattgaacaaccaaaataagacagggatgaggaaacctattttacgttgatttcagttacttccaggtagctggagggtttgagaggggaataggagaagaaatatggggtaaaataatagacccgatgtacttaggtaccaccatggttttctttttctatagttttcttttcttctttttagggtgttaatctttatgtgaaaaatcttgatgatggtattgatgatgaacgtctccggaaagagttttctccatttggtacaatcactagtgcaaaggtaagaaaacatatggttcatttatttgaggtctagtaaaaattcatacatgtagatatatgtatataaattttgtattattatagccactagagaggtgtttgcttcgttacttctaaaacttaaattcacatttgaactggttgtcatagcctaatggttaacttaaaaatggcaagcactgaactctttgctaaggaaggctgatatcctcacatgatatgcactattccaacaactagtcattttgctaaagcaagcaatttattagggacttataattgttactatagttctgatctgtttattcatttctacaattcattctgggtagtcaagccccagttccctcccctgccccctagcagtaagaatagagatcatattttcttttatttgaaatcagagattaagaaacaaagcagtagtattctagtacaaattctgaaatcttgatttaagaagttctcttctagatgtttttgtctagcatccgtgggccaagagtccccctatatgcaaggttttgtgcatacataattttgctggggttggggaagagtgcatagaaaaaaattacaactcaactgaactggaatgacgctgtggctgatctttctagtcagcttttcctggcaagtccgaggaagcttctgtgagagtgaggaaatgttaggggaaaggtggttgaatacaagtaagatggaagtgccatggttgtcttgtgtttcagattatgctttttatgtaagagtattggagtacgatagaatttattcctgaatgtttttgtcttcagtgtgttccctggatattgtttaaattgagtgttgtgcatcagcatattttgaatgtatgaagcatgcatgtttttctgtttcttgagacaggatctcattatgttgcccaggttggagtgcaggggcatgccacaatcacagctcactgcagcctcagcctttcctgggcttaagccaagcttgtccaacccgctgcttgcaggccacatgcggcccaagaatgcttttaatgcagtgcaacacaaattcttaaacttatgaggtgttttttttttgtcttttttaaagacgagtctcactctcgcctgggctggagtgcggtggtgcaatctcagctcactgca

SEQ ID NO: 130809 - DNA, 1520 bp, Homo sapiens
ccttctgctttgctgtgtattataatatgctatgacacatgtgctacctttttttcttcagtgatcgttgttctttttatatttttgagacatggtcttgctctcttgcccaggctggagtgcagtggtgcaatctactcactgccacctctgcctcccgggttctagcaattgtcgtgcttcagcctcccaagtaggtgggattacaggtgtacaccaccacacccaactaatttttgtactttagtagagacagtttcaccatgttggctaggctgaactcgaattcctggcctccagtgatcatcccaccttggccttgcaaagtgctgggattacaggtgtgagccactgcctagcccagtgatccttgttctgaattactactgttatattcagaaaaaattaagttttagtgtcattttgttgaaaatgctgcagttatgtcaggctgttgtgtgttagagtacacgattgggaagtttaaatttttattctaggagatggcaaagaaagcgcaagcgccactttaaaatgacgatgaaagctttttaatttgatagaggtctttttattggcatggtacacatgcacttccactcatttgtattgatgggagtgatccctttaaccctaggttagctagagaagagaagtgtgtattaaaagaagtggttttttttttgtgattgtagttagaggcttattcatatatttcatggtgtcatatcttaaattatggccctatttctattttgtagtgtgctttttattagggattctgaatattctcattaacagtaacaaaaccaaccatcaggcttacttaatctgaactttataaaatagaatctaatgttatagtccttgtatatcttattagatttgttggacgatttaagtctcgtaaagaacgagaagctgaacttggagctagggcaaaagaattcaccaatgtttacatcaagaattttggagaagacatggatgatgagcgccttaaggatctctttggcaagtttggtaatgtgtcttaattaaatttttacacacaaagctctgaattagtgctcagtgttaattttagctattactttatactaaaaaagtcaataaaattagacttacatggtactttaaaatatttgtggttatttgaattaagctgctggccatctattacactacaaagtagtataatgcaaataaatagaattctatccaggttaaaggttaatagcattagattagcacagtaaggtatgactaagtaattagaacagattttaaaatattttactacattaagaggctggagatatatatgtgtgtgtgtgtgtgtgtgtgtgtgtgtgtgtgtgtaattagagatcccatgtcatcagaagcatatatttgacacagccagcctacagtggaatgcagtctcatagaacaataaagctggtcagtctaagtaacatcatgtttgagcagtttaaaacaatgactttcagcgatgaaaccaaaaattcagattt

SEQ ID NO: 130810 - DNA, 2629 bp, Homo sapiens
agataactttggggcaggttatcacaacctaagagttggtggagaaaacatgggaatgaattctagagaccacaaaatgaaaacttgaaagtgttactctttctcagcttaacgtttttaaatccaaaaaacaatttttacatttcttgggattcgaagagttgaacttcaggttgccgtggttacagtgtacagtatatattatcagtctgtaccagtagaccagtaccctaactactgaaaagaatatggcagttttccatttgtctagtttctgtatgtacaatttactatccaattaattacttaagtggatttcttgttcttttttaaaaacttattgctacattgataggcagaatagcttctgaaagtgaccagttttcaatttcataggaagaggtgactcattgaaaaatagctcaagcaaagtcagctaaaaaaaaaaaaaaactagggaagctgagtaggtgtggtcaattgataatgagctaacagctgattatcactatattctagaaactggaactttcatttataaaaaaagaggtggccggaaaattcatcctgtcaataacttttaaatttacattggcatggaatttgtaggaattgtttcagggcttaaaagggaccgttttccctctcttcggggactagtctttttatttaaggatgtgttatttcatttagagcctttaatggtacaggtatacataattcaatcctttatagatcctgaaattaattgtagattttgaaattttctagcagtattcagaaataactaaatcagttgttaagaaaatcagcgatctaaagtgaaattgattgtatgtgtcaagagagcgttaatggtgatttctgaatattgcagacctggtgtttttaaaattctgtgattatgaaaccaaatatgtctaacttcacattagcttttgaaagcatgattcaaatcttggtctagcctttcattttcttaaatggaagttgtgccatgaatcactgaaaccctccctccccccaataattaagaaactttcattttttaggaaatggactagttttcatataatattgttagttattagcaatgaaatgaccaattttagcaagtagttgggaagaagttaaaatatttaaatctataaactacttccagcttgtagataaatctgttgcgtaatgtcttttatactgcttattaaacagattgtatgtgaaggaatttggattttgataactaggaaaaaaagtgctttagatttaatggcaattaaggcgagagattgcgtcaagaatttattaattattagcaatatggaattcttttatatgtgagaaatttcgggggcttctggtatttgtctttgctttatacaacttaggtcccacactagtgtgtgatacttgaaaggtctagccatcttgaagcttaaagaggaagcgttcaactgtgagaccatgtgtcctcccactccagtcaccatagtttatataatcttaagtagccagcaaaaattttgaagtaatattgactctgaaaatgtccttcctgcagcggagcgtgctttggacaccatgaattttgatgttataaagggcaagccagtacgcatcatgtggtctcagcgtgatccatcacttcgcaaaagtggagtaggcaacatattcattaaaaatctggacaaatccattgataataaagcactgtatgatacattttctgcttttggtaacatcctttcatgtaaggtaagccaaaaatgtccgatacacatgtttacattgttgagctacatttagtttagtgcttgaaataggaactgtgcagtaatggatatctttatttcacaaatatccaggttagatggctaacagattgtctctcaacactgaacaaatgttaaatcaatagcaaataaagaaaaatgggtatatgtttttccctaggtggtttgtgatgaaaatggttccaagggctatggatttgtacactttgagacgcaggaagcagctgaaagagctattgaaaaaatgaatggaatgctcctaaatgatcgcaaagtgtaagttataaatatctagctaatcatattttgaatcttatttttaataattccaaatccattcattttaagttaatatttgtcagggagaagttagatgcacataagataaaagaataaaaacattttaaagatgaataacaaaaattcatgtagttgtactggagtgaaaattaataagctaatcttgatttttacaattgaattttctacacagtaagtgtaacatacaaataacaggtttaatataattaacattcatgccaaaaggaaaacagaagataagtaaacagaaaaatgtagctttttcaaaatgagtgcattagtgaaaaatcaggaattcagacaaacctaatattcataattcttgaggtactggttaaattaacccattttataggtgaggaaactcaaagtaatttgcttttatgtactgtaaaatgagagacatacattactcacaagtccgggcgcggtggctcatgcctgtaaatcccagcactttgggaggccgaggtgggcggatcacctgaggttgggagtttgagaccagcctgacc

SEQ ID NO: 130811 - DNA, 2432 bp, Homo sapiens
cgcagcgggaagaggccacaggcggccgcgcacgtggggggtggttagcgcggaggaacccggaagccctttgcaccgcccaccgccgcggtgacgggttaacgctcctcctggtggaggcaggggcgggcggggcggaaggcggggacgcctcagccaacacccccgaggaccgcccgcgagccgtcctccccacccccacggacgcgacgcagcgcgggctccgcttccccggccgcggcgcctgcgcaaaagccccgccccttcgcccgagccccacccccacaccgcagcctccaccgccgccacctctcccttcctctctgctctttcctcctgttttctcttccctcctccccctggcctccgcgtctcctcctactccggcgctgacgctcgcgtaggggccctggcgtcagacgcgcgggggcggggcgagtgcggcgcggggtataagtagagggtgcaggaggcggtgcttccccttctccccggcggttagtgctgagagtgcggagtgtgtgctccgggctcggaacacacatttattattaaaaaatccaaaaaaaatctaaaaaaatcttttaaaaaaccccaaaaaaatttacaaaaaatccgcgtctcccccgccggagacttttattttttttcttcctcttttataaaataacccggtgaagcagccgagaccgacccgcccgcccgcggccccgcagcagctccaagaaggaaccaagagaccgaggccttcccgctgcccggacccgacaccgccaccctcgctccccgccggcagccggcagccagcggcagtggatcgaccccgttctgcggccgttgagtagttttcaattccggttgatttttgtccctctgcgcttgctccccgctcccctccccccggctccggcccccagccccggcactcgctctcctcctctcacggaaaggtcgcggcctgtggccctgcgggcagccgtgccgagatgaaccccagtgcccccagctaccccatggcctcgctctacgtgggggacctccaccccgacgtgaccgaggcgatgctctacgagaagttcagcccggccgggcccatcctctccatccgggtctgcagggacatgatcacccgccgctccttgggctacgcgtatgtgaacttccagcagccggcggacggtgagcgccgggctccgcggtcggccgggcgggcgggcggccatgaggctcgggcggcggcggcgggcggggtaggccggcgggcccggggaggggggcgggagggcatgtcaccccgcgacggccggcgggaaggcgccggggtccctggagccgcgtttcccgagccggcggggacccgcgctgccggcagccacacgcccggctacttcctcctttgcgaccattttctcggcctcagacgctctcaaactttagggtgatgacgcgccgggagggtgggtgagattcggttcctccgcggcgctcccgccagtggccccgggattctggggcgttgaacgctgagctccttccgtgggtaagaggtggaggcgctcccaccacccggagctcctgccggcgccccagcctggggaggaagtgcagttctgtgctcgaaaaataccacgtgttgaaccctgtaacctcgcaggcccgaggcctgcttctgctcctgctcctggcccagtcgcctgggggagccaccaggccttaggataaagttcctgtggcgatgtgtggtgtggtggtggtcctcaggcttgtgagtccacttcccagaactcatcagtgactgatggatctaggaatggaatttaccggagacatgcatttggggtttcccctagatcaagcatttctctaacattaaaagggcagagtgggaggaggggatgtggcagccgaccactttgaaggccagttttctcaggcaacttagaccatttttagtcaaattttatcttagattcacagtactggtggttttcgagtatattatgttaccttctgaaatagttcctgtcgttttgaggggcttttctttataaaatagtcaactttggctataaaatgttactttagtgtaattccaactggaccagtcttatctgtagcatgcaagaagttcaagtttctcttttatttttaaaagtggcccatgatacctgtaaatcttgggaaatgactgagtacaaaataacggagattaaattgagcttgaaatttatgggggaaatgcagctaactttgtgcttttattttgaagctaaacagttaacagaaacacaattttgtaaacagataatatctgtggtctgttgagttgctaggatttgtctttagatcaattggctttgagaagtcagcttaattccattttacggcccaattttgcctttttccccccctacaggctggccacttgaata

SEQ ID NO: 130812 - DNA, 1107 bp, Homo sapiens
cttgtttggttccatttctgctctggttaatgtatttgaagcctctggtttccgttcatccaggtgccaggagccactggtgtccccatcgcctcattttcttcccctaggcagggcttctcctcagcatctcattgaccccattgttcaaagttcttgccaatcctcccatccatggatttcaatatgtaaaccccatcttgacaactacttgctgagtgaatattagagaaataggatcgtttcacataaacatctgctacttcattctagaacttaaaagtttgtgattccagttaaagcagacgagcctgtttttcaggggattgcagaggacagaggtgaggggtgtgtgtgtattcctgctgctttgccaagtctcccacctcctccaagtcactaagaatggggacacctggccagctactcagcaagacatcagattctgggaggcagatgagaaaagcagggagagattggctttttggcacttgcatctctgcagttcagctggtctgggcctgggctaagtgactgttactggctacaggttctggataatgagttcagagactgggatccattgacaggcacttggttgactttgtctctacagtttttcaattaagtagattgttcttctgaaggcaattttgaaacatccaaattttggtgggacagagcaattgccggtattgttaggttatttggtagcatctgaggatggggaaaagaaaaacaatacaaagtggatctgttcccttttaaaattttgtttttccacagtcatctctcttcttacaaaatcctgtctcacccctgatgatcttacgaaaaacactcttttgttcttcaagttataagaaaacaaaccgtggaaagtagctgattttcattaaaaactgatgaatgcttgggtcaaatctcctaattacagagatcaaaggagactaataaattttaactcaaagttctttttttcttcaaaagaatagccttcagtgaaaacaagtacttcctaacccaataaagaaatctgcaacaatccattctcctagctaatttacttaagagttgtgtttgtttaaattacacatgctctggtgt

SEQ ID NO: 130813 - DNA, 1037 bp, Homo sapiens
tttgtcaccctggagtgcaggggtgccattacaactcactgctgccttgacctcctgggttcaagggatcctcctgccacagtgtaccaagtagctgaaactacaggtgcatgccaccacacctggctattaaaaatgttttttttagtagcgacgaggtctcattatgttgtccaggctagtctcaaattcctgtgctcaagggatctgcccacttcagcctcctgaagtgctgagattacaggcatgagccgccgcacctggtcaaaaagtttttaatagagtcattatattctaattttctctcacacatgctatatgtaattgtgtgcatttaaaactttggaggaaaacagttttaaggtaggtttatggttctttttattaaagataatgccgtactcctaaaaatgaaaaacctgtccatttttctttcaaagtaatttacccaaagcctcccaatttgggtaggtacaaaagtttcacaatttagaacttttaaaaagtcgtttatttggcgtggatgggccaggactgcaggtataatttcttgccactagatgtctctgagttttaaagcagcagactcgtgggtttttgtctatttatacatacagatcacctacctccctgttaacagagtttcataatcctcttatgtaacgctgggttgtcagctacagttaatcatcagttgggagatgggcaggcagggaccccaaggacttcatgtcctcgagacagggttggacgtgttgagagaaggttgagaccaggtgtgaccaagcagaaccccgtgactctgaaatgcatccacgcggaggccagggaatgatggaaaacaaagagctcgctgctgcagcacgtgccggctggatgcggagaccacggcatccactccttacagctgggagccagcagaggagctagtgggccgggaaagccgtcagtcctgcgttttgccttggctggctgcgggcgccacttgaaacaagccagtcatgcctctcccaaccctacccccaccccctggaacc

SEQ ID NO: 130814 - DNA, 1076 bp, Homo sapiens
cacctcttcatggtttcagttaccctacttactgggaatatacattgttaatgtgtgtcatagactgagtgtatccccctctaaaacttgtatgttgaagctttaacatccaatatgattgtatttggaggtaggacctttgggaggtgattagggctaggcagagtcataagggtggggcctccatggtgggattagtgtccttatacaaagaggaagagagactagagtttactgtctctctgccatgtgagaacagtgagaagatggacatctgtaagtcaggaagagggccctcaacagcccgtgagtctgccagcaccttgaactttccagcctccagaactgtgagaaataaatgtctgtcgtttaagccacccagtgtacggtttttttgttacagcagcctgagctgtctaatacatgctgtgatgagaataaaatgaaaaaacacacaccacagttctttgcacacagagtctgttgaacagtgagccctcaatgcagtctctctattggtttaatggtccctcccttgatttgctctgatgtaatcctgatttttttccaataactggagcatttcctgagaagtggctggcctccgtagttgcattttgtggaggtatttctttagggaagactgtccttgcaatgcattgcaagacatttagcatccctgacccctcccctttaatgccagtgctgactttcttcttaccccggtcattgtgataaccaaaatgcccgttaacagggacagttccacctctagctgaaagctgtaaagataagaatgtccccttctgctctctccggtccgtgcctccaagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagtgagcgtcttcgatgcctatgtgcttcccaagctgtatgtgaagctacattactgtgtgagttgtgcaattcacagc

SEQ ID NO: 130815 - DNA, 2549 bp, Homo sapiens
gtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgatttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatggagaccttggggtctttatttccaggagaaaagataccttctgcatctagggcaacaatccttttccctcgcagctctttcttttacctcacttactgatttctcctgacccccaagccaaggaggtaaaataattatatatatatatatatatatatatatatatatataaagtaattatattttatagctagactgaagaggtgggaatttttttgttgttttttttttttttggagacaagagtcttgctctgtcacccaggcttgagtgcagtggtgcgatctcggctgagtgcaacctccgcctgctgggttcaagcgattctcctgcctcagcctcccaagtagctgggattacaggtgcccgccaccacacctggctaatttttgtgtttttagtagagacagggtttcaccatgttgtccaggctggtcttgaattcccgacctcaggcaatccgcccatctcaacctcccaaagtgctgggattacaggcataagccaccgcgcccagtagagatgtgatattattcaagtaaataaaacctgaaacttggcacatttgcctatttaatgtgcatcagtcatctgaactaggttgatcctggaataatgaaaacacttcactagtattaactaatgttttctacatagtagttcccaatagattaaggaaaatttccaacctgagattctttgttttggaatttgaataatgtgtttgtaactattccttgattgtcccaaatccaggctttacgtctgcttttgtcaatgtaacatcctagtgccaggaaattggaaaatccaatgactttttgtgtgtaaagtactggaatttttttgttcgtttgtttttaagacggagtgtcaactctcgcccaggctggggtgcagtggcctgatctcggctcactgcaaccttctcctcccaggctgaagtgattctcctgcctcagcctcgcaagtagctgggactgcaggcatgtgccaccactcctggctaattatttgtatttttagtagagagagggtt

SEQ ID NO: 130816 - DNA, 2632 bp, Homo sapiens
ataacattgtcagggaccaatgttcaattttattgtcctcaaataataaactgaacactaacttcaaacttaaaatattgctgcccaaagcattctgctttaaaccacaaattcatgtgccagctgcattcacaattgtattgacagtgactgggtgtttaagttttataacttaggctatagtttgttctttaagaaatgcaagttctttcagttttgtaaatgttttattctcactatgtctgtttcttttcttcttaagtctcttttggaaaagttcttgatccccaatgcttcacaagcagagagcaaagtcttctatttgaaaatgaaaggagattactaccgttacttggctgaggttgccgctggtgatgacaagaaaggtatgctgtttttaaacctgttggttgaacttgtataagataacatagtgaggaagagtctctgaagcgtacataatgtcttgttttgaattgcttagagtgccgaataaggagtagcagtgctctttgtgttctgagaatacacatctactgcctcatactgctattctaaaataaatgctttctgaaaagccaatattgtgtacagggatgttttttcaagattttaagaaaagtgaccagcctgagcaacatctctctctacaaaaaatattttgaaaattagctgggcatggtggtgcaagcctttggtcccagctaatctggaggctgaggtgggaggattgcttgggtctgggatgtcaaaactcgtcaattttttaaaaacataacaataatgagattataaagttgttttatcttgacattgatcaatggctagtgtgtaccaggagaaagctccctttaaaaaaaaaaaaggaccttgttcaattaacaaatattaagctgttacaggttagtatttcaaaggatatgtgagatattaaaggtttggtttgaggggtgaagatataatgcacactttatctcagtacgttttggtgtgtcttatccagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagtatgtattttacctgttacgtagaaatttagcagtctttattatttgagcactgaaatgtaatgtactatttttaaatcgtaggcttttgatgaagccattgctgaacttgatacattaagtgaagagtcatacaaagacagcacgctaataatgcaattactgagagacaacttgacagtaagtacataacagcatcattagtgatgaatgtggttgaagaggttatgttttactctagggaatttttttttttattaaatacatcttttaaaattttttctcaacacatttcataggctctcataaatatatctcagctactattaaagtcctatgaaggaaaattacagaaactgaaatattagactgagaactaaaaaatacacacattgatgagttacctgtcttgttaaaatttgttagtatcaaaagtgtgctgagactctacatgttttagttcctttaagaatgattttcttgcccatcaagttgcctccatattggtaaagataatggtagggaattaataacttgagttacaaaatctcaggtatctacagaatccaagtggaagtctattttgcctagcttcttattttaaatgacttaatatgaaaggtcgtgattgtccttgggatactgcagatgtataaaaagaaacagtgtcactatcacaccaggaacatcaacataattccctaataatgtttgaatatctaaataatacttgaattccaattatctctctttttttaagttatttgaattgggattcaaattcagtccacaatgcagttgatttgtatgtctcgtttgtttcttaggtcttctcattcttctccttcagataaatactagatttgaaattttgaggcttaggtgaaaaaattatcaagcatttgctgtgtgtcaggtaaagaggtaggaattgcagatcataatctaggtattactgtttttttgttagacttctagggccatttctcttggggactatgtaatctcattttatacatttctcttccaactttattctagtccactgccattttctataaaccagttctatatgctagtgctgaaaatcttgaagagttttttgaatagtattgtatacttgtttattaaacctaaaattactttattagcacaatttggagctatctataaacttttctgatacttgagtcaagataacaagccacagtaaagaatgaaagaatcttatatatcaaacataagaagcactttgttaactaactttagtattaaggatttttcttttctagtttgaagtgatgacatttttaaagtgatgacctgagacctagatactgtgttttgttcacatcactttttgagaggccctgatctactgtctgcttccaactgaattttgctatcagtatagcatgaagagcgcatattgcaataagaaaaccagggttggccgggcgtggtg

SEQ ID NO: 130817 - DNA, 1065 bp, Homo sapiens
ccttgactaccttctgtgtcctgtttatcttagcttttcagttctatttaaaagtgtgagcctgcctataatagtgcaggggtctcttaacttacagtccatgaatggaatttcgaagattgaagaagcctttaaaattgtgtatttttgtggggcagaaggtccatgccaaccatcaaattttcaaaggtttcattttaaaatttaaaatccactgctgtaggcagagaatgactttatataggaggtctccgagaggaagcagtgtaaaattgtgtgtctaacatttataacagttggcaactgcagttgagtaatcttaatagtgattctgttaatttgactgagttctattttattgctgctctacgtttttatttgctcagggcaattttaagttgtggttatgggtcactgatttttatctccagcccacagaactaccattaaacagaaataagaaagcaagcggctttgggtccgttttagtctgaatatattattacgtgccttgggctttaaaaactgctatgtagagttagcagtttttaagatgaaaatcactagacagctcattggaataagggcttctccaaagaactctgtagggttatatctattgttactatttcattttattaagatatactgtatatttacatgtcttcatggttttggtatgtttcaaagtataaataatcccagttctgtggtctcaggaaggaaaaaattggacagtgtcttttttttctttttttcttttttctttttttttttgagacggagtcttgctctgtcgcctaggctggagtgcaatggaacgatctcggctcactgcaagctctgccttccgggctcacgccattctcctgcctcagcctcccgagtagctgggactacaggtgcccgccaccacacccagctaattgtattgtatttttagtagagatggggtttcaccgtgttagccaagatggtcttggtctcctgacctcgtgatccacctgcctcggcctcccaaagtgctgggattacaggcgtgagccaccgcgcccggcctggaca

SEQ ID NO: 130818 - DNA, 1048 bp, Homo sapiens
cggccaggctggtgaccaggtcacgtctaactcttgacctcaggtgatccactcgccttggcctcccaaagtgctgggattacaggagtgagccaccacgtccagcccaacttgtagcagttttgactatgcttccctttagtttccttatgaagaaactttgtttgcatagaaccagtagatgaggataacaagataatctcttcatataaatagtttcttcttgttatgattattaaggaagttcactctggtccctacccacatcgttaccctccagaatagcactggcttcccaaaaagttttaatggtatttacactttgaaagtttggataaatgagagtttaatttctttactatacaaatggctttgaagagaattctaaacaagcttttgcttccagccttggtcttttcaggagtaagacttagtgatctttgcatactcaacgtgtaatagatgctcaaatatttgttaaacaagcagaaaggcttctttagagaaagagcatagaattaggtcagcagcactgcaaaatttccctagctttttctttttctgcttgggaaaatttgatatttaccgataataggcttctttttcctaccatctttttcaaataggtcacatcgactctggaaacatattgcataaaattccttctgccctttctgtgagatggaagaataaaatgtagcagaactgatatttctactagaaaaagttattgaatcattattaatgattagtaaaaatattttaaattatatttttaagatcttacatgataaaaaatcaattataattttttattactccagccttttctgggctttgatatatatattttttaatttgagaaaaataagcaggtgtccctttgcagaaataatagtattggcttgtggcattagtgataaccagattttttatattgagcacctattttataatagctatgaaaataaactttcttcctacaaaaagcagctaatctccaaagttctgagtttttctgaagagctctttagtaacccattctggt

SEQ ID NO: 130819 - DNA, 3399 bp, Homo sapiens
aaataaccagagagcgtttctgagatcctaagggaaaaatcagtaatttagagacctgacgaaaataatgccgtcataaaggttaaatagtttacgtattgagccagtaccttgcatccaaagtggttaattatttgtttaaaatgtggcgacctgttctctcatttggttaaaaaaatattgtgggatttccctgggaaggtaaaagatgattaatattcgggagccagctgccaaggtggactcttctgttcaccttctaacttaaaagtgcacttcattcagggtgtgtattttcctctgaagtcatttattctgtggtgtcactgtgtggattagtatctttgtgctgttcggcaacttgcaaaagggtatctttccagaaaaatgtagctgaggtaaatcgaaaaggtccaggaaactaaaatgcgagggaaagagaattagatgggtagtcatggtaaaggacagcttgagtggtaacatccaattacattatgatggctagaagcaaaatgcagcacttctgcatttcaactggagcgatgacattggaaacacttataaattaagtacttccaatgtgatatattctagtactcacagtaagagttgaagtgtcatgacttgcggatatttttaaagcatgtggacatataacaagataaagagttgagacattagggtcagatattgatcctttgtggtggatttatactcaaaatatctgaaaacaaacagttggtcattcccccccaaattgttatgctattattggctggcagttgttgcagagatctagtaggtttggggtaggggtaacactaaagctaaaatgtaatcactcttgacaagagtattatgaaagtaaaaagacgtgagttacattaaactgatatgaattatgattctggaaatatgatagaaatccagatgttctctgtaaacaatgcttttactaaaggaagaaaagctgcttaattttggatcacttagtggtattggaaatgagttgagattttgatcaggtaagattaggggtagtttttgaggcagcttttggaagtaattttgacatgtgaaatttgggtcttctgaacaaattttaagttttgctacactgatgtgttaatggctgtaagtttacctctgatgctgagtatgctaaatttttttcccttttttgactatccttttgtgaggctgcattttaattcctcatgtgaacagtctttcacaggcagttaggtttcaggtttaaaaaactcatttaccacaggtataattttgagtctgtttattttgatgggaaaaattttaaatactccttttttcccccctgcagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactggtgagaatcaattcagtctggcttcattatactgtagggtccctatgagtatcagttacattactcttaactttttgtttggtttttcttttccttctaaacattgtgtgttccaaatttaaaagtcttcatggtgtcatgactaaaaagatgttaagacaattatagatacgtgtatgtaaaataattgcaacaatgattatgaaacagttcagttttgttaaaaataacagactttagtattgtattttatattaattgaaaatataaactaattgtgttactgttttacttatggttagaatatttgtagtagctctatagctggttatcttaaatgtacatctgtggataaaggaattttacatactttaggtaagagagatgtaataggatactcattgtagaaatagtactcttctcaggattagccgctataatgttaatgtaatgagtcaaccatgcagaaaactctggcgtcacaactatgaaacctcttcctgcattgaattcttgaaggtaaattttgaacactcacaaccatgatgaaaggttatgaacaactcaagcttgattttccagtttgaatcgagtattttaagtattcagtacttactgtgttgaagcactgcgcttaaaagaattaaactacattttggttaattttaatctgtcatataaagtagggctttttgatcaagaatagtttaaatttgaggataaaccagtagagaatccaaccaagctggcagtttttggaataatatttaaagtggttttactaaatggttacacttaaccagtatggaagggctctgatatacaaagaggggcagcatctcgatttttctggacagattactgaatctggaactcagtatggaaatccaggtttgttacttactatatgaaccttgtttatggaagaagtgctataatgagcaataggataatgtctgatgtggttgtgggtttggggtttttgttaaagttgtgatgatactatcatttctttacatttgtatttactaatggaatagcatcagttcctaaactgtaattttctcaaatgatacttacttgacactgtctttttaaagaatagtgattttttaaacatgcttatttgggttcacagccacaaactcaatgaggcatctgtcttggggcatttttttgttctttgcttattgaaacctttagaatgatagctactatttgtatctaagttgaaaaaaggaatatcttgcttttattggggccaagtgacaaatgtctgttttgtgattttgctaaggtaataagaatatttaaattttgttttttgtttttttttttttttgagacggagtcttgctctgttgcccaggctggagtgcagtggcgcgatctcggctcactgcaagctccgcctcccgggttcacgccattctcctgcctcagcctcccgaatagctgagactacaggcgcctgccactgcgcccggctaatttttttgtatttttagtagagacggggtttcaccatgttagccaggatggtctcgatctcctgacctcgtgatccgccctcctcagcctcccaaagtgctgggattacaggcttgagccaccgcgcccggccaaatatttaaattttgaaaatgtgattttttttttctataataaaaaatgtattgggtttttttgttttttttgttttttttttttgctcaccttactaactaatatctgtgtatgtgtaattca

SEQ ID NO: 130820 - DNA, 1029 bp, Homo sapiens
ctaaggtgggggtagggagagaacgccttcccgccggctgagaggaagagtgggccggcagaggctgcaggggagagggagagagagggcgttggggacccaaagggaaggcgaggagtgggggatttgcgttggggaggaaaaggaaaaaagcagcctcctgccctaggtgcactcgggacaagcgtagaggagctggaagccgagcggggtgggaggagtggcggctgcgggcgaggacgcgcgcgcctccgctcgccctccagcgcgggcgggcaggacgagcgccggggagcggcggttacgcggggccccgatcgctgtgggcaccaatcaacggttgccatagcagcgtttgacgtcatcgtgcgtgtggtgcccctgctgccggggctggtgattggaggaaaccccgtgtctgcggagcggctgtagcctgtgagcagcgagatccagggacagagtctcagcctcgccgctgctgccgccgccgccgcccagagactgctgagcccgtccgtccgccgccaccacccactccggacacaggtgaggaacccggccgccgccgcgcctcgcttcctgtcccaggccagccttccgaacgcgtgggagccgtcctcgctccgtcccctcatccccactcgccccgcggtggcggcgccgggctgaggcggagtctcctcagcggacacgggcggcggctcctcttccgctgggctcgggagggcggctagcggccgcctccggctccttgcttccgcatcgacgccccggcgccgatcggtgctcgctcccccgtcctgcccccgggggtgggtagggcgcccacacgcgagatccctggggatctccctgtcgccggctcccgaaggtggacgaggcatggccggggcgccgccggccgcgatccatccccacccttgtctctgcgggcttccaccccctccctcgccgcccttctcgcttccgcccgagataatgactcggcggcggcggcggcgggcatcgcagtggcgcaggtgaggc

SEQ ID NO: 130821 - DNA, 1019 bp, Homo sapiens
ctttagggaaggggggagtcaggccgccctcacccagtgcaggtccgtcacgatggtcacccagagcactcacgcagaaagccagcttgcagccgccagccctgaggatgccgcccccaaagggctcattgctctaatcacccgtccaggggcttgaggcaaagctccaagacagacctgtagcagcatggcccaaaaagttcctctgctgccccagtcccatacctgcctgaggtacgggggttcaggctgagtcggctgacctggagtcatctggaagccttgtcagaaatgcagattctgcagtgctgttcccagaggatgagattcagcagaactgggtaaagccatgaaacctacatttaataagtgcccctggggtttttttcagcaggaggttggtacacttcactttgattttgtagaagatcgcatgaacacagaagtgttaaccacatatgggtaccactgaatgacagtaagttgaggaatttgcccaagaagacacagctagcagttggcaaaggtgggagtcaacccagagtcaccagtcccccaagtctgtgtttctaagcacaggccaaacctctacagcagtcccctaggagcttctaaactcttcctttgtacttttgtgttatccagtaccacccgaaataagcagcatcagctgacactcttctaccttttgattgtatagggatgttgttatggtatgtggatctggatacgttgtaacttaagcctatcagtcactaatagacatgaacacccagaagggtctattacgtctagatggatgccaactcgaatggatttttacataatctctagtttaaaggctgctagtctatcaacagaggatagagaaaaaaatacactgaaaattagatttaagacagatttatccctttgcttggcaaatgtcatcttatcctgttaacagcccacaaggaaaaaagttaacaaaaaataaattacattttcaacaatgcgcttgaagtgcaggcacagatgtc

SEQ ID NO: 130822 - DNA, 1098 bp, Homo sapiens
ggctaggcgggtgtctccttcctcccttgctgctccatgtgcaccctcccgaagccgcacgctcagtggaagaggacgaccatctccgatagaggacgactggtcttcggttaagggtatagactagctgcgctcccctgctagaacctccagacaagctcttgataatatccagtcttaaagaaggatctgttacatgtgcttcagaacaagtggattaagtacaattgaagattccatgtataatttcaatcatcttttagttaaaaaaaaatttaactgaaagcatttccgtaagagctactccaacctggagatcaccaagtaaaacggaggagaagggccaaaagtttgagaaaatggatttcagtttgagctgaaatactaagtaaagtcctacctaaagttgactttatccccaagtgaaatggagagaaatcaagagggtaacatatgagatcagtcaaccgtgggcatgacagggagtcagtgagtaagcagttttagagaatcaacagcctgcaattccatcaagatagttgagagacagacccaggaatcatcctagcaaagcgacagcctccgtcacttgcagtggctaaaagatgtgaagacaagacaccatcaagcccaaatcttattggttacaaaaatggctgaatctaataatgctgacaacacattatatcaaccaaggtgaagtctaagtagttttactttatttagatgatgtatctggatttttcctgttcaattttcttagatctttgaaggaattgccctgtgtccattccaagtatttctggtgagtcatcaagtttcctggctgcaggagtgggttcattcccccatgccccagcaacagtgatcagaataaaaagggtgaatgcaagatctaataggccaaatccatttatatacggatggtgggatgaaaacactttttttttgttgtttgttttttctatcgagatttttataatggaaggatatacatctgaggctgtggtgggaagagctttctgtagcatgaaaggaagaaaagagaagcagagaggagaggcagacagagattcaacagcagtggtttccaacctt

SEQ ID NO: 130823 - DNA, 1001 bp, Homo sapiens
tataattatgcccttcgcttgcaacaaagaatatctgagccacttcctctagctctgcctgagagccgtagagtggcggtgcctgcagttgggtgggcgtgcacccccgctcactgctgttcagtcttcctagcacagaccacttctctgtggcttctcatggcagacagcagtgtgtgaaccccagtggctgtcacgagtgctttctcttgtggtcagagagcagaacttgctaccaggtttaagttactggaggtggaggtttttacaatcaaaaagccagtctttgaaagcacagaaaatgcattagcatcccctcccttggagagagctatttttgtctttcgtcttcacagactgtgctccaaaatagggagacgagtagcaggaggggaacaaaacaatatccacaatgtctccagctcagaaagagcaaatcactgccatttcctcaacaacaacaattgccacagcagtaatggagaacagactgagttggaggcaagctgcccttgggtaaagcacaacacggatctctttctgtgggattgctctccatatacttcatgaaacaaggtttgttgctatggttactagcaaatcacatgatagcctggctacctaaaagtgtgggagaacagcccagatcagaatgtgatgggggtaggggataccttccttcccagctcggctgcatttccctagcagacttggatgacctcagaggtcttcctcatttccaaccagcccacacgtggggttaaaggccagccattctttgggcaccaagagattcctttcataacgagatcatcacaagtttgcctcaagggcctctccctcttgttccaggagcccctctccgcctccccagccccttccttccctggcccctctgccacacacaggtgctgtaattcaatcgctgaattgagtgggagggggtggagtgtgcagcctacaccacttgaataagctcttttctaaaatcgaggatggca

SEQ ID NO: 130824 - DNA, 1108 bp, Homo sapiens
ttattggactcttagtccaacttagttgtttttcagctttaactttggtgactcatttgtgctcagttctgattcagacaatggaaaactattttagcaagagctgaactgatttttattcccctgttgatgtccaaagctcagcccaccgtcatgcactgtgcattcacattctctgtttctgcaagctttgctggccaatttcaccaacgaacgttgaattgaccaaacatgtactaagtgcattctgcagacataacggagactgaattttggagatctttgcttcccaaagaatcccctgaaaaaaaaaattttttttttacttctactaagtagcccagttttccaatcacatgaattttctggaatatttttggagagaagcagatttattgaagagctgttcttttttaccccagatatagacaaagttaaatttattctctgaatataaatcatcagagtaagaaggtaagatttagtcaagaagatacatttgttggactatgggttcatctgtgtgcaacagagacctaaagtttcaatggcttaagcagtattgaggtttatttatcttccatgacagcgtgagagtttgcagccaaagactagtatggcgggtccatggtgtcaaggactgccaggtatctcccatcttattgcttcattatctctaggggatggccctcatctgcatggtccaggcaggaaagaggaggataggaataaccccaccccagaggctgcacccagcacttccccttacatacacacacacacacacacacacacacacacacacattccagctgcaaggaaggctgggaaatgtctttattttgtacaatcagtaaaaactgagattctatcaataaagaaggagggcagacattggagaaaaactagtagactttccaacatattcctgaaaaattttaaatttcagaaggggctataggtgggccaggcaggaaagaatcattatctcacccaaagaatgacatcgggcttcaagtatctaagccaccatcaaaaaggctggtgctcttccaggtttttctttaaagggcatctgtcaggctggggagaacacttctctaggtgg

SEQ ID NO: 130825 - DNA, 1069 bp, Homo sapiens
actacaacagggtgtgaaggctgtcctggcctactcctgctgtcttcccctttatctttcaaaagtgtcccctaatctatcacatttctaatccagttgaggcaacagcttcccaggggtgctttagaaccttgaaatatcaataccataaaacatggtccagaaaaactaacttttatttgatagtatgtataaaaccatctgttcatttcccatacctcttccagacatgaccttcaactggaagggattaaaacaaacaaacaaacaaaaaaaaaaaacacaaaaaacacttgtgccccagagcctttggtttaccacccagggctctgatcactcgagatacattccagaattcatttaacatgtgttcccaccggagtcagcagaatgggtaaccacgggcagacagcacattctggcaattctcaggcccatgctccagaaagacagccttaagttcatactcagggtttataaatagtgagtcatcaaccactaccagttgtcttggtactagtgacataatcttgtaactcctggtgactagagagcttcattaattttgtggagaataaaacctgctctcttcatcagagggagaactgcattctaatttgtaacttgtacgatgtggcacttctcccccttctctgattgaaaatcagtatttattcctgctctgccttactgccatgaataccaaggccattgtctattttgttcaccgttataacccatggaatgcactccataattatttgttgagcaaattatcaaatagatgctttcatattatctcattttagcctcaaacaaccctgggaggtatatgtattatcttcattttactggaactcagaaagatcaagtgacttttccaaggtcacttggtactctccaataattcagacaccaaatattccaggagcatgtctgacagggtcagaaaattcagttgctaactgtttggctaacatttgttgaatactctaagccagtggtccccagtgtttttggcaacagggatgggttttgtggaagacaatttttccatggacagggttgg

SEQ ID NO: 130826 - DNA, 1046 bp, Homo sapiens
ctctcttagcttgtaaatgctctggaacttttcttcatagtatctcattcttgagtagtcatgttgggggtagtttttacttataaaagtaatacatgcctgcactccagcctgggcgacagagcgagactccgtctcaaaaaaaaaaaaaaaaaaaaaagtaatacgtgcttcatggttaacaattcaaactatgcagacaactatcaaataagtaaaagtcccttatgtttccattcataccgtaaacctggttttccgtttgttttgattttgattggtttgttatctggtgggttgattagtttgagttttggttttcaaattcaaactgccttcattttttttttcaatgattgcttgcatcatccaaaaggaaaaattcctatgaccagtgaccatcctactgacagagattgcttcgcaactaaactaagcttctgtgatttgaaacagcttaaaagctctaactagaaagcttaccaactcaatataaaaccaggttttaattgacttgggttatgaaaggctctaataatagagcctgccactttaagaaaatgccatagcccactggcatatgcagaagctccttgtgcaagggaggcgtgcctacagctgatgtcatagcccagccttctaatgccatttgcataaagagtattcgattgcatgattatataaagtgaggtttactggtattttcttgtttagttcttgaaagtctaattataggcctaagggaataaatctaccacttgaagaggattgttgtggctactgtcagattccagggagaagacagattaaaagcaaaaatttgaatttcaaagaaaatactttaatgcaccaacacaatgaagtgaagtttatgtcaaaatatagaggtttgcctttcttgtattctaaactggttcttcattaaaataactttatctaaagaaaaatgaatgccagccacagtggttcatgcctgtaatcccagcactttaggaggccaggcgggtggatcacctgaggtcaggagtttgagatcagcctgatca

SEQ ID NO: 130827 - DNA, 1122 bp, Homo sapiens
tatttattgaaaatcatatatgtgaagttgcattgtgagctgtaaagtattatataaaagcaatgtattatacaaagaaatatagcaaagttccctaatctttggaaattcagatgcattctggagataatacatatatttatttacataattttaggctatatggccaagtgcttggtgtgttttatagacaataacttaatgaggtatatgtacatgtgtgcgtttatgtgtatataggatggctttgggttgaagagggcagtctgtgcctggaagtatggggagtcagctgagggaggagtaggaaggaatagggaaatcaaggtgtgggtggctgattgagcaaaagtacataaagtttctttgagagaaagtgagtaggcaagcccgagcacaaggcttgtgaatgagagcctttgatcccgtggatgagagtggggagaatcgttagaatgggaccagattgtgcaatgcgtgcacactgcagaaaattgttcaaattactcctgacactggggactctttcagggtttgggaacgggagtgacatgatgaaagtatgtcaggaagatttatattaatgaaatactgtgtcgatactggtttgatggagatcttcttacaacctcttgtatgtttctctatttaacagtttactatcataatacaacttttggttattctaggttattatgaatatagattaatgggcaagaattttgctgtgctctaatgcagtgatactactaatgcccaaaaagctgtatttagggatgtttgtccctgcactaaataaccccagactatagtgtggctatacacgacatttcttgtcttctacttcactataaaagtaacacattttgaaatatatctcatatataaaaatgtgaagactgtggtaaggttggattttacaaattgaccagtacaaaacattttgaggaatagtatccatgtctgtctctctctctctctctcattcttaccacatagatttttttaaattaatgcatgtttttgaattttgtagtcacttttttcatattatgtctttgtactctgccatttcatttaacaacataacaggtgggtttttcgtgttataaactgtgctaa

SEQ ID NO: 130828 - DNA, 1815 bp, Homo sapiens
tatggaacaaatgtgaactggtaaaggtcgatcttgatactatattctttgaaaattcttgaagttctttaatttgaaattgaaacattaatttttgaggtttttggaagttactatttggccatttttacaaatggattttgcattaacaggaagattggaatgacttgtggctggattaattcccagaaccctctccctcctttcttttctaagtgagttgttgattttaggagtttgctttgtgctgttacctaaaatcagagactggtgtacagtatgacttccatctgaacttgaaaagtattaaaatgggtcaatattcacattcttttagatctcaggatgggaaaatgggtttgttcagatggatatggtaaatcttacccaattaaggaaggctaattttagagttcttctaatttgcttgtgtcaactcttaacttgtaaaactgctgttaactcggtttaaatttttaaattaatataatagaaagaacactaaaatacttactggtaactgcttagagccatttatctgatcctgtggattacagaatgcattccctcttctgctgtagcttatcattgctttgttttgtagctctgcatattttgcccaccttgtcttccctgtaagtttaagacgtttccaaggaaaagcttcagggctgatagtttcttagcaattcctattcttatgcccttactttaaaatagtccttttattttgtgtattttatttcctaagtttcagatgtaatatctgttgtttcctaacatgtcgattaccagaacgttagaattttacctaatttcttgtggatattgcagaagttctggttaaatcacaacttaaaagtttttaaaagtgctttgagcatatgtatatgtttagtgacaaatcatataaaaccattcacaagttttggttttttttttttcgtttgttttagtgactaattcaggatgaaagtttttttgttcttgtatttaacccttttttataagcagctgaagacaccatatttaacactatatctcagtgatagggaaatagctgcattgatcttacatgagcataatcatccttatacttcatgaggggattattagtacaatccccattttactgtgtttgagttaaaaaccaaacatccctgtaatttaatttgaagattctttaacagattgcagcaaagttcattataaaactgttatggtgtcttcaaagacttgataaaataacactgagagagaattggtccatttgtatgctgtatttctattacttgccaaaaggaatggggttaagattaaacttgtttccattctcttcacatggatattcatccccatgtttaactgacacactgggggctcagttgtgtgctgtaatgtcttattaaagaagatattaaagaaaactaaactagtctaatttcttctacattttaagaggtttttatattcccacttttttttttctcctttctgagcttagaattggctcttaagtataggttggtagatttgagggtagcaagagatttctttcatttctcgttttccctgcagtctttccctttttgaggtctgtagaatacttgggtggaaaaaaacttgtcattttgaaaccttactgtatagaataagtgtgaattgttggaaagggggaagtgattggctattaacataaaaatacaattatgaaaaatacttaggtcagttaattgaattggatgggtaagtccttgatgatattgtaagatttgaagttttagttttatattaaagatactatataggtaatta

SEQ ID NO: 130829 - DNA, 1114 bp, Homo sapiens
cacctctttacaattagtttacttatagtacttagcagaggttcttttttttctcccccaacctatccccttagcaaagcttctgagtattaaaatatagggcaaaatgtagatgtagatatgtgctatataaatttgtttataaatttgttggttgaaagttatcactttacacattacatttggttggattttttccccctaaatagtggagttggtggtgggtgtgttgtgtgtttcagaattctttctttttaaaataaattcttcagagttctgtatataaagtcgagttgacaagtttaccagatattatcttcatagtgtttcttcttagttatttgaaatgcatgtaagttgcatttgtgcaatggtaacattcattgaaaattttgcttatgttttataggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcacaggataaatggttttagaaattctgttctaactttccacattatttgccttataaaaatctaatgaattcatcagctagaattgcaagtgcaattcttatatccctttctctgctcagtggcaggttcctcagttaaactagagcagactgattcattaaaattgtgcatacgattttatgggcagctgatgatctaggtgaaaaatgacttatctgctgccttagtatattgcggttatgtgtcattgtacccctctgatcatttcctgtgtttgagttggaatatttaaaattgcagtatgacctggctctaactgccagtcaggtgtaccctgtagataactgatagcttcctaaaagcggttggattgtcagtgagcccttgtgaaaggttag

SEQ ID NO: 130830 - DNA, 1076 bp, Homo sapiens
cttgaactcctgacctcatgatccacccgccttggctttccaaagtgctgggattacaggcgtgagccaccgcgcctggccacaattttttaaatgctgggtagtattccgttgtataaatactataaaaatatgtatacaagttgtgcatccgtgttactattgatgggcattcagattttttccagttttggaatgggcactcagaacattttgtacatgtcttggtgtacataacatttgcatttctattgggtatataccaagagtggaattgctggctcatagaataaacagctaccaactagttttccacagggttgtgtcaattgatacttttgtagcatttatatgtgggaattttaatacctataaatttttatttgccagatatttctataaaacttaaggcttcaattctaagaacgttcttatgctttgattactctgtattagagtaaataagccactctaatgcttcaccttctgtttttagatatggctcgtggacagcagaaaattcagtctcagcagaaaaatgccaaaaagcaagctggacaaaagaagaaacaaggacatgaccaaaaggctgctgccaaagctgccttaatatatacctgcactgtctgtagggtaaggggaattgaattgaaagatacagctctcccgtgggcagttttggcttgaatagattaaaattttgaaaccatggcaaaatagatgctttacatgaaatagtaggtttgagagctgattattttaggtatctattttcattcaccctttaaacaaatattttttgaatggctcctgtggccaggcaaaaatctctaggtgctgggaaaacagagtgaacaaaacaaaattgctttcctcatataaaataaagatgtcttcataagggcatataatacacttcactagcacatcatataactctacactcttagagctatataatatgctagtaagtatacctctagttatataattggttttttcttcactaaatttataattaggatgtctgtaaaaccatatagagtataatcacgttgagagcttttcctagaatt

SEQ ID NO: 130831 - DNA, 1041 bp, Homo sapiens
ggggtctccgaggcgggagaggcgggtttgggaaggaaggtgcgccaggctgaagctggggtcggagaagtgttgggtggagacctcactgtgggtgcgttcctcctctcctctccccaaaacgatggtgttaaaagctagggtcaggatgtggagcgctgcctgggcctcttcctttccgatggttatggagaatgagcctacttcctggacccaaaatccttttcttctgttactcatttatgttggttttaaaaggagctttggggcagagcttacttgttgcctcctacgagagcgcctcattttagaactcgtttcttccactacttccctctttgcagccccctcggaaaaccacactgagagttgcattaaaaaccagcatgtaggtatttgtaagtgactttttccctccagtttgtcgcatttaatcaaggagcggttgtagctgcctacgattttgtagaaaattgtgttggcttgagagcaagtcctaagttgagctgtccaaaagcaggtggttggttcgtttgaatttctgctttcagaaaggaaatcgatggggcgtgttgtcagaagttaggggcctacctcatgcatttagcttattttattccatttcctttacctggtgttaagttttctgtcttcagaataagaacaagtgactactgtctttattaagtctcttcggtctttttggttgctgtttggtgacaatggaaaatgggttgaatctattgtgtaatgttatattttagggaaagtcctaagtgcaaaagttaaaaataattttgtgtgtctaatgacattgctttgtacgagtcacaacatggaaatatcaaaatagctagtaacttctagaaagcaaaggaacttctgaaattagtggcttaccatttttgaagattttttttaacataaaacaagatttcccacaaaatcagtgtattaagatacataaaatacattgtgtcgaagagttaagatgtgtgagaagactggctattttgttacaaggtcctgatagtaagacat

SEQ ID NO: 130832 - DNA, 1032 bp, Homo sapiens
agacgggcgcgtcagcctgggaggagcgggaaaagggtcgcagcgcctgaggcccggccgccgcccgagtggatgagcgagcgagcgacttgtgaaacacgccgcggcccggtcaccaaccaggaccgggatcacgtggctcccagggctgggtgaagaagccgcccggaccgagcgcgccggagaggaggggcgcctggggacagaaggcgacgtcccctgaagtttgtgtcagccagggcccgccccctcgcgcttatgtaataggggcgcgctgccattggcccgcgcgaccagccagggcgcaggcgtgcgagcggggtgggggccagaaggaggcagccgcagaaaggcacatgggcggggctgcgaggagcaggcggggcgggggcgccgaggagagcggcgcggcgtgcgcgggcacgaggcgtagtggtctcccctaaggctgaggcggcggcgggcgcgcggcggcggcgggcgtgcgaggctgttgtgctcccggctctcgtgtttcccctcctgagcgggtggaggaggcccaagcggtgctgggcgcgctcccccttcctttccctccggcgtcctctcccggccctctcgcgctgcactgtctctccgacgcaagactgtcccggcccgggtgagcggcagcgggggcggtgctgacgccgcgggacgcccgggaaacggggcgggggccggccagcggggggcggtggggaccgtgggactcgccgcgggtcgcgaggggtcgcggggggcggcagggcccggcccggggcgggccgcgggaaggggatgagttcgggcgcctgccaggccctgcaggtggccgggtcgcaggccagccgcggaagcggagcggtaaccttacccccggcgacagccgccggtcagctgccagagtgtggcgctcccggtggacgcaggggccgggtttcgggcagtctcggcctccaggaggcgcgtcttggtccagggtccgtgaggactggctagatgggggctgcgtggcctttggtggcaggg

SEQ ID NO: 130833 - DNA, 1240 bp, Homo sapiens
tctagtagcctgtgcttgtgttgtaggtgcagtagcttctttttacccccgtctcttttcagattttttttttttttaactaacaagcaaaaaatcaaaaacaaaaacacaacagctttaagttggaacatcaataagtcaaattgctgctggagttcccacatgtagctggggaacatgtgccctcattgcaaggcaggaggtaggtacgtgactgtgcatttaggtatatttgtgaccgagaagaatcacagaaatggaaaccactggagaacagaaagcagcatgaacttttcagcaggcaatcccatagcgcgaggctcttttcctattctttgcctctgtatcctctgtgttccttctggttccagctgaaccagtgataatcccaaatcagtccttcctccttttcagtttctcatcatcttcagactttctggagattgaagagccattcaaaccaaatctttgagctctttcctttagcttatccaggttcatgataggtttgttgttagatgacagaccttttgttgaaactgaagaagtcccaaacctagctgcccgggcagttttcttactttacaagctcacgggtacatggacttgttcagccctcttctgcattctctctccctgtggtatttcagatgtaatttttaccactttcttctctgcttccacgtcaacagttttttcagggagttcttcctctttgacagggatttctatggggctttgtttcttcttcctctgtttcatctcccagtacatcttcatttgcctcttcagcatgccctgaaaaatatgcctggagccagcactttgggaggccaaggtgggcggatcatgaggtcaggagttcgagaccagcctggccaacatagtgaaaccccatctctactaaaaatgcaaaaattagcctggcatggtggcatgtgcttgtagtcccagctactcgggagactgaggcaggataatcgcttgaacccgggaggcggaggttgtggtgagccaagattgaaccactgcactccagcctgggcaacagagtaagactccctctcaaaaaaaaaaaaaaagtgcctggagccttttgatggcatcttgtttcatttccttggtctccaaaccacaaggaagacattcttgctttagttcagcaatcttccacttatggtgcaccaccgtcttggtcgccatcttgttacccctcactccagtaggcccccacccactg

SEQ ID NO: 130834 - DNA, 1058 bp, Homo sapiens
ctcatgcccaataattcactgggcatgaattcattgccaaggttggaaaggctgaaggcacaatgagacaatccagctattacctgcagggctggagaatcaaagggaggaggaggtgggtgttggaggagccacccagcaggagctgggaccacagagagagctgttttccaatgggagatgaaagcacagcagaattgctgccagagacattctcagtgccaagagggaggagaagaactgtcctggcttctctctgcctcgtgatctcctgccagtgcctcccatcggcagaatttaactcggagtcagagggcacattaccgtggaaagtgcagtttgcagaatcaacctctgagatgcagagcaaagtaggggaagtcagggaatagatcttaaagcttccaaaaattacttaaaaacagacagtaatgtatgtgtttccaaataattttaccactgtttccataagaagtaagtcatttctcatttgtagacttcattaccccattttgctgactaagatgcttcagtccaaatgagtgtgggctaagtgaaggttcccatcctgctgggtatgaaaaggtattactgagccttgcaaaggacaattactttgatttcttacacattgcaatgaggacttttcagatcttccatttcaccctggctaggacttcttgaccacactggcagagtttaatgactaggatagggtgagaggctcactgtagaagacaatgaaactagttactggtttttcttgcaaaatagttaagccgctcctcacctccgcatcacacacatacacctattgtattaactagtcaaacatatttatcgaataaacaaggaaactgaggcctaggaagtctcactggcccatatcacatgactccccctcagataattagtgcaagagccgggataagatctgtgttcctgacctgagctgataaactaaaccaagacctggtgactaggacggggattggggatacttgccttaacctgtttagttaaatctgcatagagcagaggaacaattttattttatt

SEQ ID NO: 130835 - DNA, 1030 bp, Homo sapiens
caaaaaggtaggaagggtgctgcaagttgtgcaatagcacattcatagatacagtaatcaagacaaaaaaagtgggactgaagctgggcgcagtggctcacgcctctaatcttagcactttgggaggccgtggcaggcagatcacttgaagcagaaagttccagaccagcctggccaacatggtgaaaccccatctctactaaaaatataaaaattagccggacgtggtggcgggcacctacaattccagctacctgggagactgaggcaggagaatcccttgaacccaggaggtggaggtttcagtgagccaagatcacaccactgcactccaccctgagcaacagagcaagactccgtctcaaaaaaaaaaaaaaatgggactgacaaattatttaataaagtctgataacactattagccaaggtggaaggggtggatactctcatgcacgctagtgagagtgctagttgatttgttgatttgacccatgcagagagtagggttaaggaagggagtcctcagtacatggggctgtggaaaggcttgtattttttaagggcatcttagaatggcagggagatgaagcatagatggaattttctggtctcaaactctaaaagaaaccctgattaagctgtttctatgtgtcacaggctgaagccttgggtccccaatggaggctgactgagcccaggaaggattctaggggtccacagacccagaaggctctgagtgttagaggttcattgattcttgacacctcagtcctggtggcaaacctcagagctgcaggtagaatgttagggaaatgctatttgagttcctctgcgaccacccacctcagcgtctttgcagaggaacgtcactaagccagaagtggagctcagagtttcttgctctttgttgctttaacagtatcttggctccacaaagtcttgttttacagttttattggggagatattcaagtgtgtgtgtgtatgtgtgtgtatttatacttttttatactgaggtttaacatgaatatc

SEQ ID NO: 130836 - DNA, 1036 bp, Homo sapiens
aagagcagagaagaagaacagggaaggaaggaaggggaaggagaacgaagaggacaaggagagggccaccaaagtccaatggtttaggcagtggttgctcaaactgtggtcctcaacaagcagcatcagtgctgacttcgtagattgttagaaacacaaatacttgtctcccaacccaggtccactgaattagaaactctgggggtgaggccctttaacctgtgtttcagccaggcctcctggcgattctgatgcacgctaaattaggaaacgcctgatataaagatgctgctaagaaggctgcccttgatttaaagaaagcaatttcagaagtaaatttatacacgcacatgtgaacaaaagccacgtagaaagacattcattgcagcattatttatgacaggaaaacactggaaacaacctaatgttgaagaaattgtcattccatatttcatacttttttaaagggagagagaaagcgatcttcggactttattgttaagtgaaaaaaagcaagatgcagacctgtgtgcattttatgctaccatttgtgtaaaataggaaatgaggtgtatttgtatttgcataacatgtttctagaaggatactcaagaaattgttggttggctgggaaacaaggaagggaggtcattttcacagtttacccttctgtgccttttggattttgcaccatattcaggtgttaaaaactcaaaacaagttttaagtattaaacatgaacagaaaaagcttcacataacaaatgccgaaaaagtcgagtgaatgaatctttcagtctgtacttaaattcttcttctgcctgggagctcgttatttcaccaagcagcccaatctctcattatgcacatccctcatcctgatgtgctgcttcgcaagatctgctcgagtgacagagcagagcaggagaaactgttgtagtttgaagagcagtgaaggtttctgcctgagagacttccccatgctctccccagcaatacctgggattcaacccctcccaaagtgctgtggggagaga

SEQ ID NO: 130837 - DNA, 1001 bp, Homo sapiens
aaatgctctctgttgagaaaggaactcatagtcttccagggccagcagaattcacaactccaaatgtaaaagtatgccttgtgtgagtcttgcaattgttttggaaatagaaacacctgcttcatatcaatattcacattgttttgctctcatcctggactaattattgaaaggttgattgtgcctcaacttccttatctataaaatgaagtcatcaacagcattaaatgagcttaacacatatagtcagtagatcttagctgagcagatgatggcaatgatgttgatgatgcagctatttccacattagggatatttggattgcttcccattggagaacctgctgttattgcccctactgaacacccaactccctatcctcagccaggtgttatttaggtgtaaaagaaagtctgaactggagaataaggagccaaaaaacgaacaaagagttttctttaaaaaaaataatttttggcaattggtggtgaaatgtggatttgtcatcttgatagaatagtgttgccacccttccttccgagcaacttaggattgagtcagaaggtgtcacatcaggcagatttgttgaacagtttggcaatggtgacagtgttcctacagcctacaagggtttcctggagtctgtaatttaagccacttgataggttggagttctgttgtttaaaaattgggctgttcttatactcagcagacattatattcttccttgagatagtatttttgagtttgtcttcattaaagaagtctccaggccaggggtagtggctcacacctgtaatcccaacactttgggaggttgaggcgggcagatcacctgaggtcgggagttcgagaacagcctggccaatatggagaaaccccgtctctactgaaaatacaaaattagccaggtgtggtggtgcatgcctgtaatgccagctactcgggaggctgaagcaggagaatcccttgaacctgggaggcggaggttgcggtgagcc

SEQ ID NO: 130838 - DNA, 1035 bp, Homo sapiens
taaaaaaattatgaactattcttagagtctatggagggtcttgagtcaatttaccgaatgaatttgtggcctctagaggatatctaaaaatggggacttgagctcctcctatacctcctctgctaagttaagtgatgagccctggatcaccatgatggatttatttgcctccccagtccatgagggccgactgttttgttttatggttttatcagaacccaaagtagtaataatgagttttaagtaagataatatttagtaccctagttaagcggacatttattgcaaaaggaattcctcagaagtttcccagagtaaggttttaacctatggcagccttgaggggctgttgaggccccagagcaccctcctcttccctggatgcagcctgctctggtccagcatctggctcccaaggcagccaaaacaggcagctctgttgcaatggtctgacggccaggtggtctgatggtgaagagacatgtggacttcatctgaagcctttgacttcagacactcccacagtttctttgtttgggacagccttggagtttctgtaggcctggaatgtgaccatttagtaaggcctctgtccactttctcatgggccctttaagcatgcagtgaaagtacccctccaattgctggcaacctgggagggagtggaggcagacttagacattagatggacttggagtagctgggaaaggagatgccatcaggagttgaatttcaagcaatagaagatgtagggtgctgttgaggtaaaatatgtctttaggttgaaacaggagagagcgtatttacatggttacaacagtgcactcttttaagagcagggtgggtgtgccctcctaagctctcgaatagcaaatgccaaactcacatgtctgtcactataactcaggcagaccatggggggcggggagtgaggcgtggaattccaactccatttccaatttaattctcatcttagggggtatgtaagcttgcaagatgtgtagttgggttataacggctttagaggaaactggc

SEQ ID NO: 130839 - DNA, 1013 bp, Homo sapiens
actaatccacgaagctcccaacagaactggcacagatccccttagtagggctgcccaaaagattgaggctgtcagacctggatatctgggcaccctaagttgacaagtctaaagggcagagagcatgctgcctttgtctttgtcttcctagaagacctagtgcagcattcagcttatagtagatagagagagccattgttaaatggttcttatgcaaacaaggctgacctaggtgctgggccatgtgggaatgtggaagcggagagcccagctagtgggactgacatgccttgggtagatcttctcacattcatggcgcctattgcctccgccatgactcactgcccatgcactccatcacttgtgagacaagatgtgacaagcaggcgctgaaagttgtgccttgtaacctaaatatgtctctttcttttgctctttctaccttcatgggagtaaacctctcttctaatcacacatgagttaatgtaaagttttcagaaattaaatcacatttccccaatggttaacttgatcatttcagagttacatcatcattgtgatttttttttctcctcaagggtaataaattaatgaactatgcacaagggaagtttctattttaagaaagctgtgtgaagtggaagaatactttgttcagttatttctttcatagtaggtctccgccttctttaagctgaagcacacctgtttcaaggaaaacagttggccaacaagacagcattggctttgtgggaatgtgccaaagaaatttcaagatattgtattcttttgattcatattcccaagttgctctccagaggaaatatactagcagaaggagagaatagcagccatttacaggtaattagtgagtctatggtgtatgattcattgaattccattctagatccctatttataattattggagatttcttggcaatgcttaagagacaaattaccaaaatccccttacttgtcatagcagcattttaactttgcataagcggtact

SEQ ID NO: 130840 - DNA, 1125 bp, Homo sapiens
ttatttaactggtgcttcatgatggaaatctaactagaaatagcattccaaaatgtagtattttttattgttttcagaagtgataccataaaagttaatgttcactaagattttgatataaaaattatatgataaatattgaaattcactggagccaaactaaaaacagtctgccctttttatctcagtagtgaactttagggggttttttgcatgtattttcataagtgcctttaaataaagacacggcatccctttaaaatttagtttacattaatgtaaaccagaatattctcaggtcacaatgcagttttatatttgatttgtaggaaataaatctctagcctgaaagacattccagctgttgcctgtcttcatgggaggattgttcacattttctgaatctctcccagtgactgcaggaagaccaaaggctgcacattgcttttatgcaaggatgaatttttttaaaagatgattttggattttgtttgctttaatgaatttaagccctatctattagaggtaaatgtcaagaaaactgttgtgttctttggctatctgctctgctgactcccacagactttgatatgattcatataactcaaaccatgatcaggtttgtgacgaccatatttacaatatcgttggagatcaaaaatagcatctcacaaaagtttccccgtcctataccttcccacatcttatcatggatcatgtgcagcacagtcactcaattggcgaacatttattaacggactactgcattcacagtattatagtaggcatgtgaggtcctcccctgatgggatcctcaagtgagatatgctgctggcatagagaacccaagggcctttatggaccctggcttttgtttgcttgagcttttattcaaacattcagtctttcatgcattcagcaaattttgagcacatactacgtgtcaggcattgagccagaccccagggttgctataaggtacaagacagggcaggtcccttccatcatggaatatgcagtctaactatgtagagaacttgcccagagacctatatgtactattaactggggttctctttcccacagccacactggccactgcagtccaaaagagaattctaaaag

SEQ ID NO: 130841 - DNA, 1041 bp, Homo sapiens
ttacagcattgagactatgttgatttcaaggtcatgtttgttgcagcttcaaaagatgctggcaaggaacgaggtactctagaaacctggctgttgcattattaaatattttgtgtatagtttcggacattcttaacccgtttggtgctgtggacctctttggcagcctggtgaagcctatgtacttttctcagaattatgtttttacatgcataaaataaagtatgcaggtttacaaatcaaaccactttcattcattgaaaaacgttaactaaattttacaaaattgtgatacatgctttgttagtaacacattattacataatacaaactaacagcagttataataactaccataactaccataattttgaagtaatggtgagcataaaagatatttcaggatatctacaacaactgtaaaatgaggtgaaaatatctgtgatttctcttggcaacaatatcacaggtgctgtggcttgtggcctacattttaattgaaggaaatactaaatttcagtttgaggttagtgaaactaaagatataatatttttcccaaccaagttccccaggccctcttgaattttatccacccctgagtcaattgatatgtacgttagtgatgccaaaaggtgatagaactgcactggacaaaacccatcaccccatttccacattcggttccaccgcatcggattttattcttcgagtgtgtgaattttgcaatgttctctaaattctgcatgaaaaggaataatatgttcacatagctaccaaattgtaactttcttttattttcctccttgagatccattaacaacagtcttatgtcccctggattgggaaacccttacctggttagacaggggttaagaggaaaactcatagtgttagtacaagttatgcgagttaaaaccatgggccacagaaggtagttcatgtgctcatagcatttgaagcaagcattaaagaatgcatgtggctttccagcttaatgtaaagcacatacacgtgtgaattgatcaattgtcatgttaatt

SEQ ID NO: 130842 - DNA, 1047 bp, Homo sapiens
aagaagcaatttctgattctactaaagaaatttcattcttttacagtgacacaaatgtaatctgcctggctgacttaggttccatttatattttgtagcaccccagagctactcttttttatttatttatttattttaagaaacagaatagaagtcgttataagcctagcatataaaggtccttagggttttgagggcagtctcttctcccctgccttttaactccttgtcctttgtttgggcatacattttctgaatgtctttttcagagtaccttcttgtgagtttcattgattttgtttaatcggcttcccattaattaagaaagagaattaactgggaaataggcacgtgtgcagagttaaaagtaagctagggtcgtcgtaaaggaaataaagctgatgttagaaaacatgtgagataaccctttcattctatggctctgggctttcattacactttgtgtttgtggaacactggccctgtttactcaatgttgagtctcagcaaaggggtgtggatgagaggactcaagaggggagcatttggcacccgtatggccccaaagcacagttttcagcttactcacatggttattttaaagtaacactgttttgaaactccttcggtcctcatttttacctagacattttacagtacaggaatcctgaatttatgttatctgatgtctacatcctacttggtgtcaggatcattagactgtcttacctgtctctgagtcataagccactgtcatgaacccaagccactgttttttatttttctttccatcacaagcatggtctcagtatatccatgtagactctgatatagtttttaaaatacattttcttccaacccctccccctgagcttctgtttttatatatttgcttgcaaataagtttaattggctaagaaaactactccagaatttttcagtttctttccttttgttatagagaaagagagagagagagacatgcttcatgctgatggtagtgaaacaaatgagaacttcagggtggcatatattttcctgcaagta

SEQ ID NO: 130843 - DNA, 1118 bp, Homo sapiens
gatgaagaaaagacaagttggccttctccctttcacaaaaaatttaaaaataaaaacaaccctacagtgtaaaacaaacatgagaaataattcaattttttctaaaagcatatcaaatgtaaattatttccaaaattttacagagctaagcttcctgagtataaatcctggctctgctatgcagtaggtaggcaaattacttcatctctctcttcagtttcttcaattgtgaaatatggaatagtgcctgcctcataggattattatagtaaatgatttaataaatgtatagtacttagaaaaatgttccacatgtagtaagcactcgatgtcagttaatgtaaaaattttccaacatcaacagcaagaaccgttaaatacatccacatataacttacatgtactcataacaaatatttatttatttatgtatgagtagggttaagtttgatttacttggagccatccagttttagaaaagtttatgataactcaacatttttgttctttcttttttcttcttttcctttttttgaggttgggggttggagagaggctctcttccctattagtaggaagaaaaaggaaccatttctttctactcttcaacatttatttcccaatagttgagtcattcaacatggattgaggattcactgtgttctgggttgtgtgctaactgtagtgttgtacagatgaataagatttcatcctttccctgaagatctttgtaggcttatcagagtcagacagataaagaagaaatgacatacacacttgagccatctaccctgtggcaaggtgtcagaattttataatatattaactttattatcctccaaacaaccttaagatgtaggtactgcagctcagaggacttaagtagcttgctcaaggtccagccataaaaagatgaaatttgaacccagtagctctaaacagtaggtccaggcctgcccattaacgttaagacagaggagacagcaacatccctatgtacaaacatcgacaaaagactggttagaattgcatgacccaaaccacctgttagttcaggtgtgtgagcccaggtcagactgcttgtttagtggcatttaccagttatttctggcaaagtg

SEQ ID NO: 130844 - DNA, 1050 bp, Homo sapiens
tccgtctaaaaaaaaaaaaaaaaaaagtattcctctccaaaaatgcaaatgagggtaataacagtggtgcaagcacacagcaaaccccaaaggcagtggagccccacacttctgttattcctatatgctcttcgtcagccataatgtgagattgagaacaatgacaatgtcatctgagctaataagtggccaaaacattttctttcttttttttttttgagacggagtctcgctctgtcacccaggctggagtgcagtggtgcgtgcagcctctgcctcctgggttcaagtgattctcctgcctcagcctcccgagtagctgggatgacaggcatgcaccactacacccagctaacttttgtatttttaatacagacggggtttcactatgttggccaggctggacacgaactcctgacctcaggtgatccgcctgcctcggcctcccaaagtactgggattacaggcatgagccaccatgcctggcccaaaacattttcaagaaggttatttgaaatgtgaattatctttgccatccttgataatgaatgtcacccaagtatcaattgtatcttataagcccaaggatattaacactccattgagatcagcaattcatttaacctcacgacatccaaacggaaagacaaacctctgcagttcccccatcccacccctgtggtgattaaaaacataagattctcaacagtactttaaaattttgcaaaatttattgataaatatttagcagcttcttttgagacttgttagcaaaaaaaaaaaaaaaaaaaacccatgtgactgggtaaatgttcttcctgatgctattaaaaatggtggaaataacacttaaagatagatataataacaaacaaaatgccaaatgcctttattagtcacataatactgttggaatagagagagaaaatattgctgaatgtctgaagaatcaaggatgagaacaaatgatgctgtgtaggatgtttgctgtttagttgtatgaaagcatacttgtcaatgtttcagtttagggtattcgtcaggttcagt

SEQ ID NO: 130845 - DNA, 1020 bp, Homo sapiens
gacatttgggtaatatctggagatgtttttgattgtcacaacctgggggaagaggggagttgctattggcacctaatgggtaggggccagagatgctactaaataagctacgacacacaggaaagtcccctacaacaaagaagtatctggcacaattgtcactcatgcctggattgaggaaccctgtgttagaggaagggaagaaggggtggctattaggaggacagcaaggggtgtttgtcatggatggaaaaacacatgtacgtgatgttctcacagcctccctgtgagtctcactggcttcaggccacagcatccctgagtgacagaagctggtctcattacattggccaaccagccctcagtctacaactgtctgtcagagacccagtgaattagaaagatttgtgcagactaaaattagaaaagagatgaaaagtgattatttggaaataaatttgaatatgcctatttagatcctccaagactgcagtctgacatataaataagactaaaaatatgaaattatggtaccctgtcattctattcactagatttcactagctctgaatctaataaggccttagtcaccgtgttaaattaaagctttttaatatttaaaagatattaataatcttgctttggtaggttggtaaattttaaatttaataatttcaaacagtagctcttcaagtattcgaatcaatgattttttatattcacttatcttgatgttttgccataagtaataaatggtgtaataaaatgtctttgcgcttcaaataatacctcagcactttttaaacttctttgcaaaacttgaatacagtttatgtatgtgagtgataggcacacatatctacaaaggtggctaaattttaaaaaattaatgccatgacctgcaatttcctttgcaaatatgtagcttgtcctgcttgctttatggctgttgtttgcaacatcatattttccccttaaataaaaaatttaaaaatgacatagaagactttggccaaattg

SEQ ID NO: 130846 - DNA, 1051 bp, Homo sapiens
taacattgactcttccccaaatgaaggagggattttctatttgtccctgttagagaaaactagcatgagattaaatgataaatggcagcaataaaagtcagtgagaaatgtacacagctgtacttggatatttgtcatttttgaaaattttagttaaaattgagtgcctcctttattatgctattagatattaatcactagctactatttgcttgtaatttgaagagtttgctattagaaaaaagcatagcaaagtgaagcacatgctaaacattttctaacttttgtccaagactttgaaagattaagactaaggaggcttcatggatcgtaattaaaacaccattcatttggaaccagctcctaaaaaaaatgttgtgcctgtggcctcaaacttggttgagggaaatcctgtaagtcctagaaaatatcacaattgccgtaagtagtttattaattattgtgtagatttactttacataggaactgtgttcctgaaaaattgcaactaaaacaaatttttataattttattcatttctttattaacatattgtaatgtctgtgaaagtcaatcctttgttttggattgattttaagtcacagtaacttctaattctttgtcagacatgacagttcaaaacatgtacatgaatacttggtggtatcatggaatgcaacagtcttgtttactacttaagggcagcctggtgatgaatccttttgcagatttgtggaattattatgattattttaaatgacagttatataattgtaatataaatgattgcaaattccctgagggcaaggaaatgtatcttctatttactgcagcactgtacagtgaaaaaataaacagtacctggacatgaagtcgagacccaggaacacacgcagccttaacagctaacttatgtcaacaaggcacctacttttggtgaacattaattttctcatctgccttcctatcttacaaatgcatagggtctcaaatggaatcatacatatgagaaatgcaataacatgtgagagaacacaatagaaacctaagg

SEQ ID NO: 130847 - DNA, 1035 bp, Homo sapiens
gcagctgttcgactgggggcctttggttgttgggatatagcagaagtgtgggaaatgctgaaagaggccatcacagcccagctggccagataacccatggaaacccttcccagtgtggatcctattatcgtgggccattacttatttgatatttagacataggtgatttgcaatttcagattctagattttctcctccattaaaatgtaaaccttcacaatggaaaagtttgttgtctcttttgtttactgctaattctctagtgtctagatacagctatcagctccacctttgggctgaacctcctgaaagtcctcaaacgggccttcaagttctgacacaatctcccccaccccaagttacctctctgattttatctcctactagtctgtgaaatctagctagatatattcaggagtagataagactgttggggcatatgaaatacatctagcagcaaaatgtagaaagatttagaaggaatcatgtttgaggtctaagttctagttctgctactatttcctggggtgaaactgggccaaatcatgtgacctttgtaggctttagcctccacactgaaagaattttggatcagggtgcttctaattgtaaatttaatggcaatgctatccttggttgtagcataatatgaagttgatttatccattcagaaacatttctgagtatttttggtccctggtgtgaaattgtgaatcttagcctggtgattcataggctaacagctgctttcccaccatctaccccaagctcagggctttgcaatgggggcggcagtatagccagaactgacatcatgtcccattcttcctaggtccaagtcatttccatcaagcagcatttcccaggcttttgtcattcaggtcccatctccatgatttttactatatcacattctatctatattattttttacttaatgtctttctttaaaccactccttctttatattttaccttgcatttgccctaagcagcagttatagctgtgaatagctttgaaattggatatgccagc

SEQ ID NO: 130848 - DNA, 1082 bp, Homo sapiens
ggaaaatgtgtgtttttgcctaaagacagtaaagcttgagtaggatttaacataagaacacttccccttggcatggaggtgtggataatcactatgatgctattggcttctagtcatttctgtccctcctgcagcacctgggtccttctctgtgtttattgtttcaggggcaggtaattccttgctagagtgagctccaaataagctagacttcatctctcattcacatggagcaaagggagactgcgagagttcatgctgcaggtttgcagcatctgccagacccaaacgaggatgatttggatgagaaattgacagaaaagctcttggggcagtgaagaagccactccctgcttgactactagtgggcttgagagagtagtgggcaaggcagggaagaggatggcttcttcaacagaggttaaacttcctaacaggggctttccataagaatggcctgacttagcaaatactgcccaaatttcctgggctgtttgggattttgtccaagaatttcagacaatttagtaaaaattgcctagtggcagaaatccagataaccatagatgggaagaatacatataaagaaattatttgaaagcaaggtatatgaatagactctaggtttataattattactgatttcctgttgtttggatatcgctctttagcctccttaagtcaggatggttttgtctgggtccccaagaaatctgtactcttcccaaggctccctatgtgactagcttcttagttataggatgttacatggaatttcatttttctgcagttttctaagctaaagacttctttgctcctcctcttaaaagaatgaatgcgttttagcccttttagcctgggagcccattattctgtattttcaatgtcccacaaattcccctctgtcaaaaaacattgattttgtcaacagaatacctttcatttaggaataatatggagagagattatctcagaggctgagagcacgagacaccaaatattcagaggataattaaagtgttcttccagatgttttcaaatatagccacagagacaaatactgatcagtcgagtaattgatt

SEQ ID NO: 130849 - DNA, 1049 bp, Homo sapiens
ctattatttgggtcattaattatcagtcctcttcaattagggcacaaacaagattttttttttttttttttttttttttgctaattgatgtggatagtctccactgagggctttgttttcaatgctatttcattccttcttaaaatgtattattcatttgtaaactgctggtttctttgggacattgtccccataaacttttcataaagtgtgaacgatttcatcattcctccacccaagattcatcataaatttgatgtttgttcttgctgcaatattagtagaattcctgttgctctgatagggctcaattgaaaatgatgtcttatcctttttagtgactcaaactagataccgttctgacatgttataaaaagttagtatgagtttattttggtgcaaaaaaattgagctccatttatagtttttaaaataatatgcattttccataaactttttgaagactcagttttacctttatgtgacactggctataatttgttgcaattggtttcttacttgcctgtctctctggctacattgtaaattccttaaaggcatgctccatgtaggtctagctcatcactgtatcccctgagattagcacaatgcctggcacataacaggagttcaataatcatttcttgaatatttaaataatgttatataaaaacatcaaagattgtaaattaccccattctcaaagtaagacccccaaaaattcatgctcttttttttcatagatcactaagtgagaaggcaaactgaagacggagctttgctttattcaagacattgggaaccaaaagaaagtaaaaggcagattttcctccatctctttttcagaaattctgatgccctatttattaactgggatgcttgtactcctagggaagcgataatatggtgaggagacaatcatagatgaggtgggagggcttctggagcccgtttctaaatgctttgtgcctgcagaaaaaggagagcattgagaacttttttctaaatggaacaaagggtgtgactggcacaccatttagcctcgttta

SEQ ID NO: 130850 - DNA, 1001 bp, Homo sapiens
acaaaaagtttccttcaaaccttatttggcatcaaaacttctcccatgtctcaaaccctcaggcctttgcacactctaagaggctttgcctcactattaaatgagtgggctggagacccagaccagctggagcctcagagcccactggtcttgtataattcaagaaccattgattaggtatgacacacgccagcccttctgtctccttgcaatcacagtttttatgggagccccaagccctcatgcccaccatgcagagttttcatagaacatttagcgttcccagaggttccccagagcccacacttttgtttgagagccttccttctgagtaaaatgaatctcctaaggctttctctttgatgagtgggaacacctgttaaattccttctccctaaccagctcctgacaagaatatgttaatcccatagggttgaggtcccctgaagttctatgaccagctctgacaggaacagaacaatagtttgcccaggagccagcacttaaaatctgcagtaaaatacttggcctgcctcccgctccctttgtgctatctgaaaaaatgtggtgtgccgtggtatattgtttttgggtaattctgcaggccagtcttgaaatgaatgcttgtaggaagctgtcaagatgaacctagcattaagctataaaggttggttggaggtggtttaaataaaggcatttgcttggggttgtacggaataatggaactcttaagtgagaagtcgaaatagcaaacaccgctggctgccaacagcacactgtgccattaacctttcatatgaagtcattggaagataactgaattatatttccttgggcggatttttttttaagaaggtaagtggcagcagggatctatttttattaaaaaggcttgagaagtgcagtgaaatggctgtgtgtttgcaatcacgtcttccctgttatttgacaaggcctgaataattggaggcagaagaatcagtagttctgcctcgttgctg

SEQ ID NO: 130851 - DNA, 1062 bp, Homo sapiens
tatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttataagaaaaatgattcttcttcagaaattaaaaacataactattgccagatttagctctggaatgtttagaatcaggctagaatagcattttccaaagaatattctaagagctattagctcctctagatatttttttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttatggactgagaaagggagaacatggtagggattattgaatcatttcaaatttataccagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgt

SEQ ID NO: 130852 - DNA, 1008 bp, Homo sapiens
aatctctcttccattttatttttgttagaccaaactatttttttcaaaatatatttttttcaaaatatttgcctgactttagtaacgtgtccctctccccctcactcacccgcattcacacacacacacacacactttcccccagacacttccccttttcggttgtttacgcacgaaaccagccagccctttccctagcgaagtgtttggcggtgtagctgtcccgtccccggcgcttcccacagcaacagcgcgttctcttcgcctcccgcagtctctcaggacaggccaggctagcgcaaagtaccgtgttcctggaacaccacgagggcgagctcgggaatctcgagccggcctgcaggacacctgccgcaccaagtggctagagcccggggagggcgaggcgaggtgggacgaggcggggtggtgagcgggccgggaaggcgaggccgcgcggactctgggatagctcctcaggagtgggcgcccggagtgggcgagcggaggaggcggggccgatgaggtgaggtggggccagctggagtaggctaagcagtccagagcagggggcgtccctcagtggaaagccgggcgactgggcggtgcaacagagtaaggcggggccagcggaagcagggagatttccttaggccgcaggcggggaaatggggctggccggggtaggcggagccccgaggcaggggaggcgtggctggcagaggtaggcggtgccccaaggcaggcggggcttgccgagacagggataatcccttaggccacaggctgggaggcagggcaggccgaggcggggaggatcccttaggccgcagtaggggaggcgggtcggccgaggcggggagaaacccttaggccgcaggcggggaggcggggctggccgaagttaggcggagccccgaggcgggggaggcggggccgggccggcgcagggagagtcactcaatggacaggcgagaaagcaggaccggcgcggcggggcggggccggccg

SEQ ID NO: 130853 - DNA, 1133 bp, Homo sapiens
aacaatgtatctgcttgattttcccttctactctgtaagttcctttagtgtaggaactctgtctcaattacctttttctctccagtgcctggtagaatgttaaatttattgaatggattcaaatgaccaacttcaatccaatttaggaacatactattgtaatctgttgtttttatctcacctggaactctgcacctttgaaatgttgtcttattatccaactctatgacccaaaactcctgtccttccaatgctctcacacttacgagtaaaagaaagttgtctcacttcttttcttctgcatttagcctagacatagcaacttattctgaaacagttaagagggaaaatgttctttgtactgaactcgaaattttttagaaaaaatctatattgcttgttgattcttttgcaaaaactgctttacttactattaatgtgacgggttgctaagtatggctttcaggttgtcacagctggatcagatcaatggctgagccaatcagttctgaaccacattactagaaacccccagttggatctcatgagaatcatgatcttgacatgtccaaaacaactcactattttcctactaagacttcatgggcaaaaggcactgctaactgcctagtctctggattagaaacttgtagtcattgctgggcgcagtggctcacgcctgtaatcccaccactttgggaggctgaggcaggcagatcacctgaggctgagaattcgagaccagcatgaccaacatggagaaactagtctctactaaaaatacaaaaattagccaggcatggtggcgcatgcctgtaatcccagctacttgagaggctgaggcaggacaatcgcttgaactcaggaggcggaggttgcagtgagccgagatcgtgccattatactccagcctgggcaacaagaacgaaactctatctcaaaaaaaacaaacaaacaaaaaaaaaaaacttgtagtcatcctagaatcctccctctaccctacactccatatccaaccactgatcaagtcatcttgagtacatttacttaactcacatgcacggattcttcttgcattccccaccaccactgccttatttcaagcttgctttatcctgtactgggcctattcc

SEQ ID NO: 130854 - DNA, 2680 bp, Homo sapiens
gccttctactgaaagaaaaatttgctagtgactcaatcttagaaaaaagaaaatctccttctataaagacctcaaaatttcctgtcaacagctttagtttgtgaaccttaaactcttattgaaaatctatgtttagggtgtaagcagtttatcatggtatcttcctcccccttacccttctcctctttttgggaagtcatccttcacatattgtttggtttcatcctgatgcatctagaggacataagaatggggtttctgaaacagttctcccatgaattaattagtcctgcaacttatagggtttccagagttattgggtaaactacagtttatttccctcttggagtgttataattcactagtaaaagtatttctcttccaacttcttagagatccagcagtgaggtcatctaccctggttaaccacattcatccttggagaaacactttatattaagcttgtttcttatctatgaaatgagtggtttagatcaacttcatctctagagtacctgttttctatttcttttcagattttatagatcctgatacttaactttttttttttttttctgtccctttatatagaattctagatgagctttcccatacaactgtgcttcaggaaatcttaagtttgtttaggtttcctagtcattctaggaaattggatatacttcattgttgtgcattataaaatgattagattaaaaaaaaagcttttccttaagagagacagacactgaagaatgatgcgtatgtatgaagggatggattgatgaggaatgttacatgttcagcaaactatttcagggaggcatatccttggttaagttaaaaagtgtaagttcacatttactgagcatcatttacactgtgttgcacaaagttttattacagaggtatgataaaacttagtgttaatatggcttattgcatgaattttgatgcatagatagatgttccccaataattactattataaaatgattctgtatcacaatgtagcagtaaatactttttttgctttattattttattatttgcattattttgctccttaatgcaaaataactttttaagataacctgtgtgagttttgaacctaagaccgtatcttttgtttggcagccttttttccactaatagacactttatggaattagctgcaagaaaggctcttagaaaccatttagtccaacagcctcatgttacagatgaaaatactgaggctctgtgacagaaagtcacctttttttcctctactaactctagacttactcctttggggaaaaaaaacaaaaacaaaaacctgtcttgaggtatgaatgatccctttcctttttagtacaagaaaatatatttaaaatccagttcaaaataatatctccttttaggttattaacataacaatagggctttgtgtatatactgccagagttaagagttaaatattaacctgttaaattcctgttcaggtttacttttggacatcaagcccatcactgccagccagtgaagaaggattccagcctatgccctcaatcacaataagaccaccagatgaccaacatcttcctactgcaaatacttgcatttctcgactttacgtcccactctattcctctaaacagattctcaaacagaaattgttactcgccattaagaccaagaattttggttttgtgtagagtataaaaagtgtgtattgctgtgtaatattactagcaaattttgtagatttttttccatttgtctataaaagtttatggaagttaatgctgtcatacccccctggtggtaccttaaagagataaaatgcagacattccttgctgagtttatagcttaaaggcctaaggagcactagcaacatttggctatattggtttgctagtcaccaacttctgggtctaaccccagccaaagatgacagcagaacaacataatttacactgtgatttatctttttgctgagggggaaaaaatgtaaatgttctgaaaattcactgctgcctttgtggaaactgtttcagcaaaggttcttgtatagagggaatagggaatttcaaaataaaaaattaagtatgttctgtgttttcattttaactttttttatggtgtttaatttgtggttggctgcaactgtgtatcatgtatatggaacttgtaaaaaagttctcgacattcagatcttaagagatgaaatcacttttacctataaaaaccacttttattgcggtttgactgcattgagctctaggatattaaatgatatcactaatattttgcatgtaatttgctcatttgagtgagggcactttttttgtacatatgatggggccaatgcacaatacttttatcacaatcaactttttctttgtatccctatttcaatgagcagtcagtctcaagaggttactgcacttcagttctaactagacatttgtactaaggtatttcagttatgtaaactcagcctgggcactttctgataactgtaaaatgttttataagatcatgattattgaagatacattttggaaaattttaaatgttcgtgagcagcttaactacttttgtatctagccttttttaagtatcttgttacatttacttttttaaataaagaaattacagaagaaatgtcaagtaatattgaagaaacaatagttttt

SEQ ID NO: 130855 - DNA, 1057 bp, Homo sapiens
ataagaatttgtctcatttacaaaccaaaaatttaggaaggaaaacagtatccaaataaactgcctaagatcttgccactccaagtatgatcctcagatcagtagcattggcatcatctgaaagcgttttagacaggcagaatctctggtctcccctctctgcattccccacccagtgaatgaatgagaatctgcatttcttgagatcataagaatactgacatacagatgagataaaactcatgtgaatatcagttttaaggctggtggttcatttgttttggtcatattgagtcaggattgactaatgaactgtagaggttttgcattatgcaaatgctcttaatttcttgtattaggaattagacgctcccccccaagtcttaaataatgttttaatctgtatccttttattataagaagattagtaatattctacagataataacaacaactggtatagtatattttatttacattcttcattcttaggagaaaatgctgagaagcttctgcagttcaagcgttggttctggtcaatagtagagaagatgagcatgacagaacgacaagatcttgtaagttaaaaatttcacaagatttgtagaaggaaatacagaagttaaaaataccatgtatgatggccttttaagtttgtaatggttggtcattttaattttgggtagggcaattatagaaggtcacaaataaggcagtttttgtttttctgctctataacaatatctgaagtattactaaagctctaagcagagtgaagtacatttagctgttaatatgctgtccttagtcccagaagataccagtttactgttgcaacatggctttttatctttatcgcactgcctacatatgcttctccctgtatacatccttaatccttttgactagtgccaagccttgacagaatttctgagtattatcttgattgttatctgcatactaggaagagagtagcttaattgtgatatgtgggtactaagtctttcaaaatcttattagtacagagccccagctaacttagaattataaattagat

SEQ ID NO: 130856 - DNA, 1653 bp, Homo sapiens
ccaggcagtctgatacagcatggttcattgctccagacattcaaaacagccttaccagttagtaatgttggaatattgcaaaaaccaagttctcagacaccagccaatgccagccctactagtcaggcccttgtaaagagtaacatcaatcctactatgttaatgtcttccccatccagggtaaaaaaaaatatttttttttttaagacagtgtcttgctctgtcaccaggctggagtgcagtggcacaaccttggctcagtgcaacctccgcctcctgggttcaagtgattctcctgtctcagcctcctgagtagctgggactataggcgcgcgccagcatgcccagctaatttttgtatttttggtagagacggggtcttgatctcatgatctgcccaccttggcctcccaaagtgctgggattacaggcatgagccaccacacccagcctgtaaaatgtttatatagctttatgactgatggtgttgagtgtttctgatccctgtgctacaataattgtgcaggctttggagtcatactgttagagttgaaatcatggctctaccaccctctagctgtatgatgttaccaagttaagttttttgtgccttggttccctcctctgcaaaatgaggataagattaaattgaattaggtaaggtactaagacaattcctggcacatcataatttctcagtaagcatctagcttttgagtttgtgtctgggaggtttgttgttgtcaatttatctttcctgagatactgacagggtagcactttttaaagattgaagctattcttaatgactagcctgtttgttattaacaaaacttttaaaattgttaaatcactgggatataatactacttcactattgaacccatagcttattcactatgccttccctccccacttcctgcctttctctcttttgaatcctaagaaataaaaaatacaggactgaattttttttgctatctggcataaaatgggaactagcattgttagagaaggctgctaaaattatgtcttgtgctttaataatataaataaatgttacatggaaaatgaagtattattgtttctgaaattctctaggcaatgaggaaaggtctactagatgtgcttccaaaaaattcattagaagatttaacggcagaagattttaggcttttggtaaatggctgcggtgaagtcaatgtgcaaatgctgatcagttttacctctttcaatgatgaatcaggtaggacatttaaaaaaaatgtttaaagaatgaactatatagataggtcagtcagcattttctgagtttctagttcttaaggcctgtttatagggtttgggaaattgctgtattactcaagcattaaaacaattttttacattgtttttaaaggtatgtttgaagtaaatagtattttgatggcttagcattaggctattcttaactcttttactgcttaatttttctaggtttcaaaaaatatgaatacaaacaaaaatttttcatggtgagcaactgtgtaaaaaaggatttgtatatagtggttaagaaaaagtaatccatgtgacaactctctgggcttttctgattcatgttgcttaaactccctaatgaaagaatttgtatgatgattgctctatagagct

SEQ ID NO: 130857 - DNA, 1754 bp, Homo sapiens
gagtcccgctccattgcccgtgctggaatgcagtggtgtgatcttggctcactgtaaacctccatctcccaggttcaagtgattctcctgtgtcagcctcccaagtagctgggactgcaggcgcatacaaccatgcccggctaatttttgtatttttagtagagatggagtttcaccatattggccaggcttttctcaaactcctgacctcaagtgattcccccagctcggcctctgtgtgagtcaccacatccagccaatggctttgaggatttatgttatagttttttccggaggtacatgtcacacatctgataaataagcatgttaaagctgtagcctcctaataattctctttaatcagacctactgatgaataattttctattagtacaagaatatcatattatgattttttctttttaactctgaccctattaaattcttaaagtgttccagctaaaatgttcttatttaaagaactagactcaaagcttggcaacataaaattgttgatatattgagtcttcagcagggtttaggaaacagctaattaaatagacccaagtttaacccaataaagtgaccttggggcaagttactaaatttccttgagtgtcagatttatcatctggatttaataatctatattttatgttactatcaagaattaataagatgtatattaagttcagagccggctgctccccataattggtgtttaataagtagtgcaaagttttgcagttttggaactttaaaactattatgcttttggctttatattttttcaaaatataacccttcttatactttgaaaagcaaatattgtcagagccaaagatttattaaacttatctctttaaatagttatatacccagtgggaaattattctatatcaatgtatcttcaaattagataaaattctttatcagattttaatttactaattaattgaatgaagatgctgtttctttcataactgagtttcatatgattacttttttaggtcaattggcatgattttgctttttttgatcctgtaatgtatgagagtttgcggcaactaatcctcgcgtctcagagttcagatgctgatgctgttttctcagcaatggatttggcatttgcaattgacctgtgtaaagaagaaggtggaggacaggtaaagcaaatatacacttttctgattctggcaagagaatttggttaaactgctgtgcttgtcttatgtatagacagtttagttagggaatgaaagagatgaacgtgtgtgtacacataggagagatggatactgtcggtgttaaagatggatcaagagttagtgagacagactgaggtagaagggcttgtactttttgtgtgtgtgtgtgtgtgagatggagtcttgctctgtcgccaggctggagtgtagtggcacaatctcagctcactgcaacctcttgactccctggttcaagcgattctcctgcctcagcctccccagtagctgggattacaggtacgcgccaccacgcccacctaatttttgtatttttagtagagatggggtttcaccatgttggccaggatggtctcgatctcctgacctcatgatccacccaccttggcctcccaaagtgttgggattacaggcgtgagccactgcgcctggcggcttgtcctttttttggcctaaaatgtttccatctcttagattctggtcaaataaataattgtgtttatatttaaaaattttaggaactagttt

SEQ ID NO: 130858 - DNA, 1738 bp, Homo sapiens
ccagatacattataatcaaacttctgtaaaataaagaaatgttattgaaagcagccaaagaatggttctttacctatagggaaacagtgatttgaaagagtggatttctcactataaagtatgaaagccaaaagtcaacaaactcatcaaagtgatgacagaattctgtatccagtgaaaagaattttcaggcaataaagtgaaagaagcttatccgagtttcattaaatgactttattttaacaacagagacgttaaagacctaataatacacaagctttgtgtgtcacattctgaaagggcaaattaaaagttcatttacctttaatattgttatacacatatatttaaatatttatgttgctcttcctacctgacttcatttgaatgatttgagagaaccatttcatatgttttgttttttcagtgaatcttggggcttactctctgatattctctgttagcaggaaaaccgaaagcgccatggctctagtcgaagtgtagtagatatggatttagatgatacagatgatggtgatgacaatgcccctttgttttaccaacctgggaaaagaggattttatactccaaggcctggcaagaacacagaagcaaggttgaattgtttcagaaacattggcaggtaaaagaactttaatcttgggtttgaattttttaaaacatttcaatttatgagattttctaaaatatatttgttttaaaatgtatgtacgctgggtgcggtggctcacacctgtaatctcagcactttgggagactgaactgggaggatcacttgagcccaggagttggagacctgcctgggcaacatggcgaaaccctgtctttactaaaaataaaaaaatactagcgggcattgtgctgcaatgcctgtagtcccagctacttgggaggctggcgtaggaggatgacctgactgtggcactgcacttcagcctgggttgacagagtgagaccctgtctcaaaaacaaaacattctcaggctggtgttcctgtttttttttgttttgttttgttttttgaaaaagtgtatgtgctgtactttatgctgaatagaaaggaggctgtagagaatttctcaaaatattaatacgtattatgtgtggggggatatatgtattctagaattatttaaatcttatttctctgtgtttgtttttaggattcttggactatgtctgttacagaatgaactatgtcctatcacattgaatagacatgtaattaaagtattgcttggtagaaaagtaagtgattttgatgaacctaattgtattcacaattgcaaaaattttcttttataaaataatcaaacgctagcatactgtttataacattcatttactattaaatcttaaagcattacagccattataaataactttaaaacatttaattatacaattatggtcaacaaaaataaaattaataaattaatgacagaaaaagactatggggagatggcatagcagagtagataacacaagtggggctggggggtctgacagacctacgtcctgttgcaaacaaatatgctgacatttctgccatgtttccccatttataaattggtaagaaacacaacatcgtaagtacctggcaaatagtaagtgattggtaaattgtatccactattattagttgtacctggtgttagagaaggtagtggtattgaaaagagccttccaggccaggcacggtggcttatgcctgaca

SEQ ID NO: 130859 - DNA, 1390 bp, Homo sapiens
gaacaatgtacatttttggtgaaaagatttttgtgagtatatgttaagagttgcgtatttagtcatgttttctgttgaatgcaaccaatgtacaatattgacagctttcacctggctttctggagtaaacagtgaatttattggtgttctagaatcattaaattcgctagagaatttgctagtgaatttggattgctttctgaacatttttctgttcttctgtagtgctccctctgagcattgtagaagtgttccagcacccctatgaagaccacattcattttgtcagggagcctttagtccactatcttgaatcatacatgaaggatctagtgatacacttttttaaagatttgtattaccaacttctctgctcatactgcattagtactagcaggtgcattggatatttattgactccaaaacttgaatgtattttgtaagtaagtccttttaaatttaaattatacgctaaattctagaagtctccgttatctggaatgtgaaaggctttttgtttttagggaaaatggagctgatagtatcctggatcttggattagtagactcctcagaaaaggtacaggtaaggaacattttattcatgtgctgataatcacagaatttaaattacaaggaaatttcaataaaggggatgaaagcaggatttctgaagaaactgtctttataaataaaatgaatgtttacagtagagagacagaagcaaagataaatatatcggtattatgcatagaatcaaataataagcttggcttaattagggctcagtataatcccacccattggttggcatccatttgagcacagcttgaattaagctttactttgaataagtaacaaattgaagaacagagagggaaagatgtatagaatcctaggactaattcaccaggtgtggtggctcacgcctgtaatcccagccctttgggagaccgaggtgggcagatcacgagatcaggagttctaggactcctgggactcattcttcaaagaagtagctggtgccaacattgcaaaaacaagtgacatatcatgctatagcataaggaagcctttttagttggcattgaaacaattgcacatagaaggtgagacttccaatttgaacctaagtaggttgattgcctactaaattcatattaatttactaagactcagagttttcacaactaattcacaatgcccaggatacactctaaaattactcagcctacaaagaaccaggaaaaactggatccacctctctcaggaaaagaaccaatagatggcaaccacgagatgacccacttgttggaattatcaaagactatcccatgttctgcaagataatggtgaacactggtgaatggaaagacagaggttctcagcag

SEQ ID NO: 130860 - DNA, 1003 bp, Homo sapiens
ttaaacataggtatatttttctctaccctacccccttctttttttctaccctaaataaaagatatttctggctctctgatgaagaaaaaaatatggaaattgagtatatgtatgtttaactcagagatataaaaaaacctaaaaagaaaacttgtcatacaaatattataagtagccttaacaagatgtggtactgcatggactgtttattccctgccaagtttctctataattgatcttccagtttcataaaagaccttactggttctgaaattttgtatttgttacccaagtttcttattttattttttttttaaataaaagattgtagatgtaattagacaagaggttttagagagtagtcaagtaacatttgttcatcatttacaggcatttgcaagtaaaatcactggcatgttgttggaattatccccagctcagctgcttctccttctagcaagtgaggattctctgagagcaagagtggatgaggccatggaactcattattgcacatggacggtaatgtgtacaattgggaaggcatttcagtttaaacatcagctacttactttcagtatgtgggtgccatcatatcttaaaatttatgtcataaagtataagactttaaatgcatttttatttattttttaaatgatagcttaaattccatgaatgagacagcttagtttcttctcatgtattagaaaggtagggttttaatagttaccaaggttatttggaaattacttgaaagaaagtacatctcaaattcacttatcagaataccctcctggcaaaggccatacatattatactgtgttcttgccataaccatgacatttcttttaggcttcctgatttgtcttaaaaattcatggaagtttttgctttctattctgtaaagtatgaatttaatataaaatctaaaaaatatctaacagattacatatccctttttccaaggtgacaagtaaaagtgacttaggaagataaggccgggt

SEQ ID NO: 130861 - DNA, 1329 bp, Homo sapiens
ggaaactgggaagtcttaacatttccaaactatctgttttgtacacttataggaaaccatactctggcttgggcttaggaatttaaaaataataataggtaatattctggtggcctttaatgctttcatgccaaaaactaagaacagaggatatttaaatgagtctagtcatgtaagaaatttcagcgttatttatagtgacactatcataaccttacttgctatatattatttcacagctttgacatgacaagggagaaaattgattaacaaatattgagtgaacatctatttcgtgccaggtatattctacacaatcacctccaaccctgaaaacccatagggagagaaaggcattaacaacacagatgctagggaaggataatctttagctgtcatgttttcttacatttgtctcatttctttgcattgactttgaaatttaaggtagttgaatttgcattcatctaaatacagtatatttctgattttcttctaggtttaatgcagagattaaggaaccgaggagagagagaccgggaaagggagagagaaagggaaatgaggaggagtagtggtttgcgagcaggttctcggagggaccgggataggtaaattttgtatctttgattcaataccacctttttggatgaattagagataggcctgtaaatgaaagaatcttaattatggattattttttagaaaagtaaagttttaattttgaacatatgtatagtaactaagaatagtctgttaataaaatacaataactaagaatagtctattaactaataaaaagttctgctttaaaaacccagaggcggttgaaattatattctttttatctgactcaagttcctatttgaatttttttacccatatcattctctcctaagtttatcttaaaaagtcttcatttttcaggccacatgcggtggctcacgcctgtaattccagcactttgggaggccgaggtgggtggatcatctgagttcaggagttcaagaccagcctgaccaacatggtgaaactctgtctttcctaaaaacaaaaaattagccaggtgtggtggcgcatgcctgtaatcccagctacttgggaggctgaggcaggagaatcctttgagcctgggagacagaggttgcagtgagccgagattatgccattgcattgcattccagcctgggaaacgagcaaaattctgtctggcaaaaaaaaatttaattttggcagattgtgctatttagaatctttgaagttttctcttgttaagatggattgcattttacttttgactaaaatttccagaattatgtgtggactctt

SEQ ID NO: 130862 - DNA, 1020 bp, Homo sapiens
ttggctttctctcagatttcagaggctttttatgtagctgtaggtgatagacacactcattaattaatatgtatctttgtgacaaaaggtgcaaacaatttttccagtttggttagtccccctccagcctcccgcccacttagcttgtcatcaaggaatctgttttttttctagtattttttttttaacatctctgatcatttggtattttggtgtatcccaaaattgaacaagattattgttttccaatagacctttgaaagaaagtgttagaattgaattaaattctgttgtcctgatttaatttgcaagacattcttgtatgctttaaagtattgtattttgtaatggataagcttctgagaactccaattactttgttgttttttaaactctcaaggaaaggctaaaactagattttcagattgtacatagaaaaattcaagctactttccaacattgaatttactactttttgacttcttgatgtgttttaataggttgatcgggatcgagatcttctcattcagcagactatgaggcagcttaacaatcactttggtcgaagatgtgctactacaccaatggctgtacacagagtaaaagtcacatttaaggatgagccaggagagggcagtggtgtagcacgaagtttttatacagccattgcacaagcatttttatcaaatgaaaaattgccaaatctagagtgtatccaaaatgccaacaaaggcacccacacaagtaagtactctacaaataacaagcagcttaaaattctttccttgttcctcaaaccaacagtggtaatcatggtttctatatgtgtgagtgcataaatttgcatttttacatacttttattctagattgatttaatcttgtttaaactattctaatggacaacaatttgctattctacggacacatttattttgataaatgtttgtgattgtactagtttttcatctcaattgttacatgttgtgggtgggtaagaggttgtaaaatacatagtgat

SEQ ID NO: 130863 - DNA, 1069 bp, Homo sapiens
taaaatgaaagacgaagataagacatagcccagggatttatccgtatgtagaatacagaaggaataagggaggaaaaataataagttgtcgggaacaagtagctatggaaaagttctctgttaggacacagtttgaagaagttaagacctcagaatattttttaaaaaaagtaagttactaccattgaacaaaaaccaatcagtctttgaaattggctaaattatttctcccccccaccccttcccttaaacttcttacaggccacagtgtagctttatgggaatggttatttcccatgatatgctgctaggacgttggcgcctttctttagaactgttcggcagggtattcatggaagatgttggagcagaacctggatcagtatgtattttgtgcaccttaaattccattctgcctgataagcatgtatttcagggaataatctgtcatgcatttttttttttttaagatcctaactgaattgggtggttttgaggtaaaagaatcaaaattccgcagagaaatggaaaaactgagaaaccagcagtcaagagatttgtcactagaggtaaaggtatttagattttcttatactatacctgtagtatgctatttatataaattttaaaacatgcaaaataacaatagctttgcttagggatatgtacttataattaaaaatttaaagaaaataaaaagaaatgttaactaccaaatttattttttcgtgtgtgtgtgtgtgtgtgtgtgtggtttctttttatttttttcttattgtaaccaccaaatttagaatagtagttttctctggcagtttggttccctagcatcctctatgaatttttttgttttagtttttaagtatcattatgcatgcattgatttaaactttttttgatgtatttaattccattgagattattattcatattgatgctcagattgtgtcttctttggctaatgggagtcttgagtcagttttgattcctgagttcttttgacatggccccaataatttttgataaactttcttactttctggtatgtttcatcttgggtatttcctgt

SEQ ID NO: 130864 - DNA, 1080 bp, Homo sapiens
gtgggtaaggctggttgtgctggcttatgcctgtaatcccagcgctttgggaggctgaggtgggtggatcacttgaggtcaggagttcaagaccatactggccaacatagccaaaccccatctctactaaaattacaaaaaattagctggacgtggtggcgggcgcctgtaatcccagccactcgggaggctgaggcaggagaatcacttgaacccaggagatggaggttgcagtgagccaagaccacgccactacactccagcctgggcaacagagcaagactccgtctaaaaaaaaaaaaaaagtagttatctgaggttggtttggtaatgcgttggaattggtggtcagccagggccatcagacaaaaggaccattgaagctccagaaagggaaaaaaaacttgcgtatgattcctgtattactaagttgaggacaaaatctaattagtttttttcccttcatttgtaacttttaaatgtaaatattcataggttcttccaacaaaaatgtcttatgctgccaatctgaaaaatgtaatgaacatgcaaaaccggcaaaaaaaagaaggggaagaacagcccgtgctgccagaagaaactgagagttcaaaaccagggccatctgctcatgatcttgctgcacaattaaaaagtagcttactagcagaaataggacttactgaaagtgaagggccacctctcacatctttcaggtatttgctaagaccctttgtttttattgttcagtacagcgttaaaaatatatatccatgtctagttaccatttatagacttgctattagcagctcagctaaggggaaactgaataactagaaagagtagaactttctagatttgtgattcacacttatctgtgctccttttccaagtttgtaattctcttacaagaggtaggttctttgtttatctaacaaatatttgttagtatatactgtggctcagtatgatttgttgactctgttttttggttacatggcataataatttttttgcttagatgggagttaaaaagctagtttgaaaataagatacactgtatatacgttgtctaataac

SEQ ID NO: 130865 - DNA, 3461 bp, Homo sapiens
gacagggtttcaccatgttgcccaggatatctgtgttttctttagttgcttgtgcttttggtgtcattttaatgaagtgattctcaaagtatggtccctagaacaacaccatcaacctcacctaagagctatttagaaatgcaaatcctggggctttaccccagacctactaaaactctggggattagaccagaggtctgttttaataagccctccaggtgactttgatggaccctgaagtttgagaatcactgtcttcagggaaagaattcattttgccattccaaaggatactggaattccttttctatacaaagtataaggctgtaaatcatgcacagtggttatatttctaaagctgagcagcaggcttaactactttgtatttatgaatattctcagctcctaattttgcatatttatgatagtgaatttcacatttgtattcttctaataaacattttcctttctgttcttatagacgtgccaccttgcttagcgcccgtcaaggaatgatgtctgcacgaggagacttcctaaattatgctctgtctctaatgcggtctcataatgatgagcattctgatgttcttccagttttggatgtttgctcattgaagcatgtggcatatgtttttcaagcacttatatactggattaaggcaatgaatcagcagacaacattggatacacctcaactagaacgcaaaaggtatccattcttgccatgaggttgatttaagaaatacttgcttggtatggtcttctttagtacattgtcaacatttggagtaaggagaatagcattgcaaaagagaactagcacaggaccatttcatataggaaagtgggcttgaatttatccaacctttccccattgccactcttcacttaaaataggaaacctaagaatctggttaaacttcatgcttgagatagtttggcctggcctgattatcatctttattttttccttttttttttttttttttaaagagacagagtctgactctgtcacccaggctggaatgtgatggtgcgatcaaagctcactgcaaccttgaattcacgggctcaagtaatcttcctgccttagccttctaagtatataggacttacaggcgtgtgctaccatgcctggctaatttcttaatgttttggagagacagtgtctcatgatgttccccaggctggccttcaactcctggcctaagtgatccccctgccttagtctcccaaagtgttgggattacaggcatgagttaccatgctcagcccatgttttctgttagagtttgtgtaggtgctcgttatttcttaggtgatttgctttttcttctgttgagtccattttgtaataatagtacctaaacctgttcactctaccatttcccagattctgaaaatgtttgaaattggttagatacattagcgacctttttagtgtgtttttgcttgtatttcctctgacttttgctcctgttcatattatacaaatacttcaagtaaaatgactcacttgtctttttaaaggacgcgagaactcttggaactgggtattgataatgaagattcagaacatgaaaatgatgatgacaccaatcaaagttagtgcacagaaaatctgctaatctacttcaagaaatggctgcctcagtagttccccttcaagctttttaacttcattattttctgtctgggtgggaatttctcttttcttctctatgtctcatttcttacattttctgtccatttttgcttacacattcttgcgttatacatttcacaactaaggatgtattaaagaaatgttataaactttccaacaatattttttcttctatcttttcttgtatttgtcttagtattatgtttacctttactcttaatatactcttattacatttaataaaatcttagcaaaaccgttgttaatattgatgcaaaatagatttaatcaagaaaatgagaattaccagttacagctcccaaatatcagaacgctagcaattaatacaatgaaaagagaaaatatcccaactccagacttttctccaaaagttttaatatcacactttggggtctagtggagtttatttgtgggttgcagttatttcaaatgggactaaataatgcattctccagtttcttattatcaactagtacttttattcagcctatggaaagacagttggcctaattgctgttttttgagaacccagccatagctcactgccgtttatacgcaaacaaggtactgccaaagttttattccattaaggagatttggtgctagtgtgctgacttactattgagatatgtaaattgctcagacattactctgcttagcaaatgctcaggtttcagttcctgatcatctcctctgtttggatttgtcagtgagttgggtcctgagtatactcatgaatctaactgtatttgggtggtgggtatctcaaaagataaagaggaggatatgggaaacctttgtccaatacaaaatggcacaatattattaaatgctgatttttattttgcattttttattgtaacatacacataacgtaaaatttgcacataacataaaacttacattgtaaccatattaaactgttacatttactttaaaaaataccagaattttggactatgaacttgtttttgtgtggcattaaaattttataaaagaggtagtaggaattttggattgagcaggttaaaggtctgttaccctaatccagtaattaaataattttcctaaaaaacaaaacattttatctttttatgtttaggtgctactttgaatgataaggatgatgactctcttcctgcagaaactggccaaaaccatccatttttccgacgttcagactccatgacattccttgggtgtatacccccaaatccatttgaagtgcctctggctgaagccatccccttggctgatcagccacatctgttgcaggtgaattaaacaagttagtcttaaggtttctttctaattgggtttattttctttaaagtattcaatgtaactagaatatttctgttaaaattccagccaaatgctagaaaggaggatctttttggccgtccaagtcagggtctttattcttcatctgccagtagtgggaaatgtttaatggaggttacagtggatagaaactgcctagaggtaagacagtaaaagtttttttgcaatataacatttattaaggacaacttgtcccagcatatagatttttagaaatgcgttaattcagaatattatattttctgaaatgaagtgtcagaaattcctgccttgtggtataatgtaggaagaattccaacactgtcattaacttgctgtcagatcacttcatccataaaataccagcctccatatgtgctttgtctgtttcacagagctgactgctgtatgtggctgaaaatttgaatttttcatgtataataaaaat

SEQ ID NO: 130866 - DNA, 6327 bp, Homo sapiens
taatgaactttgggatctgtgggtataatttttttatttttttgagatggagtcttgctctgttgccaggctggaatgcagtggtgcaatcttgcctcactacaacccccacctcccgggttcaagcaattctcctgcctccgcctcctgagtagctgagactacaggcacgcaccatgcccagctaatttttgtatttttagtagagtcggggtctcaccatgttggccaggatggtcttgatctcttgaccttgtgatccgcccatctccgtctcggcctcccagagtgttggaattacaggtgtgagccaccgtgcccggccaggatataatttttgatagcaaattgtcactaacaaatgaagattttcaaaactgcttgatatatgatttcaaattctctatagttagtggtcttcgcattttagttaactagctttgattgtctacaaataagattctggatttaggttgaggtggtggagggtgtggctggagaagaggatcatcatgatgaacaggaagaacacggggaagaaaatgctgaggcagagggacaacatgatgagcatgatgaagacggtatgcaggttatttgagaaattactcagtatgagtaaatcaggtacttttaaagggagatattaaatacagagagaaacctcatttgaatgtatagtgaaatggtcaaacttattttttgccaagggtttctgtagcatctatttagaaaatttaggcgctatatataatacatatataaaatagtttcccttttttctttttaagtcagtttcttaaaagacttttaaaaactaaaataatcatagtcgcattatgaaacatttggaaattagagaaaaggaaaataaatcacccataattacacccagatgctaatagcttgtatatttactttcagtcctcccctgcactgccctgatgtactagtctgttgactaccataatttccctagccattcttctaaggttgagtagttacttagtcttattttagtagttatcccttctctttcacaccattccccttctccccaactcctaccccctatgccttcttagttcccacccttacgatattctggcttatcagaccctgttttaaaccatagtgagtttgtgcttttttcttatttaaatgtattttttagggagtgatatggagctggacttgttagcagcagctgaaacagaaagtgatagtgaaagtaaccacagcaaccaagataatgctagtgggcgcagaagcgttgtcactgcagcaactgctggttcagaagcaggtatgttgccttatcccaactactttcttgcttatgctaaggctgtgtgtgtgtattcagcgtggattgggtcatactttgtgtgatatacgcaagggtagctaagcatttttataacttcatccttgttctctgggtattagaaaagaaagtattattttaataactctttctccagcttttctggtcattaaataatgaatgaattttaaagtttctttaaaagatttttattttcttgccttttttttttttttttttttttttaaattgggtctcattctgtcaccaggctggatattccagtggtgcagtcagagctctttgcagccttgacctcctgagctcctacctcagccccctgagtagctgggtctactaggtgcaagccaccacatcgggctaatttttttttttaaagagttgggatcttactgtgttgcccaggctggtcttgagctcctgagctcaagcagtcctcccacctcagcctcctcagttgttgggattataggcatgtgccaccacacccagctaaaagttacttattcaggaggctgaggcatacaaatagcttgaacccaggaggcagaggctgcagtgagccgacatggtgccactgcagtcctgcctgagccacagagctgggcttgaaagttattttctaataaaaactattttatggtaggttttgtggattattgaatacaatctggcattctgtttaatatgtatgttttcctgaatgagggggtacattgtaattttaattattaaactcacaatgtttttggttttaaaaataaaaattttaggagcaagcagtgttcctgccttcttttctgaagatgattctcaatcgaatgactcaagtgattctgatagcagtagtagtcagagtgacgacatagaacaggagacctttatgcttgatgagccattagaaagaaccacaaatagctcccatgccaatggtgctgcccaagctccccgttcaatgcagtgggctgtccgcaacacccagcatcagcgagcagccagtacagccccttccagtacatctacaccagcaggcaagtctgaaaacttagtattgctaagaatacttagatagattttttaaattatgcatgttcatctggggataaaattagttttatgatagttcctcattgttttgttgagtttcaaatataaaaaatatgtacatatgattatagcagggtttcccagtctttgcattattgcatctttggactgggtaattgtgggaggctgtcttgtgcattgtgggatgttaggcagcatccctagcctacacccactagatgccagtgaaacccctctcacccttcttcccctccccttggctcccacagttgtgataaccaagaatgtctgtagatactgccaaatgtgtagcccctttggcggggggaggtggcgtgggggtcagatttcccctggttgagaactttatattaattcttgtcccctccatactcctctccccaaaatagtgtggtttaggcaaagttttttgcttgggtaccacaattgaccatttagatttacgtaagtatatataatcccagagaaacacaattagcaactgacattagctcattgtggttgtcctttttccttatagcaagttcagcgggtttgatttatattgatccttcaaacttacgccggagtggtaccatcagtacaagtgctgcagctgcagcagctgctttggaagctagcaacgccagcagttacctaacatctgcaagcagtttagccagggcttacagcattgtcattagacaaatctcggacttgatgggccttattcctaagtataatcacctagtatactctcagattccagcagctgtgaaattgacttaccaagatgcagtaaacttacaggtatgaaaccactgaaaagtttcccattccactatttttttttggctgtcaattatgagaattccagtattaggggaattaaatgttagaaacgtttacatattgacatactgctgctgtatcgaatttagctctatttggatagttttaactattttagtttggtcttcatagaactatgtagaagaaaagcttattcccacttggaactggatggtcagtattatggattctactgaagctcaattacgttatggttctgcattagcatctgctggtgatcctggacatccaaatcatcctcttcacgcttctcagaattcagcgagaagagagaggatgactgcgcgagaagaagctagcttacgaacacttgaaggcagacggtatgaaattcttcatatatacagaacgtccccaacttaaaatggatcctcaacttacaattttttgtttgtttgtttgtttgtttttttgagacggagtctcacactcttacccaggctggagtgcagtggtgccgtctcggctcactgcaagctccgcctcctgggttcatgccattctcctgccccagcctcccgagtagctgggactacaggcacttgccacccacgcccggctaattttttgttttcttagtagagacggggtttcactgtgttagccatggtggtcttgatctcctgaccttgtgatctgcccaccctggcctcccaaagtgctgggattacaggcgtgagccacagcgcccgacccccaacttacattttttttttgactttgtgatgggtttattgggggtattaaatgcgtttagactttatgcgtttatgatgagtttatcaggacataaccacatcttcagtcaaggagtatctatacttgcatgtttagatagaatctttgtatcctagaaggttaaagctttttagttgctattatgtaagacctcatcttactgtgaagggagaaagaaatgacttgcttgcattacttaaattgttgaggcagaataggctagttatcatccaagctgtttttaaaaatccattcatatcgtaggaatctgatactaaagcctttttatttttgaagttattggtctatatctttgtctcattatccccaagacctccccctctcctcttaggaagttattttgactataattggttatgaatgtactttgtactcaggagggggaaagtatgtgtgattaccagtgctgctctttttttctcaaatcacatttctttttttctgcctcccctagtctgttgaattaaaataaaatatatatctatgtatttgttatgttctttctattcagttataaagtgacctttttcaggagtaggtatcagctcaaatattgaacatcagagcaatagcagtaatatagtaaaagtgcctcatacctgaagtcaaaatccaaggatttggttctgtctctacctcaggataaacaactttgttactctgggcagatcataaagtgaggaaagacaaaggtctaagagattacttagaaagacagtgataggcatctacagtagaggtaatagttactaaagtagggcagtgaagaccaaaaggaggggagagaagcattgaaataaaaaacagaatttagggccttgttgagggattaagtagcaggggcatcatttatatttaaaccttgatcctgagtaactaataggaaaattaaagagaaaaacctaagagtagtataatggacaaacttgcttttgaacatgtgagaactgggggaaaaaaaatggtagaaatgtcaaatgtgcagaattgaatgcttggcaaagatagctgtactgaagatagtgatttgagaggtagcagctttcctgtcctaggaacgctgcttcacaaagacgaaagccttatctttgttaggctgtagttgttaccccagagaacacagaattctgatagcggatcttgattggtggcagtgttctctctcccttctctctgtcagctttaatataataattcacatatcacatataattcacccatttaaagtgtccaattccatagtttttcagcccttcatcataatgaattttggaatattttaatcctctctacagaaaacctattagcagtcattcttcattttcccctactcacccccccccccccccgccttccccttcctaagcaactgttaatctgttttccctctcaatagattctggatatttcctgtaaatggaatcatacagtatgtggtcttttgtgactgggttctttaatttagcataatgattttcaggttcatctatatttagcatacatcagtacttcattctttttcatttcctagtaacatttcattgtatgagcgtactatattttgtttatccattcatcagttggacatttgggttgttttcacctttccactattatgcataatgctcatatgaacttttgtgtatagatttttgtgtagatgtgtgttttcagttctcttgaatatatacctagttatggaattgctgggtcatatggtaactctatttgtaactctttgaagaactggcaatactgttttccaaaaaggaagacagtctcagtagcagtgtgtgtatgagagttttagtttttctacatcttcaccagcacttattatctgtcttttgttataaccatcccagtgggtgtgacctagtatctttgatttgcatttccctaatggtcagtgatgttgatcatcttttcatgggctaactggccactcgtatatcttcttaggagaaatgtcttatttggatcctcccgtcgccaccaccccctccatctttttttttttttttttaaatagagtttcactcttgttgtccaggatggagtgcagtggtgtgatcttgggtcactgcaacctctgcctcccgggctcaagtgattctcctgcctcagcctcctgagtagctgggattagaggcacccgccacaatgctaatttttttgtatttttagtagagacggggtttcgccatgttggccaggctggtcttgaaccctgacctcaggtgatccacccaccttggcctcccaaagtactgggatta

SEQ ID NO: 130867 - DNA, 1073 bp, Homo sapiens
tttaaaatcatgcttttgaactgatgttttccccacacacatcagcaagtcattagttaataagctcattcaaaatagaaatcatgtcagatctcttaaaagttagatcacttctattaaacacttgctgttaatggacagatggtgctaccagagtttttagaaatagaactgctggtggaggaggaaaaatcttcctgtagaatttttcgatgggatggactcatacaaataatgtgcatcaacacagatttgaaatgacttaaaaagaaaaaacatattctgagatttatattttctgatatatagattaagtattgttggtttctaagaattctcagctcagatttaaagtcacatcctagcaagtgtctcacatgtaataaatgagttaaataaaaatatgtgttgcatatctgagctgtggcaggagcccactcataagcttctgattctttacagctccagtcagtctcagtcatcctacatcatcaggaatccacagcagaggcgcatcagccagtcacagcccgttcggggcagagatgaagaacaggatgatattgtttcagcagatgtggaagaggtgattttaattgtggtagatttaaaaagcttttattttatgagaaaagaagagtagtcagtagaaattacattaatagtagcttgagactactatatgcgtttgcatccagtttgtagatgtttattatatattctcatttgtggttatacatagtaaaattattttaataatttgtgacttactggatattaggaaattggacacaaacttgtctttaaggattaagggtggagatattctcagtgttaacagcaaagatattctgggtttttttttttttttttggagacagagtctcgctctgtcacccaagctggagtgcagtggcgtgatctcggctcactgcaacctctgcctcccgggttcaagcgattctcctgccacagcctcctgagtagctgggattacaggcgcgcaccaccacacccatctaatttttgtattttttagtagagacggggtttcactatgttggtcaggctgg

SEQ ID NO: 130868 - DNA, 2659 bp, Homo sapiens
ctctatagactcaaacggacatcaccaacagcctactgtgattgttgggagaaatgtaaatgtaaaactcttattgctggacagaaatctgctcgtcttgatctactttatcgcctgctcactgctactaatctggttactctgccaaacagcaggcaagtgggatttttagaacatacagtaagttaaatcaaaagagcgcagcacagctgagtagcttttcagcctccctcctcacgacaacattctgttttgcaggggagagcacctcttactattcttagtacagacagtcgcaaggcagacggtggagcattgtcaatacaggccacctcgaatcagggaagatcgtaaccgaaaaacagccagtcctgaaggtgagttaattagacatttatgacacttgtgggaagcaatatgttttatttttgttttggtcactatttctttttcattttagattcagatatgccagatcatgatttagagcctccaagatttgcccagcttgcattggagcgtgttctacaggactggaatgccttgaaatctatgattatgtttgggtcgcaggagaataaagacccgtacgtattcattaaaacctttttagatttatgtatttcctacgttagtgtagaccttttacagttcattctgtctttcgtttctcctcaagtcttagtgccagcagtagaataggccatcttttgccagaagagcaagtatacctcaatcagcaaagtggcacaattcggctggactgtttcactcattgccttatagttaagtgtacagcagatattttggtaagttctttgaatgtgtattacaagtacatgaaaagtatgtttttcaagtactcttctttgctgtgaaactagaaaagaatttaaaccttaagatccagtgcgaatgaggttatggtaataacacactcagatagggatggggtggcattgcatcgttcctttctctggaaaacataaaactatcagtgccctcagaacctgtcataaataaataatttacgatgtgagaaaaataaaggcatgtcacagaataatgtaaaatttaaaaacagaaaaatatcagcctaatactagtgtaatcttgaatcaaattatagcctgaccacttactggaatatgatgcagcaatttaaaaataaatcgtattgtaaataacgtaaaaaaaaaaaccaaacaaccaaactgtgaaaattgggtgttctctgtagctaacatttatacaagaagctgcacacagaaaagagactagaaagtaataatggttccatgagggagatgggattatgaatttattcatataaatatttgagtctgctttgctgttttggaaagtgccccagactgagtttatgttttcttcttctgatttcatatatttggtattgttcttctaaatattagttgatataccaaggactgtgggacaaaaaataagaaatcgtacatttaggactcactgtatgtcaagcacattggcaggtatatttcataaactgaccttgtaaatgttttggttaaatttgttttgagattttattataaaatgttaatacttaaaaaatgttagaacttataactttatgaatgtctaaacatcttatgaagtatcttaacattaatagagtgaatataattttttaaagcttttagatactctactaggtacactagtgaaagaactccaaaacaaatatacacctggacgtagagaagaagctattgctgtgacaatgaggtttctacgttcagtggcaagagtttttgttattctgagtgtggaaatggcttcatccaaaaagaaaaagtaaggcatcctttttgattttggtttagataccattttcactctgtttttgtgatagtgatttatgtatatgaaaagatagattgctgatatttctctttttgttctagcaactttattccacagccaattggaaaatgcaagcgtgtattccaagcattgctaccttacgctgtggaagaattgtgcaacgtagcagagtcactgattgttcctgtcagaatggggattgctcgtccaactgcaccatttaccctggctagtactagcatagatgccatgcagggcagtgaagaattattttcagtggaaccactaccaccacgaccatcatctgatcagtctagcaggtaaattgctaccaggtaacagattctgattaatccttctctggaaatgtcgtgtttgacttcctaaaacctttgcataagcactcaggtggtgtacatgatcatttgtgtaacataaataacaaccagaaagccggaattttaaatatttttctacaacaactgtattatcaaggacagggctaaaataactccattataaatgtttctaattataagattatttgttcttaagtttcatttatcttttctatttgtttgatagtttccctaattacactgtaagcttgttgaatcaggatgttgagcaacttaaaactttccgatgtcctttagcacactgcttctcaaactttaatatgtatgaaaatgacttggggctcttattaaaatatagatgcccactctagaggtcttgaggtggggcctccaacttcgtatgcctttcaagttctcaggtgatgccaattctg

SEQ ID NO: 130869 - DNA, 1075 bp, Homo sapiens
ttacatggactggagcagagcacattaaccaggtaagttatttctacattttcctgtattaatcatatctttgtgtcttttttcgctatgactatcactagacttacagttttcagctttggaattaagtctgatatgaagaaagttgatttaattcctaagtaaatgaggcaaaagagctgattgctcagttaaatatggcataccatgaaaattggaaattttcactgggtagtataatctgatccacaaatcttgatacagattttataactacaatgcctttttggggatgatacaaattatttttttctactggtaatatttctatttgtatatcataaactgtatatttgctgtagccctttataagttctagttttccaaagcacattaattttgtttgttgagattgaattgttctagaaaataccagaaataattattatgatgagatatatgcatacttataattattcctttaaaagtacactcttaattttaggatatttttgagtgtcgaacttgtggcttgctggagtcactgtgttgttgtacggaatgtgcaagggtttgtcataaaggtcatgattgcaagtgagtacaattctagttttctttagtttaatattataagctgtttagatttatattgctgtatggaaataatctgtactaagtcatgttttacttcagaaagcatgaggttacttacgtttcccttgtttaagtcagtttatgtataatagtgtgattcttgatttaaagtatactgtgaaatgtttggtttctttgctagttcaaacattgccctccttaaataaaagtaggtgattatacattgtaactaggatcagattagtcttttgagaagtatatctacagaatgttcctgagtgtattatgcagcggaggtctcaggtcccctgtagtggggtatactaggagaaaattgccataggcctagagggaatcatggtgaatgtttagactgtgtcttaaactaaatgcaacagtctttcattcagcaacagttaccacagctagttctgttggttttcagagacctgagaag

SEQ ID NO: 130870 - DNA, 3104 bp, Homo sapiens
tactctttatccatttacaagctctaaaattgtggctgagtgaagggatttgccttttgtgctctcttaaatcattgttagttctaaatgtattaattttgtagccgttgtaaggttttattcaaaggtaaagtatagattttcatacagatagttcccatttcccctaacgagttctgtgtttgtgattatttctttttctttttagtgatgtgtacacctgtatagtattttttttttatagcaggaggaaaaaaaccatgcccatacattaacaacacattttataaactctagtttcattcattaatttctttgggatgcaagttgtactgttaaaaatttttttgtgtgtaaaaatctaaattggtctttgttttaaaactaatcattgtgtggatattagttcagatgcttttgagattataaaagggatttagtgttgaacaatactggttttgtgctaatcagtatgattgctgatgtctactattaaacttaattattaccgattataaacgggggatagaaactttttgttttaatgtttagctgttcttttatctgaactgtatgaaagattatttctaatcttacttcaccgcagctttcgttccctgtgcttaagtttgtgtgggagcttaatatagtgattttagtgctgaacggtgtactaggagcccccagttttatttctatccctcactgacttattctgtgattccagaattggcatttgtacttcacttcccttgcctggagtgcttgcttgtaggacatactttcatcttctcagatgagaagttctgtacaccgtttcattatgtgtagatatggtagtgagctctgattttgttcatgttcttttagtttgagattacgggaaatgatgagacgttcgttgagagcagctggtttgggtagacatgaagctggagcttcatccagtgaccaccaggatccagtttcaccccccatagctccccctagttgggttcctgaccctcctgcgatggatcctggtaagagctgttatttaatttcatttagtgtttaacaaaaagagcaggtcatgaaaggaaataattttaacattttaaagggatatttagaaatttgaaatatttgaaagtagtatgatgaatattataactagtttagctataaaaattagatttaagggatttatattttaaaaattaaaattccagaactcttgtcaggtattccacttttactgaaatatttatttctataccagtaagaataatccctttattagtaatatatcaagataagtcaatagatttgcctagtggattccttctcttgtagtttggaaaagaagtttcacttaaactctatccaatttgacctttggcttgcagagaaaagccttaaggccagttaagagaacatgttaggaatatgttgcctataatgatatacatcctactgttctgtttactgaaagatggtgacattgattttatcctggcccccgctgtgggatctcttaccacagcagcaaccggtactggtcaaggaccaagcacctccactattccaggtaagaatctgtactctttgtctgcctagtcatctggaagaaaaaaggacacactttggatatagggttctacagatctacactttatctcaaggagactgttctttgcttgaaaaacatctaattctctgaattacattccatctgtcagtgcaaatatgtggtgtctgtgtacatacatttagaaatcagatgagatttgtaaaatggtgttcataggtttaaattatttgtgatgaagttaatttattactgatactagaatattgttctggtagcttatgcctgatatattattccagaatattcttttaaaaaaaaattgtaactgctccttgcagagcagggctagataccccataggcagtgtaccctattgtctatgtgcttatgtgccccataggcagggtagcccagaatattcttttactgtgtcttcttcattgttgttttgtaccaaatgaatctgcttaattacaggtccttccacagagccatctgtagtagaatccaaggatcgaaaggcgaatgctcattttatattgaaattgttatgtgacagtgtggttctccagccctatctacgagaacttctttctgccaagtaagaggatttgatatatttttcatgtgaagatttagcttagcttagcttttactattaaagtttatcttcttacactatatggacaatagttatgtaaatttaaaacaatttatcagaatccagcatgatattccctctactgctaagctctgttgagtgaaagaggctgtctcaacatcatgtagtgtacactaaatgaatacaaactagcttttatgttagtttgattgaggtgtatatttatatgtgaaagactaaaacaaaatttagttttttgttttatcatgaacatttataatcaggaaggaaaataagtagtaattaatatttttacatataatttttcttattttagggatgcaagagggatgaccccatttatgtcagctgtaagtggccgagcttatcctgctgcaattaccatcttagaaactgctcagaaaattgcaaaaggtaatttatttcagatcctaaatgagttacattcagtttggatagattctcttctgtccatatattataattattcagactggatttctatatatgtaaatgatacaattggttggaaatgatcaagatttgtgtgtgtatgaaattcatgtgtttattattccttcaagtttactgtatcttccaactttccatcaaaaaacagctgatataaatttattgatttaagaataaacactccgtaatgaacagtgtaaaatctttggaaaataagatggattactgatagaacctcttggtagttaattggtgttaagtgatataactttacagaataatagacagatgtcttgttatttctgacagaattcctgctaaatagaaagcattaaggaatatcaattcttaccttccagcctttgaaagattaaagtagttatctttttaaaacactgataaatagtttatgagatg

SEQ ID NO: 130871 - DNA, 4294 bp, Homo sapiens
tattaaaagggttctaattagatagataacatgaagtaaaaaccaaggattggcagactatggcccaaaggccgaatccagccactcctattcatttatgcattgtatgtggctgctttcctgtttcagttgcagagctgagttagttgagaaagctaaaaatatttacttgtccttaacagaaagtttaccctcccttctctattcctgtcgattgtatgttctgcttaaagtgtacccttaagttctgtttcttttggtaggccacctgaaattgtctctactgatttgcaaatctgattatatattattgtgttggccatgagaaatttttaatatatgtaatgtgctactcaaattcattgaggtttttttcccctaatttgtctgagcacagaaacaaaccttaatgcaacacattctgcgctgtgactatgaggcctgtcgacaatatctaatgaatcttgagcaagcggttgttttagagcagaatctacagatgctgcagacattcatcagccacagatgtgatggaaatcgaaatattttgcatgcttgtgtatcagtttgctttccaaccagcaataaagaaactaaagaagaagagggtgagattaagaactatagcaaggtctttaaagggagttttaggcaattttgaaaatgtaacagttgttaaagaaaagcaaatcactataaagaatttgtgtgtccttttttttttttttttactttctcagaaggtaaagatgggtatgtaagaaaaaaaattttgcaccagtgtgtttttattgtgtttaatactatatgatatatacaaactggatatgtaatgctaaatgaactttactgattttataattgcagatgacttattacatgagaattatttagcaggttaagccaagttacattgaggcaacttttatctaaatttttagaatgtagaggagaaaaatcacttagtgaggtgttatatgtttttggaaggtaaataagctttttttgccataaagtttttaattggctaaatgaagggagaaattgaggacaaagtgttaatatgtaattcataatgtgtttttttttttgaatttgctgatgatactctggtagctacatttttgaatagtggtttgcaggtttctgacctttatgtcattatcattgaatcagtaaggattatacatagtacataaactgagactgaagtactggtaagtaggtctttttctattttaataagtgaaagctaaatttcagtcttcttattaatgaccttatttttgcccttcgtggattgagaaggaaggcggaataaggaaataaatcacatgtgaaagatcagatagttcagtctgtctgaagtgttagttgctctaaggaggaaaaattgaacaattggttatctagtatgtgaattagaatactaaatatatagagattagtgtttagtggactatacatactcagtgtattagttctaaaacttaaattgatcttaattttttctcatttttcagaagcggagcgttctgaaagaaatacatttgcagaaaggctttctgctgttgaggccattgcaaatgcaatatcagttgtttcaagtaatggcccaggtaatcgggctggatcatcaagtagccgaaggtaatgtgatttttaccaggaaactttaattggaggaaaaaaccaagtacagaaagcagtatatctcttacctgtcgtgtacatgaattggtgggtccttttttgtttcatttttgttcctcccaataacaccctgggaaaaataatctgataacaaattagagtttaaggtagagctgggacacttaataaatttgaaataatttagacaagtagtttaaatttgtttctttcaatttgttctaaattcatcattcttgcttcctaggaagttagtgtgttatttggagaacaagtagtataataattgaaggaaccttaatcttttcagattgcttatttaggtcagtttctcagatatcttgatctgggaaaaaaatgaaagggtgatgtgtattatggatgtctgatgtttaaattttcaggctgagttttgggatggacaaacttttataacacattaaaaattgctaggtatttgactagataatgaatatgaagaattcaggatatagttttctttctgtaggaaaaaaatttattgtctgcttgacaagatcattaatggaagcactgctcactatgtgctaatgtggcaggttgcaaagtctacttaaaatgaagattctccttgcctattttctgttccatagttaactattcctttaaaaatgtgtattcttaaattggcaacaggaaggctaccaagttgatccaagttgatactttaccaggttcaaaaacatcctgaagtgagatttatcaaaaagtattcatgggtgaccaaattacaatttaaaacagtgcaaaaactttacgtagactaaacaaaatggaaattatcaccagtttatttattcaggactatgctaggcagacaaagtgtttggtctaaagtgggaagcaacttaaattcttcatgaagaaattagtgtctgaattatttcaggtatttcatttcctcagggaaattacaggtgcaaatcaagttggactctgatatggttggtccaatgccagtgctgccatctttttttcatgtcaggattattttgaaggcaaagactaaaaggagcttcaagagtgggtgatgtgttgctcacagaaataatttgcagagtaagctcctttgaggaatttgccgaagatttcactgcagtgctcttaaccagttcaaactcagggctgccggttgaacagatgaaagcacaggagtcttattatccacgccgggcagtaggaagtccacagactgcttcattgaagtgaaaccctcctctagcctccaatggattttctaggcgatgccccttgatgagtatgcaggctgggattcatgagctgtaagctcaaaactgatgcaatttcaatattgaatggaatactgttaaatgccttcagatgatgatttgactcagaagttttattatgtgaactcaatagttcctgagtacaaagggcagatttagtggaaagcttgattgatgcatctgattgcaggtgtatatactctagagattgttaatctggaagacacatgaccttcgcttttttgtcacagtgttatgtttgaacatgactggattctaaggcttctgtagcatggatataacgtgcttacaaagaggaaattacatcatccttgaattcttccatattgtcagaaaatacgatgactccaggcaagcctttacgaagaaatgtcaaaactctgaatcttagcagccaaggtggtatctcctcagtattgtcctcagccactgaggatacaggtgaatcttcatgaattgtgtacaacatcttgaagaataattttctttttttgttttttgttttttgttttttaagaatctatatgaggagctgggcattgtacttaaaaatgttcccaagacctaatgaagaaaagaggttaaggacaattttaaaaatgacaaggaatggccccctcatttaatattgaattgactacatcacagcaacaaagttgggagtttgcaagttcaagatgagactatggtctcaatttatcttcatttattcttaatctgctttaagctagaagttggagaatagcccacataatgttttttgtttggcctgcgcaatgttaaaatttttttttcctttaatttgaatgccttcagataagcatgtgtgcctctagcttgtcactacccccatttcttacacctgactgcccttattttacctttctgacccattagccattgagtttgtgactctggtgtaagcattcttaaaaaggccaaaacatgcatttattttcaggttatttgcagtgtctcccaattattgctgattttttttttctttgtgctttgagtaagacacattaggtaggataccaggtgtctgttgagcttaattaagattgtataggagcatcacagtgtgaacagtcaccatggtgtgtgctgttactggtaaggagtcttccttttcctctgggtgatatctttggacagggaagtgatctggactgaaacagtcactgtgccatgctcccatccacattataaaaactcttaaactcaaatttctaaattggaaaaagaagacattgatactataaaataattaactatagttattttttaatagtgaatactataatggcaaa

SEQ ID NO: 130872 - DNA, 4247 bp, Homo sapiens
tggtcacaacttttgctcaaaatttgtaaatttataaacctagacttactgccacaccatggatagaattttttcaaaaattccttaaaataaattttatggtgttaattgctttgcaatttaggaaattaaaagttagactttaatagttatgtgatagttttcttaaaactatctggcagatcttcctttttaaactctggttagatactataattttgggagtacaaaatacattttacgctatttctttgtacttgtttatactggtgttaatacaattaaacattaatggttacagttgttcttcactgtgaatttatttgaagtacagattgatcagaaaactccaattcataaagcagtagcttaggaaattgttgagaaacttcacttatgtatccctttaaagatagtctttcttataaatttagatgaaatctataaagtctcttttacattttctttttggtacttaccattttgttgttgtctaagaacgacgacggtcaacccctgcaccaaaagaagaggaaaaggtgaatgaagagcagtggtctcttcgggaagtggtttttgtggaagatgtcaagaatgttcctgttggcaaggtttgttcaagatatctaaaacttaattactaacagaattataatgatattggttatccagggatttgtggttgatatctgagtcctttcttcagggctgttttatttatcatcttcagtggtatctttagttgcacccctgcatctgatgcagatctgtcttctcagtcgctgacagatgaagagattatgcctctctttgagcatttgtgatgatatgttgctttttaaaaaaactattatttgggaatagttttagttttgtagaaaagttgcatagagatacgttactttttggtacagcccatttgttggatctcttagttctagttgagatcatcttccatgacatttaaaattcttccagagtactgaaaaaccttattacaagtcaccttccactttttctcctctcttctgttttgccttctaagaaaccatcaatttgagtgccattaatttcactcttctactgacacatatttaaaatgcacttgcagttgtagaatgtctgtaaagtaaaggttttcatgattactcagtagtttctgaaacgtgatagtctttcatttatacttaaaggaaagagcagatataccagtttctgcagcttacaaaggtctttctcatataccgtttcatttgattctcaaaatagacctgtagttcatgggtaggtgttttcttctgagaattagatacgggcttaaaataaaaagcatcaagtagcagaagtgggacccaaatttgtcctggtttcaaattctgtgcttgtctttctgtgcattgctgaccctatccctgtgttgagtgtattgtagccactagctgtatatgtggctgtttaaatttgttaaaatcaaataacttaaaaaagtcagcaccttcgtcacattagcttcatttcaagtgctcagtagccacttatggctaatggctgccgtattggacaccgccaatatagaacgttgccattttcaagaaagttctgtcagaccgaaggctgctttaatttaattaggagatgggaggatttcacgggctatatacttaagtttttcagttgattactgaaaacattcactgactgtaatcactggctgtgtgggtcagttttctctagcaaatgagccttgaatatagatgtcagtagcaaagctcagagtctgtctgggttgattttataacttggtgatcattgaagaaacatacaaagaattggattcctttaacattaaattagttcagtgaatagaatttgtatgttgattttatataagctattgctaatgttcattgaatttgcctatacttccaggtgctaaaagtagatggtgcctatgttgctgtaaaatttccaggaacctccagtaatactaactgtcagaacagctctggtccagatgctgacccttcttctctcctgcaggattgtaggttacttagaattgatgaattgcaggtaagtgtaaagaagttattcagcaagtgaatattggaactgactccgtgagtttattatggagtttgaaagcaaaattccttttgtgtcatgcaggttgtcaaaactggtggaacaccgaaggttcccgactgtttccaaaggactcctaaaaagctttgtatacctgaaaaaacagaaatattagcagtgaatgtagattccaaaggtaaattttgaaacttcttcagctggcatatcctatattccattaatacttgttcaggaaatgggaatatgataaaataattcagggcattggcatttttttgttccctatctgtaacattatggaatggcatgtatctgtttgaattgacttacaagtgtggccagagaagttaaaatattgtagatgtttattagagataagatgtataacaatttttcttctcatttatgtgcttctgaaggtgttcatgctgttctgaagactggaaattgggtacgatactgtatctttgatcttgctacaggaaaagcagaacaggaaaataattttcctacaagcagcattgctttccttggtcagaatgagaggaatgtagccattttcactgctggacaggtagaggctcatttttgcttttgaaaagtgataggacaacaatggcatttttgtgaggttagggggtctggctctggttagcttatcaattattcaaaaacctagaatatttagcacatttgaatactaggtttcttattactattactaaaatctaatttggaaataaatatgcctgtaaaaatcagatacattttttgattaggagtcaaactttaccattttcccattattataggaatctcccattattcttcgagatggaaatggtaccatctacccaatggccaaagattgcatgggaggaataagggatcccgattggctggatcttccacctattagtagtcttggaatgggtgtgcattctttaataaatcttcctgccaattcaacaatcaaaaagaaagctgctgttatcatcatggctgtagaggtaatttgagtattgaaactactgggcattttaattcacaaaacaccactaaatagtcttgaatagatcttgcaacaatcttaaatagatcattcattgcccctttcttccctaaaagagctaatggtctattaaaactacatagacaagtacatcagtgattatcgtgtaatttaagtgtttgagcaaggcatgcataatgttgtaggagcacaaaggggagagatataaatcatactgtgactgtaccaaagacttctttaagaagcgatacccggacagatcagataggccccttagacacagggatggagttgggaggtattatcccaggcaccaagagcaacctttgtgaatcttattaataagttgggagaaagtacttttttttgatatgaccagaattctggtagggatcctgtgggtcagtgagtagcaactgaaaaggctggagaggggcactagggtgtttgtgtgttcacctaacgctacctaaacttcagcctgaaagcgaggaggaggaggaggattataagccagtgaatgacgtgcttttgattttttaaaaaagatcagcagtggctggtgggtgtttagagagcagctgatagatatcagaagtttagagatcagataaaaaggttaatgtaggctgggcgtggtggctcacgcttgtaatcccggtactttgggaggcagagtgtggggtggatcacttgaagtcaggagtttgaagccagcctggccaacatggtgaaaccctatctctactgaaaatacaaaaattagcccggcatggtggcgcacgcctgtaatcccagctactcaggaggctgaggcacaagaatcacttgaaccccggaggcggaggttgcagtgagccgagatcgcgccactgaactccagcccgggcaacagagcgtgactccgtctcaaaacaaacaaacaaacaaacaaaaaacattttaaaaaaagggaaaaagtcaggcaataatccaggttagaaacaaagtaaatgtcaacttttggaaatgaggaaggaggggatggatttaagagatcttaagaaactagaacctgtaaagcttggtaactggattttagcagtgaatgaaagaattaataaagctt

SEQ ID NO: 130873 - DNA, 1051 bp, Homo sapiens
gtacatacagatttttaaggttccaaaattgtttagtttgctttccatttatactcagatgttatgattataaatttactaagtttactgctgtaattcctcagtgttaaaagtgcaaagttaaatgtgaaaacagtgattactgttaagttaaatgtaatttttaacaaaccaaagctattgcactttatacctcattaaggttttgcttttagttttcgtgttctttctctgtcttggttttttaaaaaagatttatagactttctaattacgttggattttgtactaaaaatagaagtaataaaacattttcattgtcttatgaactttgtaaagaacatttgaaataattttgatgtgtacaaatacaagattagaatagaatatggaatttaaagcctgtaattgatgaagtttttcaagatcttccttgaaatcagccatttcaaatattagcaaaagagctaagtgaaatttaaatgttaagaacatagtctttttcatgtcagtagtaccctcgtttgccagtcattgaaatgcattcactttaaaggtatgctagtgattaatcagtattggcttccccccaccatcacagcatttgtggagcagccaggagtatttgctgtgtacttattgagatcactcatgttaagatcctggtgaaaataataccagttttcttttagattatttctaaactcaggtgaaatttctgatgagagtaataggagacgagggttaagatgatggtccagtttataataggtatataaataacaaatttgtgaataatcagtgacttttctgattaaaaactgatttctaccctttaatatataaaaatatttatgtttgcaccatctgtagaatgctgtttagttgctgtagttattttcttaaacagagtattaaataactcattaaagagggctagttttttaatcctgtcaccagatggtttaagaataaatttttataaaccattgtgagtagagtttcttcttggaactctatgaaattaatggtctaatgggctttttacttac

SEQ ID NO: 130874 - DNA, 1749 bp, Homo sapiens
gtacctctggtcatctaccacatagtaagattgggatattggataaataaaagatatctccagaaaaaatgttcctatctaagatggagatactgttggtatgtttaacagtgctgtcttgaaggccattggttttcggagcatgacctgaggttagtcccctgacagagttttttttttttttttctctgtaagttatttactcctaaacccagttaaacttcagacactaatgtctacatattcttttttaatttaaaagaaaaattattcatggaaccttctggctagcaggaaacagtagtcttctgggataaagaaacatctataaagttatggagcctatcatgaattaagggaaaaagttatttcagattgtaggaaacagacaagaagtgtaattttttttttcacattttactttttaaattataatgccttttagtttcttctctgctgtttctgctctgttttttgtttgtttgtttgtttgtttgtttgtagcagaatggatgggatatttgctgcatgaaaatttaaagttaatgctaaatttttagcaaacatgttgaaattattccttttccttaatattagaaacaaattttcttttctttttcttttttttgagatggagtctcactctgttgcccaggctggagtgcagtggcatgatcttggctcactgcaacctccgcctcccaggtttaagcaattctctgcctcagcctcccaagcagctgggataacaggcgcatgccaccatgcccagctaatttttgtatttttaatagagacggaggtttcaccatcttggccaggctggtcttgaactcctgactcatgatccacctgccttggcctcccaaagtgctgggataacaggcgtgagccaccacgcctggcctagaaacaaattttcttaatgaagacctttaaggtggtgctttttcagccttattgattgggtaagattatactgggaaacctaggaagcccagtactttcatatattgtatttcatccatttgaaataaatattatatatatttttaaagttatgtcatcttgatggtggttttcttttgtttgctaggtatgcttgagaaataatcctctttatcatgctggagcagttgcattttcaattagtgctgggattcctaaagttggtgtcttaatggagtcagtttggaatatgaatgacagctgtagatttcaacttagatctcctgaaagcttgaaaaacatggaaaaagctagcaaaactactgaagctaagtaagtactatagcttaactaatcgtgctttgacaccagttccttgtttgctctgcatatgaatgggaataatcaaggaagacttagaggtgtgaagttgtaaactcctaacatgatagggtcttgttaaggttcccaggaaatttgaaaggaagtgctaaattttactgtttgtaactttgctaatatatatctattaattaattaattaatttattattattatactttaagttgtagggtacatgtgcacaatgtgcaggttagttacatatgtatacatgtgccatgctggtgtgctgcacccattaactcgtcatttagcattaggtatatctcctaatgctatccctccccctccccccaccccacaacagtccccagagtgtgatgttccccttcctgtgtccatgtgttctcattgttcagttcccatctatgagtgagaatatgcgttgtttggttttt

SEQ ID NO: 130875 - DNA, 2343 bp, Homo sapiens
tcctggcgccaagtgattctccctccttggcctcccaaagtgctgggattacaggcatgacacctggcctaaagtcactaaattcttttaaaaattggtagagcaaatgtttacttctgaccttaaagatggccttagacattcatttgaataactgctattttgatttgtgtgaaaaagtattatagtttctagtcttactaagaacctctctgaattacttatttttatagcatttaactcaaaacattttagaactccagtctttaaagtatatatgccttgccctagtttttaccacaatccttttgaaaagatggcttgattttatttaaagttctaatattttattctttaggttgctacatgggtggatgaaactttaagttctgtggcttctaaattagagcacactgctcagacttactctgaacttcaaggagagcggatagtttctttacattgctgtgccctttacacctgcgctcagctggaaaacagtttatattggtggtgagtctatagggaggaggaatttatcggtgaatgcttgtgtatgtatagaaagatgctttgagtagtggaataccaacatgagaagttcaattaaaagattatgccttatggaagggaaatttcactttggaacaaagtaacattttaaaaaactttaacagttaaatttataaaaatacatacttagtgaatataattaataagttttatgaaagtataaagtagaaacaaaagtcatttagaatcctgcaacccagagataactacagttaacatttggggtattttaaatctttttttcctctgcataaacatgtactttgcttttacataattgaaagtataggttatagagtatttttttcatttcattgtatgaatattctctaccttatttaattatagctttactgttagaaggtgaccttacattttttctttgttgtgttttaaggagttaacagcaaaattgcattttggaaacaatatataggggagtttcctaatgaagtataattatttggaagaaaatatgtctgttaggcccaggcacagtggctttcggaggcccagcactttcggaggccaaggccagaggattgcttgagcctgggagttggagaacagcctgggcaatacagtgagacctagtctctacaaaaaatacaagaagtaactgggtgtggtggtgggtgccttgtagtctcagctacttgggaggctgaggcaggaggatctcttgagtccaggaggtagagtgcagtgagctgagatcagccacctgcactgtagcctgggcagcagagaaaggccccgtctcaaaaaaaaaaaaaaaaaaaaagcaattgatgaatttcccataaaatttaattataaaggtttaataaaagtagatccagttattaatctaatgcacaaattataattaagatgaaattgtacacattaatagttttctgaggcgaaaatactggagaaatgccagaaatgcttaactgataatatgtgtaatttcagatttatttagtgggctgttttactgcttatttgaccaatttatgttttttgttttcaggggtgtagttccttttagtcaaaggaagaaaatgttagagaaagctagagcaaaaaataaaaagcctaaatccagtgctggtatttcttcaatgccgaacatcactgttggtacccaggtaagtgatggatttagcctgtcttaagggacctcgtttctcttcagaatcactttcttcccttgtaagcagttttacagatgagcatcatttgaagagtcggtttccagtaacgtgtatgtgtcacgtcattcttccttcattcagtagagtaatactgtatagattgtggttcagtattagtaggtttccctatggggcaaggttccctggctttaagaatcacttgctacttttaaaatgcagagtctggaaccccttacctgaaatgtttaagtttgtttggtggtagggccaggcatcgttgtgtttaacaaacatcccgggtgattcatatgactaacccgtttgaaagatactgctctatgaggatgttgtcagcatgaggcagggggctttggcaaatccccatttctaccactttctggtttttgactctgagatggttttaggcttctacgggtactattttctggaagctgatattgttaatatctcagtggttctctaagtgtggtccagagacccctgccttctcctcaaccctttcagggactctgaaaatttccttcatttttctattacatatttgtgtcaggctgaattagcttcctattagctgaattagctttgt

SEQ ID NO: 130876 - DNA, 3491 bp, Homo sapiens
cggattcattttagggatgtcattgtgctttttaagacagctgtaggtaagtctggagatatgagatttacacatttaaaagcatgatgctctggtagatgaagtcactgaggctgaaggtgaagcacaatttgaatacagggagaaacacagaatcagtggcagggagtgcatggtagtaccagggagatggagggaagaccatgcatggtagtgccagggagatggaaggtaggtggaagaccagtagagaatggtgacctatgaattagggagagaaggatgggttccagaacagataatgaacagaggcaaatcatttgaagagtttaaagagaagatggactgattacgtacattgagcattgatttggcagttggaaaaaatgtcatgtccatcactgaaaactggtaaggtgaaacatatgccaggcagtaattcactttaccatgttaggactgaaggagagatttgtttggatggttgttgggggatatgggaaggagttgcatccagtgtgtctgtgggttatctttaaataggaggggaggaaaacacttctttctctgagatggggagaagggaggaggtgagaatggtgctttcattaagcaaatctagagctaggaatattgaggaagcccctgcctgagagctatcattttctgggtgagtcagagatgaagtcaggggaggagattagtcatagtcgaatttgattgagtgcttatttgcactgggctctgtgctgtgtactttatccagctgacccttgaactatgaaggggttaggggcacccactcctcatgcagttgaaaatccacataactttgactcccccaaaacttattatagcctcctgttcactgggagccttagcaacaacataaagttgattaacaacatattttgtatgttatatgtagtatatactgtatttatacaataaagtaaattagagaaaatgttattaagaaaatcataaggaaaagaacatacatttagtattcattaagtggaagcggattaccattaaggtctttattctcattatcttcatgttgaataggctgaggaggggaaggaagaattagaagaggaggagttgcttttgctgtctcaaggatggcagaggctgaagagaactataagcagaccctaacagttcaaacccatattgttcaagggtcagctatatatgttactccgtttggtttttaccctgcactcccctctcccttaccatgatttgcattaccttaatacccattttagaaatgaagaaatggtttcagagaaattgtatagtttacctgaagtcacatacttaataagtgttggatctaggttggggactcacttagtctgattccattatagttaattcttaaccgtaggattgagaagagaatatgaagtagaaaggtaaaatttgatgcagtttctatggagaaagtcagtaatggtttgtagacatccatggtaaaggtaagggaagaattgctaacttggagaattccaaatttggtctcttttccatcccccaataaaagtgacttgaaaataggaaaataggtttgactggtacaggtaaaatagacgattaaaattagtattatttctgtacaacactaaggcataacctgttgttattgtgttatattaataaatcttgtagactttacaagttttagcactataacgttaccatctgaccaaataaaattgaattttgacagaaaaaccagaaagacaccatttgtttatcataccctggagccagaatcccaaagaaaatggagaagtactgtgtatagaccaacagcatttttgcaacctaaaatccgttactggcaatttttgctgtgagatttctaggtagctttgtggctctgatcatttgttttatgttaaagaaaattatttatttacatttattagccaagctttttataatttaattgcattccaaatcattgcatgtatgtcaacataaaagtgaacgaatgattaccttaaatatgggcacttgtttccatagcttgaaagagcttacagggaaagaatcttttgatttgacatcgtttttctctgtttcagctccgtattctgtttttctttttttcccttcactcattcagcacattgattgagcacctacttgtacgctaagttcttaagttacagtggtgaataagacaaagcttatacttgagtgagatagtgtataaacaaataaatatgtcaagttgtgaagtgctgtggattaaaaagaaagcagtgtaaggaactaatgtgagagtggtggttctgtacatagtgtcatcagagacagtctcttgagggagtgtcacctgagaaagagtaacacagacagagggaacagcaaggacagtggtccgagggtaggaagaagaccactgtgacaggaagaaggccagtgtgaatggaggtgagtgagttaatggagggagccagggccaccttaattggataccttgtaggctgtgctaaagacttcgtatagttgtggtttatgtgtttacataattaatctagatctgatgaagtgattaaagtgacagtgttcaaatcagtagatttggcaatttttatatttatagtattgtattttactttataggatggaacaaaattcatctgtattggggctctgtattctgaacttctggctgtcagcagtaaaggagaactttatcagtggaaatggagtgaatctgagccttacagaaatgcccaggtattttattttatgaaatcttgcattgaatagctctacatatcaacatataaaatagtaatttttttttatgctttcaaagaatccttcattacatcatccacgagcaacatttttggggttaaccaatgaaaagatagtcctcctgtctgcaaatagcataagagcaactgtagctacagaaaataacaaggtatgaaacactttgcattgattaacatttcatgctttaattcttgttttctttttttcttttttgctccttttccatcttttcatttttgatctatgttaacataaatacaaagtgtctcaagccttagtaatctaatgtatatttttgttggctagtttatactgtaactttaaaaatagctttctgtggctgggcctggtggctcacgcccgtaatccgagcactttgggaggctgaggtgggtggatcatgaggtcaggtgtcgagaccagcctagccaacccatctctactaaaaatacaaaaccccatctctactaaaaatacaaaaaaattagctgggtgtggtggcaggcgcctgtaataccagctcctcaggaggctgaggcaggagaattgcttgaacctgggaggtggaggttgcagtgagctgagatcgtaccactgcactgcagcgcaggtgacagtgcgagactccgtctcaaaaaaaaaaaaaaaaaagctttctggtttaaggaaaggcaaaaatattc

SEQ ID NO: 130877 - DNA, 1451 bp, Homo sapiens
gtaaacataggtgtggccagttaatagagttggtgttgctgggccaagtgttttttaaagctttggccgctatttcatgtctcatatttttaacagttttccttccccctttgaggaaggatttctagttaaatttatgacccatttatgttggacagttgcagatttactgattcaacttctttttgttgaaaaatagagctacaaactactgctctttaaggaaacatgcatagccactttctctagttggattgagcagatgtcagcttgctaagaagcagcaattcgtacttcataaaaacaataaaaacattgttttctatgacttatgaaatgaatgagctaaaatactgtccttgtgtatgtatttgattgttttgtatttacatacagtaaatttctttaatacagataaatctgaagcaggcaagaagtagtaggtgatttttttgtcctcttcctgtgggttcatagttgtgctattcatcttcatttgtccatagtgggttttcagggcctgtaggggtgtaattggctcatccaggccttatcaccgtgggggacattgccctatctctgaaagataaaggcaagtcagttctgagagggcctcatgcaccatgctcttgctattgggctggtttgttcaggattgtactgctctagtaaggcatttacccaaagaagctggagttaagattcatttgttcattcaacagttggtcagtgtgttcctgctttgtgccatataccaagctggcatatggtaatatagtcatgagtatgatattggcctttctacaaggaattcagtggggaacacaaacatttacatagaatgtaatgtgatcataatgtgatcagtgctaggctgaaagtatgagtaaagtgctataggggttctgagtggtaaatgaccaataccacctgagagatctggcaaaggcatcgcagaggagatagcatttaagcagcatttttaaggtgaggtgggcattgaccaaggcacaaaggtattccaaacgtatctgggcatgggcccagagtcacaaaaggtcatgatgtgtttgaggaaccatgaaaaattcagaattgctgctttgtggtggggagtaggagaagagatgggatggagatgactagacagtttgccaagcaagaagttaggatattgttttgcagcaattaagaagtcaacagagtccgtagagaagtgacttgatgtgattggtggggttttgctttgttgtatttgatttgttttaaggaggtgaacattactggcatgatgggagaaagcaacaggaaaaatcaaaagtcggttatgagaatgctacagttgttcaaggaaattgtgaggatctcaaccaaagcaggggtatggggagagagaaagagaagaatctgagaggaatttgagatcagtttagacatgggaacctgggagc

SEQ ID NO: 130878 - DNA, 2004 bp, Homo sapiens
gagacaaagctgactgaacaggaatgggctaggggagttatgctctgtatcctgaggaatagtgcaatgactggattctagaaagcatctaggatttggtaattgatttgaatctttaaaaatccatcactgccataagtgaaacagagttgatgtatcctgttgatggtatgtatgtaattgatagttcatcttcagaggctcctattggaacccatgtttttcgcttgttttttactgcgtctgtttcttcttatttccagaaccatttgggtaggaaattttctaaagcagaaataaactaaaagaagatgggaactttggggccccactagcagataaagagagcctgatatggatttcttttctttctttgatttagaacttgaatccgggatattgaaggcgaatattatttaactttccaaatttacgtttccatggttactgtgagtcttgttgtagttcatttattttcctctgcattcagctcatgtggcaagtttgaatgcaagaaggaacatgaattttaatcagtctctttggaagcaaaaggttattctgttttctttggcaactgccaaactttccctgaattgcattcttttacttatttccctaaaactagaaatgtcccaagttctacttttacttcatatggtagggactgatttaaaccattgggcttttactttttttttctttttgtacatcaattaccgtttcctatttctcttgtctggatcatgttagagttgtgtctatttcatatttgcaggaagtaaaagagactcctgaattatgttttaatagggccaccacgtattattaatctaggtttgtcatgtattatttttgattaatgaaagtatttctgaatagtgtaagtttagcaagcctagccattgtaccctctgttagatttagctagccgttgttggcctggctaaaaatatgatagatatgtttttaagtataccttgtttttagagacagttgtaagtgcatcatgaaatcttggcactgtatagacttttagtgcattattccttggtttgtttagccaccgagtgaatggaagaagagcggtatgtgaaacaaagtatatcctacctatattcttttttccattaaataccaaatttaaaatagcaacatggaaaaaactctttttactagcacatgatggaaatctagaaattcatacttgaattctgggaaagaaaacagcttaagcctttaattaaactgttaagcattatcatagtgatcagtaaataccattaggtgcttgtttgcagggctgaatgctacaagagaatgtagagagctattaaagggaaagaagaccttgtttttatgtaactttaggaaaacaaagtattatacaggggcgcaggataaataccatgtgaagaaactggtaatatgtgagacttatattggtttctcaaaattagttaggggtagtgattcctgaggagcaaaaggttttgggggaaggcttgatagggaatagagaggtaggtggagaatgcagggagatagggtgtcaggatgcacttggtatttaccattggtgagaagaggtaccagcaccagatgagagtggtctgccaagagtaggggcttgtctaatgaggggtccattaggaattcctagctcaagacagtttgaatgtcatgctaaggctaacactggaaaaccagagcagttgcagagcatgcatctatcattttatctcctccatgccacagacattgctgctaattgcctagtaccttgctacttatgggggctatattaatcacaagatcggatattgagcctgtcttatgaaacttgtgaggtttagtgcaggagacaggtggtgattagtcatccaaagtaatattcttaaaatgtgactttccttataatcttgattggggtttgctttttaaaaaaaatcttggtaacttgcattattttgactgaaagtgttatttctacgttcttgacat

SEQ ID NO: 130879 - DNA, 1031 bp, Homo sapiens
tattaatggattcatagtttaccctttttagggttttttctatgtgtgcatttttcgagtttgcttatatacgtaacatgttgaagttctaaatttatgtgctttttaaacccaccagtagacaaacgaggagtgtatattttctgatatgtaaattgaatttatagtacgcatttctaatgaaagccaacaatttaaaattctttaaaaaagaaccaaatatacttcaaaataaagcagttccactctaaaaccatgtagttgaaatatacaaaagtctgcctctaattttttaaaatactagttataatttttatacattcacttgaaagggttgatgttttgaatgttgcatgtcagccttattagatatacatttacataaatttttatgagtagataaactgctgttagttgcatcctgaagggtctttactagagagtggcttacttttatcccactggtgtgacccaattgcataccagttctccttcttcccttagagagagactctgagctgttgcgtgaacgtgaatccgttttacgtttacgtgaacgaaggtggcttgatggagcctcatttgataatgaaaggggttctaccagcaaggaaggagagccaaacttggataagaagaatacacctgttcaaagtccagtatctctaggagaagatttgcagtggtggcctgataaggtatttggaaaaaattcacactgcttccatttaaatggatccctgacaacccctccctctaaggtttccattttatttattctggtttttgtactatcactcaaggaaaaacacaaatatataaaacaatatttttgttttgttttaaaatatagatagaatatatctttatttggcactccatgagtcatctcagtgagatgtattcagtggtgcaacgtatcttactacttgataaagtaaatcagagaaattaggatgttagttctagataacacatcagcatgctattccagtacttcttttctggtaataattactccagtaagtggt

SEQ ID NO: 130880 - DNA, 2662 bp, Homo sapiens
tggtagtacacacctgtaatcctagctgctcaggaggctgagacaggaagattgagcccgggagttttgagactagcctgggcaacatagcaagacctcatctcaaaaacacaaaaaaattgggacacttgtcaggtatggtagtgcgtgcctataatccccagctactagggaggctgaggcaggaggatcacttcagcccaggagttctgggctgtagtgtactttgtacttgtgaataaccagtgctctccagcctgggtgacatagcaagaccccatttctttaaaaaacagtattattattttaaagctcagttctattaccttattcttttgtcacaacactatgtaacatgttatgtcaattagacagataactttatcttagctgaaaataataataatgaaaaccaagcaatcagaatgattgtttaaaatgctaattttataaattctccaatatttagaagccgctggagttctggagtgggtggaagtggtggaggatcctctggtaggtcatcagctggagctcgagattcccgccggcagactcgagttattcggacaggacgggatcgagggtctgggcttttgggcagtcagccccagccagttattccagcatctgtcattccagaggagctgatttcacaggtatggatctcgtagaacacttaatgtcagacaacaggacaaggtgaggttttactgaatatggtgggttgtagtcatgactcatatcatgagttctgaaacaactgttttcctattttgatcctagaaaactttttttttttcctttgagagggagtctcactctgctgcccaggctggagtacagtggcatgatctcagctcactgcaacctccgtcccctgagttcaagcaattctcatgcctcagcctcccgagtagctggaattaatgggtgtgcaccaccacacccagctaatttttgtattttttagtagagacggggtttcaccatgttagccaggctggtcttgaactactgacctcaggtgatccgcccaccttggcctcccgaagtgctgggattacaggcttgagccaccacatcctgtcctagaaagctgattttgataaagaatttaatcaaaagaaaattaccatagcacttctttttattttttatttcaggcccaagttgttttacaaggcaaatccagaagtgtcattattcgagaacttcagagaacaaatcttgatgtgaaccttgctgtaaataatttacttagccgggatgatgaagatggagatgatggggatgatacagccagcgaatcttatttgcctggaggttggtggatcaccgtcatgtttttctcatttctggagtgctctttcgactggggagtggaatttaaagcacaatagacttttctgaatattcttttcaaggtggtagatatttttcactgtagagttgcttgattttattgtaaagtttcttttatttttttcttttcttttttgagacggagccttgctttgttacccaggccggagtgcagtggcatgatctcggctcactgtaagctctgcctcctgtgttcatgccattctcctgcctcagcttcccgagtagctgggactacaggcgcccgccaccacgcctggctaattttttgtattttagtagagacggggtttcaccatgttagccaggatggtcttgatatcctgaccttgtgatccgcctgcctcagcctcccaaagtgctgggattacagatgtgagccaccgtgcccggccacaagtgttatatcttaacgagtgatctttcttgtgattatgtagtaagtagctcaggcgacatttatgcatttgatgttctttaaaatctttgttaataatgtaggttgttgtgtttttcctcaggcgatgtcattccctagtttttaaatgtatgtgaatttttagagctctttcagcagtctacagttgctctttgtgtgtatgctgcagtgatgtttgtttctgtttatagaggatcttatgtctctccttgatgccgacattcattctgcccacccaagtgtcattattgatgcagatgccatgttttctgaagacattagctattttggttacccttcttttcgtcgttcatcactttccaggctaggctcatctcgaggtaattttgcatttatttatatatttattttggtcacaggctagctgtatggaaagatagtggtagaatctactgactgtatttgaacttctaatattacagttattattagttttttatgaatgcattagcattaaaattaattattttttattttgaagagccacaatagtattttagagttgatcctatttacgttgtggaattgatgtcaaggactatgacttcacctaaatgtatttttaattaggaatatggattctgaactaaaagcagaattctactttacagtgacatgcagcattcagaaaacaagtcttagtttatttggttaaaataagtgatctgtttattttaaatcctggttagataaaataatgaaatgtgaaaaaacttactagaatggatttaggaccaatattaaatgaatagaaatgtttagtttattagaatgccttttttttttggggatgaagtctcactctgttgcccaggc

SEQ ID NO: 130881 - DNA, 1672 bp, Homo sapiens
gctaattatttttttgtggagactgggttttgacaggttgcccaggctagtcttgatctcctgagctcaagatctgcccatcttggtctctcaaagttctggaattacaggcgtgaacccagcctatggttttagattgacaaaatttcaaacatcatactgagagttcccatgtaccccatgtctagtttccaatattattaaaatctaatgttagtatggtacatgtgttacaattaatgagtggtgatactaaagtcatccataggttattcacatttccttagtttttcataatgccctttttctgttctaagatcccatccaggattccactttatatttagtcaccctttctcattagattcctcttgactgtgaccgtttctcagacttttccttgtttttgatgataaatacacattttaaaccagccacctatatggacaagacttggcccatgggctttaagtttgcaagctgtggactaattccatactaggtatgatatccttagttcattttgagtcattctgtgtaccttgagaactgtataacgggatcaaaattgtaggattaatttgataagcaaaccacagaaagtagaaacaggttttcccagtacttgttagtttaatattaaaaattatgttgctcactgtaattatagataaaaggaatcaactgattccagtactgtcttttgtgactaccaatagacctctattagaatatgcttagtttaacacattaatctttatatagatagtgagctggttagaggaatgttaatggcgattgacgtacggggactggtaggtggtttggattctgataggagaaaacactgcacacagcaggccagagtgggaatacctgtattctctatggtaacagtcaggtgaatggagaaactggagagatattttgacggttgtctttaaactcaatggagggcttgtgtagcagagattgtaaactggcagctgctggtggtgtaatggattaaatcagcagtgcttatagaaaagaatttgagtgtttttagataggcagatagtctcctgtcttccctgttatcttggcttcccttgtttacgtagcttatctacctctcatggagatatgagtttgagatacttgtaaggtctgcccaggagcagatgtgtacttggatactatttctgatcaggcttgtaatagtacttgcttgtggaaaaaaatggtgatgcatttcttagtgaaaatatggagtcttccctttaatctgtgatggccatataatttattgtctgaacagggacgtttttgagtgaaattaatagttaggcttagccaataggcttaaactggcactatcataggcaaactggtatatatagttataattatatcattttaaggctctttaatgtggtttttcctgttttcacattgaaataatttacatatttagctcttgaatgtttttaaaaatgactgaagatagtttttcctgaaagacttagtttttaaaactcataggaaactatgaagtaaaagtgctgatttaatagttgatttttgttgttgttgttggagacagagtctcactctgtcacccaggctggagtgcagtggtgcgatcttggctcactgcaacctctgcctcctgggttcaagtgattctcct

SEQ ID NO: 130882 - DNA, 1920 bp, Homo sapiens
tagttttctgagtccccttacccatttcttacactccccgtaaacccctctttgtgcctctgttctctctgccagaacagactgtgtaagcgttctttaagcattaggtccatgattgcaatactgtaaaatgtcatagtgcctcctgaccaacttgatgccagtgatttgtttacttatatttgagtttgcagatgtttacaaagtataagcagttaaattctgattgtttctcttgggctgtatgaaaaatctttgcagtttgttgaaggtgaaattgtgattaagttattttgtaaatcaaattttttttttacagtcacacatattttcctttatagtaaatgtgtttccttgatttgtacattgctctttttttttttttttcaatttctgtgttaattacaattaactttagagaagcttgcaatttataacatgtattggggaatctaggacaggcaaatcttgtgtcctcaaaggggagtctttaaaccacagatttaccaaatacaatgcaatatgaaagagactgtccccagagaccttggtcctcactcctgtcctgcagagtctaggcctgctcacttttgctgctgggagttgtcctggatcaggaagtgaatagtctctttgagagccacatttttaaagagtttgggattattggtacagttttttagcatggattttttttttttttttttttttttgagagacaggatctccctctgttgcccaggctggattgcagtcatgtgatcttgacccactgcagccttgacttcgcagcctcaagtgttcctcccacctcagcctcccaaatagctaggactacaggcatgccccaccacaccctgctaatttttgtatttttggtagagcagggttttgccatgttgcccaggctggtctttaactcctgaccttgaacagtctgcctgccccaacttcccaaagtgctgaggtaacaggcatgagccactatgcccggccagcatggataattgagaattgatcatttattttgactgattatttttaggaatacatactgatccatttaatgttttttccttagaagattttgctaattgtcagatttgtgtgctaaagatttctagctgctactgttttctttctttagtaattacttcaagtttatcctgcaaggtatttcaaaaatctcctaggtattttttttaaactcattttaaaccagcttaagggtaagagcaccagatttatttggggtagagaagggagtttatttttgtttaataaatagtaaggtgaaaatggacctgtatcgaaagttcctattctgttacttgtgaccgttgaacaatagatgataggtataagctgcttttcgttgatttgagctaccatattcctttagggtttaatctgagctaatagtacgtgaattgaaatgtataattttacttgcaaatagttgaaggcccccttcaggtgggtaagacagtttgtagcaggattctgacaaactggattccccatttttcaaggaggctgctggtaaactggttttgtctataggagaatacagggccatggttggcaaattcaaatccttgtgtccctccctgccttattttgtcccaagaaaacctgcaaatctggattgtgtgataatctcttatcttaaatgttgggactaattgatattttcatggaaataaatatacacatacacacagtcacatcattcagacttgtgtgtgcatacatgttatgtacattttaaaaataaactattttaggatagggttttttttttttttttttgagacaggatctggctctgtcacccgggttggaatgcagtggcatgattttggcttattgcagcctccgcctcctgggctcaagccattctcctacctcagcctctca

SEQ ID NO: 130883 - DNA, 1124 bp, Homo sapiens
ttttctgttttctttgcttttaggatggtagagtttgcaggattggtttttcagtacagccagacagattggaattgggtaaacctgataataatgatgggtaagatattatgtcctttctatttaatatgtatttagctcttaggtattatattaaacctgtgttttgatttcggtaaccctcaacttaaagcatcacagaaaattagatcttttaaaacagtgaaactattgctttctagtttaattttaatctttatgcaagcgatgattcacagcccaaagtactaacattaaaagtagcagaggagtcagttatcacttaacagaaacaggttaccagaagaatgatattacgtgtttagtaggtaccaagtcaaatctgctctttaactgaaatgattttatagatcatttccaaattaagcaatgcaatttgaaataacagggttgtaaaaaatgttggtcttcaaaaatttacctcttgctttcccccaggtcaaagttgaacagcaactcgggggcagggaggacgtcaaggcctggtaggacaagcgactctccatggtttctctcaggttctgagactctaggcaggctggcaggcaacaccttagggtaagttgtggccagttgaaggcaccatcttacagatggtctgtatcatcttcctgtgagtgctctcagtctgaatgatcatcttcaatattctatctagtgatggagtgagaaaattctcctgaactctgggcaggaagttcatattgctcagggtgagccaccatgataaaaataactcacacaggctaattacaattaatctaggctcttgacctttaaaaaatgtatataatgtttacatatgtttataatgtcacgccatttatttcatttaaaattttaaatgattttatctttggtcctctcttacaacttattcttggtacaacttattctttgtactataacagcagagatgagtaattgggacagactagcctccaaagcataaacttatttatgatttggccctttacagtaaaagtctgctcatcccaggttttgcttgtcaatttatatactggcgtttgttcctgatcctatttatttatttctggcatcca

SEQ ID NO: 130884 - DNA, 1254 bp, Homo sapiens
ctggtttgttcaattttgtgctataagaccgttcaagaacttgagatgataccttaagtcaattaggctttctgttttcatttcatgatatccatgtgcactcaagaatctcttgacatggataacacagttttttgttttgttttgtttttttaaacaattgagcctttggttgggcattggttcagctaccaactttatgctaccttttctataaactctagaagcttcagttttctcacctgggattaatgggaaaatgggattaatacgattatcattgttactgaggttgcaaatggggtggtgagggaacggaattgcagagtctgcttgtgatcttttcgggacaaaaatgaaaatatgaaaaacattcttaccatagcagttgttttgtgtactactattggaaattaccaaaataatggtacaagtacctgtcagaagtatttgtttacaaaagatctgtacacgtggtttgttaatgttttgttttaaaggttacgagaagtttctgagaagctgaacaaatataatttaaacaggtaagagttttaaaatatttaaatcttctgacaacaatttttctttattaagaaaaaactcatttaggcggcagcctgatatgattaagattaatgtgattattagactttaagaatcttttaatctgtcaactttttatgggttgggcttatttgaattatagattgcattcatgcttttttttttttaaatctggcatacagggagatataaatgattatggagatattatttttcaattattgctttaaagtaaatattagtttaaaaaataggttttgccaactttttttttctaattgtatttaagagtaaaccctatgatgtatttaccattaaaaaataatttaactttttctttttttatctctcagccacccccctttgaatgtattggaacaggctactattaaacagtgtgtggtgggaccaaatcatgctgcctttcttcttgaggtaaattattcactctaagatacagaaatgaaaaataaactgttaaaatagaattgtgcatcattgtatctcttccattataacaggaaaacagcagttacttgaaagttatcttgaagagctcccagttctctttcctcctctggcccagagaaagcttacatgatttgccagagtgtgaaactaattagtaacagaataggggagtctcctaaatccagtcattttcttactttgaattttgtcagattg

SEQ ID NO: 130885 - DNA, 1948 bp, Homo sapiens
tagcctttttccctagctatagtggctggcaggtgggaccaccccacgtgatagtttgaatttattgatatcagtgataacgtgaaacagttggcatgagaagcagcgtttaagaagtgtcagtgtttgtggtatggtgcaagagttgtttaaaagaactgtgtaaaaattgaggactgactgcctgtttacttaagaaagtgcatgataatttaactgcggaccatgttctgtggttagagataggttgtctttttagaaaggtgcttgtctctaccatctatatagtacacaatagttgctccaaaaaaaaaaaaatggtataggcaagaccaccactccaagacttaggctttaagatttagatggtttgcctttggagaaatgccagaaatattcttacagtatttctttttctagcagaatttatctggtcacagattttttacatgtactgcatttttgttttggcaatacctgctttctccaacatggatgacaagaggtgaatttgaagactttttctacaggagtctgtgatttagtattgtaggtaaccttcattgactgtatctgttggttctttgcatgaattattaagccctttacttcaaaataaaattgtatgggtatgtaaaagttttattccatgagtggatatccagagttggggtgaggtggggtcactttataggcagtttcctaatatgattattgagttacttagtgtttttttccttccatggtaagtgatcttttaagagttatatgggaaactatcttaaatctgtatattcacactgctcacgtatttaatttgagacggaagacctggagagttagtttttttgagattaagatcaggaacattttctgcctctgaaataagttacgtaccagtaatgtactttttttcgttgttggaactgtatccagaaaagcagaggggtaaggaaagacttggcaagttgtattctgtctttgcttagagtctgtgaagacagttcggatagaaacacaaatgactagatatgagagaatttgtagacttctgtaggaaggaaattacaactaccaggaaaggttcatggaggaggtggcatttgaactgggtgggaaataagtggaatgagactgaaggaactgcactggtggcagatgatgccacttttgccattaacgtgattgctgagagtcatgaaacatgagtggatgtaccttgtttaacagttccaagtatatggaaaccatcaccttgtagagtatgtgatgtcagaaatacctttctgtctttgagaattgaaacctttgaaggtttaattatacgtttttttttttgctttagaaattctgcaagaaaggatctgtcaggtttaatccagtttaggggtatttgaacatgcagatatgttatatgttagagttaggcagagaattatgaaaccgaagaacctgtacttagtgctgttgccagttgaggatcagtgagaagataaattacctttgaaattgtaatgttaaatttggggagaatgagactgaaattagaggggatttaaagtatagcaatgaaatatgttggcttctagcaagtaccgttacactgttttcctgtctctgttaattaacatcagtttgctgttaccttactttgttgctttaaacaaaaatttcagcctctagatctgtaaagtgatctatacatttaaaggaatgaaatagtttatttaatcagaatatagaataaatgtagcaaataggagtgtagagtacccaaggattgtcagaagctttttgctaacctattcattgtgtgttacaaccacctcaccaaagttcacctgtctacctatctatccttgaatgagattaaatgctattatgaggttattttctttgtgtttttttttttttagacggagtcttgctctgtcacctaggctggagc

SEQ ID NO: 130886 - DNA, 2445 bp, Homo sapiens
aaatgcctagtttagtctggagtgaagggtaaattaaggtttcccacagtttgtttcagtgtaggcctgagactagtagctatgtgtgcagaaggcagtagggatatagttattctgtcagtctgtctaatatctgtatgtcacctacctacctacgtacctgctttcttttttctgacagtgccattcagaagggatatggttattctaaggctgagggaatagttatgtaaacaaaaataaaagagtagtttgtgagtatgatttagttagggaattgtgtttggagtacaggctccttctggaagagagagatgcgattagagtgacggtagtgaccagaagaaaaaaaaacgctgaaataaaaactcgtgtataagaaacaaggagttacagtgtgttcacagatttctttttccaagaattcccagacttagctttcattccctggatcctcaagttcctagcagatcttaggaatcaaataaggccctatttagtttgagaaccacttcaagccagagcttggcagagttgaagtagcaatatagtgagctatccaaggatgaaaaatacatttcagtaatattgataaatggctgccatttattgaacacttaagtgcctgctctttccaaggtatattacaaaattatcttgaatccttacagcatcactgctagacaagtggtagttctatctgcatttaatagatgaagaaaccttccatgcctctgggatgttaaaataagctctaccaaagttccagagccagttcacagtagagatggaatcaaacccaggtttctgtgacactacagcgtactcttcacacctcaccaagctgcccctcacaagagagtaggtgtgatgcctggggctgatgaaatggcagcttaggacgtaaagtgaccatttcaaaggcagcaaaactgcgatttcatctttgacgttaataaaacggcaacaagaagccatctcagtaaatctcgtacaaagaaactctccagaatctaatggcatcaagatcctcgatcaggaatataaccccgattgtcttgtttctatagagaaatcagatttcatttcaggtattttatttcagtttacagttctttctcaaggactgaataacttaccaaatagcagtgtttatactatgaagtacatcagctatctcttgagatattttatttgtatgtagagttaaaattggatttgtagtaatttgaatacattatctgcatttgggagatgctttacggaatgaagtcacaggtattcagaatgtggatggtctatggtgaagaaagcctagtatattctcttgaaattttggtcggatgctacacttttttggtcaggagccctgaagaagtctttcggtcttatctgctagcatagtttgattcttgtatgaatgtatatatagtcttactgttaaacaaatgaaattaggtaagacagaaggacttatgaaattattaagaataattagtgtataaaggccatatcttgaatcttttcttaccaaatttcttcttgtttggcatgtgcattcttttccttttcctgtttcgaacggagctgaaaataacgtgattgattttgctttaaaggtacatgactgggctgggtgcggtggctcacacctgtaatcccagctctcagggaggcaagaggtgggaggacagcttgagcccaggagttcgagagctgcctgggcaatatagcgagaccccgttctccacaaaaaggaaaaacaaaaacaaaaaaggaacatgactgattgtgtgtgtgtgtgtgtgtgtgtgtgtgtgtgtgttcagcatttcgtttttcagagatgtgtttatctttcaaatggccccagtagtttgggattttggtctccttttcacttaattaggaaaagtgttatttgtggtacaatataagaatttctaatcagagtatttttcaggttagaggaagaaattggttgtaggtatacattttaacagtttagctaatgaaatgaccatgaataatgtaatttttctctagtttgcagagcatttttctctgcaaactagagaaacatgaattttctgagtttaatagaaatctttttgacagtttcaactaaaactgataactaaggggaatagttagaagttcacattaaaaaagtttatatccctttatgaagttacaatatttatttagaaacttcattttcttctttgaatgcatcttgaaggtgaatgttcttatttagggtaacatgaatgcattatatataaactggcatttatcatcttcataagcattaataaaagtgtaagtcctccttacaaactatgattcaagaagccaacagatgaaacttacctcacaaaaaccatcttttgttttgtctttctgtgttttgttttgtcttttgtgtaatttggggtcatttaa

SEQ ID NO: 130887 - DNA, 1253 bp, Homo sapiens
catataccaatatttatttagccagaatataagttattgagccttgtatttagagatttctgatttagtaggtttaaatggggcctaagaatatgtctttttaattgttccccagggatttcgatgatgagccatatttaggcactcttattttagagagtacacattacttttgcatgtgatgttacctatttcttaaaacaactttgtgaaacagataaatttttgacagaagtgggaacatgagagcaagagatgttaaatgaggtatccaaggttacacggtgtcagagctgggagtcaaaacccagggcttttgattgactcggtaggaccagtctggcactaattttgccttttcatgaaagctacaatgttgatgattgcccaaaccaaagaaacaatttaatgtgtatgtttatatccaattattcctattctggtaagcattaggtgttagaatattttattgtattacttgccattggaagacctccagtgatcggacttcctataattttcatgttaaggcacttcaccagttagattcctgttaccaatgtaaggcgcttagacagccaggctctgcactataataggcttttatctgtaattttgcttcctgataagctctccttcccccttgctattgcttccagcttccttttggtccctgtagcacatttccctaacaccagcccagatacaaaccgcaggggagggagagggagaggagaaagaagattgtcttcttaggcaagaggactgggagagtatcccacaactatgaagtattgagtaactttcctgtttgtctggtaaactctttctggggctaattctcagagtttcagaaattcctcatactcttatagcaccatttgaattataatgtagcctatgggggattattttgcaggacaacattcctttgttgtgttttataaaacctagtctgctaatattggtcacagcagaatgttttaaaatcacttttattttttattcattttatttttattttttgagacagagtctcactctgttgcccaagctagggtgccagggacacaatcttggctcactgcaacctctgcctcccaggttcaagtgattcttgtacctcagcctcccaagtagctgggatcactggtgtgcaccaccacccctgactaatttttgtatttttagtggagatggggttttgccatgttacccaggctgttctcgaattcctggcctcaagtgatctg

SEQ ID NO: 130888 - DNA, 2058 bp, Homo sapiens
tggagacttcgattagccagagtccttaatatggtagctcagagtttcaaaggcatgcatcccaagaaataaaaccaggctggaattcctttttgtgacctagccttagaagttttgcagcgtcacttctgcctcattacctttgcaagaagcaagtcatcaggctagcttatatatgaggaagagtaattagactctacctcttgatggaagaagtataaaataatttatagatttcttttaaaccactgtgatcgttaagaatagtgataatagtaaagcataattatttagaaagagatttgggtactatgaatgttttagaaaagactgataccatgtatttgaaaacaaattataaggacttaacatttatggcattggacagaataatacatattatggaagtgtaactactaacgaacaatttcctgagataattattgaactcgacagttggtttaacaccacagaggcccccttaaaagcatctaggtcagaatcacaaggcaagtcaatataaatgtgtttctttgacgtcactagtattacttacagtcagttgattgattaggtgcattgtttaggaaatgtgaaatatttgatgtattctgagacttaaagattgaaatgtgagctagcgattagttctttactatgactctgctcagactcagggtgtattttctatgaaatagtattttgtaaaacctactcaggatcgttttgtagtctattataagcgtgatgattgggtgttcatatgcatatgtgagatgtgccaccctcaaatcttgttatgacgtcatcagcacgttactcttctgatacgaaaaaaagaagaaccactcggcttcatcatccgtttaattagtaagctttaggactgaatgttttctattttcagagacatgtctgcactgaaatactactattgtgtgtattcatttaatagtttgcgtgcctactgtgtgtcaggcattgtactggggactgggtatgtagtggcattctaaagaaatcttaatgccacttccaaaaggaaaactccaaaaatcttttgggtgtggggcattattgttgaaataaatgtgtagcttgccagtatgattaatacgaagaagacacatctgtttgcatgtaaagtttattggaaatagggcttattatttcatagctgtgcctaagagagtattttgatattatttgtggtcagttttcaaggggttattagtcatatgtgccatttttcttgggtattttgcagtttttattgaatatgtgatgaacttgcaggatcttttgtgtgaatgtgaaaaagagcgtgtgttttacacatgttttatacatcacatattttgtttctaatcaaaagaggccttatatctgaaagccttcttgttactcataagacaaggatgtgagactagacagtttttaagggtctgcctaggtctaacagaggggaaggaataagttctggatgggaaagttggtagaaatgttagcgaagtgtcaaattaagtagaattagtttttagattttcttgaagccaagacaaaaacaatggctaaaaaattacaaagctcagtgtatcacagaggagcttttccttccttccttccttccttccattttttttttttttttttttttttgacagagtctcactctgttgcctgggctggagtgccgtggtgtgacctctgcttcccaggctcaagggattctcatgcctcagcctcttgagtagctgggattacaggtgcatgctaccacgcctggctaatttttgtgtttttagtagaggtgaggtttcgggttttactgtgttgcccagactgatctcgaactcgtgggctcaagtgatccatctgcttcggcctcccaaagtgctgggattacaggcatgagccaccacccctgaccaggaactttttgttaatcatggtttgatataaatgttggagaatcttttacattagagatattttaaaaacctaatggactgtgagttttataatcgatacagaagttttatttatgtgattatgtga

SEQ ID NO: 130889 - DNA, 1055 bp, Homo sapiens
tcaaagttcacatgctgcatttggtttcatttgaattttatcgtggagtaatttttacaaacatatttgtggtttttccaagggctacatgtaatcatttgatgttgacattctatgttaaagcacaattgtcactttcagttttcttttctttgagacaggttcttgctctgctgcccaggatggagtgcagtggcaccatcactgtacgctgcagcatcaacctcccaggctgaagagattctcccactttggcctctgaagtagaggtggggtctcactatggtgcctaggctgatcttaaactcttgggctctagggattctcccgcctcggcctcccaaattgttgggattacaggggtgagccaccacacccagcctcgatattcattgtcttttaattggtctgtgtatatgtttctttgtttctcactgacgtgtatgtacgttttgttgaatttctcaacattgctttccctagacctcatgaagtcttgtaccttttgcaagattcgcaacttcattttgcagatattttgcgttggactacatggtattgtcagattaacatcctatgactagcagtggcttagcttcaaaagatgtggaagcaataggccagtttgtgcacttgttaaatttacagggatgttcggagaccatttttccaagagattaatggttggtgagggttttggctttgtcaacttttgtttccttatgcactctcctgactgcagggatgaggaaataacattctatcagtatacattaccgggtgtgattgttgagagttggcctgtcagttgtatatataaaagtgtggctttttttttttttttttttgagacagagtctcgctgttgccgaggctggagtgcagtggcacgatctcagctcggccttccgagtagctgggattacaggtgcctgccaccacgctaggctaatttttgtatttttagtagagatggggtttcaccattttggccagttggtcttgaactcctgacctcaagtgatctgcccaccttagtttcccaaagtactggg

SEQ ID NO: 130890 - DNA, 1508 bp, Homo sapiens
catgggatggaccgtcatcaggagcagcaaaacttgaagaccactgagtaaaaaggctcttttaccctcttttctttgtcttaacattgattgatgatggcaaatagggccaaacttgccagttcttcactgcctccaaccttccttttccccttagacttacaggttttatacctgtctgtttgagaatagggtattttcctgttccttgattttgtgtgtctctctctaagctagagtagtttatttttgttcgcttctttttttttaaccacgaaattggaaaaatttagattaagttacataaattctaggtcctctacacaactgtgagatactgaaaggatagctttttaaaatgcatttcggtgcttgtaaggtcacagtctagttgggagaaatgaggctcatccatagatagtagcactatgaaagactgctacaagaggtagagtttgggctgtgtaaatatttgccatgctattgcttgcacagagtttgagaacagtgttagattagtttttcttgttgagtaaatgcttgtgtgcttctcatgtgcaaaaagtgtgctaggccagggatagctggtgtgtttcaattgccacaccaaaccgtcctgaaacttcgggttgagacgtgtttggaactttttctggctcagggagaaagcttggagaagagtgaggttatagattagcgagctcagggagtggcatcaggtgggtatgccatgtattgtttttctacctttctttttttttgagacagggtcttgctgtgttgcctaggctgatcttgaactcctgggctcaagcaaccctcttgcctcagcttcctgagtagctgggattacagacaagtagctaggattacaggtgagtgccactgcacctagcttgtttttctaaccttttattttgaaataattacagactcaaaagaagatgcaaaattggtacagaggggtaccatggatccatcacccaacttccttcaatggtaacatattatgccagatatttttggcatccatgtcaaaatactagagatagagacattttccccatgtgcatttttgatttttttttttttttttttttgagacagagtcttgctctgtcacccagggtggagtgcagcggtgccatctcggctcactgcaacccccacctcctgggttcaagcaattctcctgcctcagcctcctgagtagctgggactacaggcgcctgccaccacgcccagctaattttttgtaattttagtagagactgggtttcaccatgttggccaggctggtctcgaactcctgacctcgtgatccacccgctttggcctcccaaagtgttcggattacaggtgtgagccactgcacccagccaaaaattgtttaagataacatagatttgaagacatagtttaaagaaaactttgcctttttagatgtgattgtaaattgatgagatataggctgggcataatggctcacgcctgtaatctcagcactt

SEQ ID NO: 130891 - DNA, 2925 bp, Homo sapiens
aacaaaaaaacaaaaaaatcaataaaaaaaccccccagacattaggttgtgtgggatggagcatcatattaccaaatcagtgaaaaatctcaccatttgattattgagattgttacctaaaagcaatactaaatgcattatgccaggtgcggtggctcatgcctgtaatcccagcactttgggaggctgaggtgggcggatcatctgaggtcagaagtttgagaccagcctggccaacatggtgaaaccccatctctactaaaaatacaaaaattagctgggcatggtggtgcatgcctgtagttgcagctactcaagaggctgaggcaggagaattgcttgaacctgggaggtggaggttgcagtgagccaagattgcgccactgcactccagcttgggtgacagagcgagactccatctcaaaaacaaaaacaaaaccaaaaacaaacaataaaaaaccaatactagatttattgtattggaaaagtacagtctggcctaactaaaatgtttaaatgaatttgcttaagtaagattaacagcagggtgtagaatagccaagcaaaatagaaaatcaaaacaaaggcagagcaattttataaatcaggatatctgtgactgaatcataggcctaggaataaacagacacttgtgaagaaaattacaggatacacaggaatacgactaggaataataggtgaaattaggaaaggtcagggttttttcccctaacaattagaccattaggttatttaggaaatagtttccaaaggaaaatttaattgctgaagactgagttacatggacgtagatcttataaggtatattaaaggaagcaattttatgttacaggaggatgtacttaatgtctcccctccctcattttatcatacatatttattttgttttttgagtctcgctcttgcccacgctggaatgcagtggtgccattttggcacaatcttggctcactgcaacctccgcctcccgggttcaagcgattctgctgcctcagcctcctgagtagctgggagtacaggcgcacgccaccatacctggctaatttttgtatttttagtagagatggggtttcaccgtgttgatcacgctggtcttgaactcctgacctcgtgatctgcccacctaggcctcccaaagtgttgggattacaggcgggagccactgcgctcgcccatattatacatatttctaattaagaaaacagactctagttagcatccatgtttctgtcattttgactccttggcattctggtcatgtgaaaatagcctcttctcttggctcactgtggttatgaattgttggtttatttttagaactggtttttaagttttcccctgagtattatttttaagccttttattttggaaaattttaagcatatacaagagtagagagaatagtatgatgaacaaccatgttcccatcacacagtcttaacagttgtcaactcatggccaatctgatttcaactctctccccatttattctcctctatcaggtaatttaattgctgtatcttcactatatatttcaaaatatgaagcctttaaaaaaaaacctgaaaaaaccttaataacaaaattgcccagattttcctgttgtctcataaatgcttatttctgattgacaattttgataattttacttaataaagctgattgggttctaacatgttaaaaaatttgacatttgtagaataaccttagaatttggattgtaaccttagaagaaggggccactggggaattatttagttccttaaagctcagtgctgtaactttttttttttttttttttttttgagatggagtttcgctcttgttgcccaggctcgagtgcagtggcgtgatctctgctcactgcaacttccgcctcccgggttcaagtgattctcctgcctcagcttcccaagtggctgagattataggtgtgagccaccacgcctggctaattttgtatttttagtggagacggggtttgaccatgttggtcaggctggtctcgaactcccgacctcaggtgttcacctgccttagcctcccagggtgttgggattacaggcgtgagccactgtgccaggcctcagtgctataacttcttaacctccggtatgacagcattttttgtcagcagtcacttgtaattgttagataaggatgataagacaggattcttgaaattcagtgatttttccatggggtcactttgagaaataagattgtcatgtgaaaagtttgcagcattttcatgaactaatagacaggtgaggtattagtcaattgaacttggctataagaaattattctctgagatcatatttcttattactttcttgagacaatcagtgtagtggtaacaaaaccccttccaaattagaaatacgataaattcttagataaccatgctttgtaacattgtcattttgtcaggatattaaagaaggtattaatatttaatgttattttacttgtaaatacacaatttatgttacttgcacagctaaagtactgttatttgttcaatttctgacagtatcacttaataaaatgtctttgactctttcatctttattgagttatactttacattcagtaaaattaacccattttaggtgtacagtttgatgaatttcggcaaatgtgtacagttgtgtaatcaccaccacaatccaggtacaggacattttcatcaccccaaaaagttacctggtttccctttgtattttcagtcacttccccctaggctaggtcctggctacctagcaaccattgttctgctttctctcactgtaatgcttttcctttttgaatttcatagaaatggaatcatgtgtctgttttcttttgcttagaacagtgcttttgcaacagatctgtgttgcagcatgtagtagtttcttc

SEQ ID NO: 130892 - DNA, 1840 bp, Homo sapiens
tgaattgaaaccattcagtgctcagatactttggacattttgatctcctttccaatggatttcttgagttagtactacgttcctgcttaaaacattgtctcagagaaacagtaaaacaatataaagaatgtggttcgtcgagcttgaggggagagctgaaaggcctgcctcactaatagcctggaaagtgcctcactaatgagctgaaaaaataggcacagagatttacagtgtttatgcagggatacaactactgagagacagctgaggtccacctgatgggtcttctgacttttctttaaagtccagggctccattccacttcacgtggcttgtattccagaatggttctgctgtctcagacatcccagccttcaggcagtgtggccacctgtcttagtgttttgattccgttttcccctcaactgctctttccagggctcctaatgggtttatgcctttttttcagaggctgacgctcttaaccttttcttggtactaggttaggataggtcttcttaaggtgatgtggttatggcatttattgtccttgtcctgaattattcctcaagatgcaggttagttacgaaacaaaccagttcttattgcttgtctgtatgtggaattttcctgtgagatttgccttttggcattacaacgtattgtgcagtcataaacagtctttattgagattgtcatatcaaaaggatttttctctaagcttagagtttccctttcaggtgtcataacacaaggtaagatactatagacaggagtttcaaactctgcgctggtagcctagtcatttaacctcttagaaccccccacatcaatctctgaattaggtgtagcactctcctcaaggtcagggaggaacagttgagacagtagatgggaaaagatcaatattataatgtggattctacggaaaacattacgaagagatggttacttttaactttttacgtgttgcctggtttccagatagcaaagcaggaactcaaaagagttgccctagaatatccttagcattcagagcagaatcgactcttagttctagattagtacttctcagcttggtgtgattttgcaccctccacacacaaccccctccccttattgggcagtgtctggagacattttttattgtcacagctggggcattgctactggcctctagtggatggaggccagagatgctgctaaacatcctataatgcataggatagcccccacaacaaagaattacggggtccaaaatgtcagttgtgctaaggttaaggaagcccatcctagatgatcttcaatgcatttggttgtaaaaataagtgaaaatgacttttatgaagaatatttcaagcaatatacgttctttttttttttcttttttgagacacagttttgctttgtctcctaggctggaggcagtggccggatctcggctcaatgcaacgtccacctcctgggttcaagcgattctccttcctcagcctcccaagttacagacgcataccactatgtctggctaatttttgtatttttagtagagatggggtttcgtcatgttggctaggctgctcttgaacctaacctcaggtgatccatctgcctcagcctaccaaaatgctgggattacaggcatgagccaatgtacctggccgcaatatatattcttaatttttaaaacatgactgtttaaattaagattaaggcccggccagtggctcatgcctgtaatcccagcactttgggtggctgaggcgggcgaatcacttgaggtcaggagttcgagaccccttagcctggccaacatggtgaaaccccatctctactaaaaata

SEQ ID NO: 130893 - DNA, 1584 bp, Homo sapiens
gaagcgccatgattattgttattattattaaatttgagcccctgcagtgaggtttgcctgccccgggaggggatggattcaagcgggggtggggaagtgcattggattccctttactctcctcctgaaatggtgctggcagctcctgctactagcccctgtggtgcgagcttttttgtttccttttctattctaatgatagtgttttcctgagttgtaatttgacagctgaaaaccgtgcgtagagtgtcaaaggaaaactcttacgtttgcagttcgcaatgctgcttttcttaacacgctgtaaatttctgggttgggtttgctatgggcggaggatgaattatgattttattttatgttttgtcttttataggctgttttggtttggatttctccttttcttccgccaccgttccttgccagtttaggatattgaattgcagtgccgcatgctctcagggaactgagataaggcaggaaaagttccttcactgttggaaaacagactcaggaggttgagggaggcctccattaaagcatgtcttagaatctaagactcagatctaatgatgggctaaatgtttacaggatcacaaagtggagcattttaagtcttcctctctcccagtacttcactgctctctacatttcttttgcgtatagaaggccatctggtcccaagtttagaagttacatagaatttttgctaagtgaccgggtgacttaagttgcatgatgccctgtttgtcatgcgcttcccagagggaggaagaggcctaacttgctgctgagatactggcctcttgtgtcagtgtatctaaccgcctcaagtggagcagacagcttttaaatccagagctggcggtttagtttctgcacttggttcggatttgcctaatctttgctgtagccatattgtatttaacatgtttgggaatcttttgaaatacttactgaaaatactaactactcagagttgtcacatagttcctttaaattctgaaataactttttagttatttaacattttgttatgtggttcttagcctgactttacttcattaaagatcttttggagacattaacataaaattttttggtaaaatttagaaacaggctagtagtgaggatagctctacggtcattaacagaaccatgttggtagtgcttgtcttgttacttagaaaaccgcaccagagagaagagaggtagggcatgttttctatattagtcctaactttatgtaccaagaaacctgactagcttactcagttggctgtgcatgccaaaacctattttgcggttgtgttgggcactttgattcatttttgagcattccttttgcttcagctatttgagaaatttacaagtaatgtatctttttaaatgctaactcttctttttccattcctagtataaacaatcagctttgtttgattcttctatcattatacaacattaaaaatatttagatcatagtgacttttaatttcatgaaattaggaaaaaagtagacttgagtcataacatgtgcatcaaggtggcagatatttgaaaaatagaaaggtgccgtaggtgaaat

SEQ ID NO: 130894 - DNA, 1186 bp, Homo sapiens
tcccggagccccgcctctcgccgccgcgcccccgcccgccggtctcctccctcctcctcctcccgtttgcccctcccccgccgctccggagcggagcctgcgagacggagaaactggggcagaagtgaagatggcggcggcagcttctcgctagtgacgcgcggtgcgggctcatctccttcccctccttcctcacctcccctagtccggaccccgtccgccgccgggaccagaccgtccccgtagcccgcagccagcagccgcccctctcctcccccggccgcccctctcccaacgcccgtctgccgctggccggcggcgcgcccctggtcccggccgcctgcctcgcactccgcgctgtcgccgggggagcgggtggcgtgtggattcgccctcctgcccgcccctccgggccgcggacacacgcccggcagggaggcggcggcggcccctgcgtatttgcttccctccatttggggactgggaggcggcggcggctgtgggttttggggaggggtagagggctggggggcgggcgagagcgggagggggccgccctcgagtggaggacgagaaggaaagcaccatgacgtccatccatttcgtggttcacccgctgccgggcaccgaggaccagctcaatgacaggtaatagggctggcgggtcggcgggcgcggggggaggggcgcccttccctccctcccctcccccacgggccgtgccgggcgggtgcgggtgtttacgcgccggccggccagctggggtggggtgcgggggtccttactgcctcctgctaggctccttccggggcaaacttctcatcccgggggcagggggccgcggggggagcgcggtgtagacgggactcgcggtgtagactggagagcgctctgtaaacccccttccccctcccgcaaggagcggcgttgaactcggcggagatgggggggtggtttctggctcccggggggcaggcggtaattactgcccggccaaggcccgaggaatccatattagtcaaagttgaattgagacagacaatgcggatgggggatggtggaggtaaaaagagagggaagaggagaagcggggccaggggccccggggtgggctgggctgggcttgtcccgggcccccggcagctgtgtccggtggggtggtctggacctggggatcccggggtcg

SEQ ID NO: 130895 - DNA, 1014 bp, Homo sapiens
ttgcagagatcagtttactttcaacacgccttcatttctgttatctctattatctcattttcttctcccagccgccttgcaggaaaggacagggtattattaccccatctgatggtacaaagaagcagagccagggctcaaggtcacatgcctgagtggcagagccaaacccgggaccaaagtctaagctggcacctttgctcagaccttggacagacctgggggaaggcagcaggctacatggctttcaaacttgattgtgtttaccactcacccaggagtgcgtttttataaagcaggtccccagacactcaccagagcattctgtagatttagtgtgcctgggaatctgcgttttaataggcacctctgattgaagtgaagagaacattttaacttactcctggagatctcacccctttatgtggtttgcaaaaatgagtaattttattgctgagaagtccttagaaaggaaaattatacctgaatccctcaggccctagacctcagctgcactgcggcccccttcagagtgattaacctgctgaaaggaaataaatatgccctaaaaccctaagctcactgcctggcaggttggtgattctcaacaagcgtcttctgctgggcactgtggctcacgcctgtaatcacagcactttgggaggccgaggcgggcggatcacgaggtcaggagatcgagaccatcctggctaacacggtgaaaccctgtctctactaaaaatacaaaaaattagctgggtgtggtggcaggtgcctgtagtcccagctactcgggaggctgaggcaggagaatggcgtgaacctgggaggcagagcttgcagtgagccaagatcatgccactgcactctatctagcctgggtgacagagtgagactgcatctcaaaaaaacaaaaaaacaaacaaacaaaacaagcatcttcttctttcatctttctcttcaatgccaataacctttggctgcatattcttatcctaattttgagttttgccc

SEQ ID NO: 130896 - DNA, 2259 bp, Homo sapiens
attgatgtgcttttgtttcagtctctcaaatgatgattctgtagatgtctgagtagttactttaataaggtatctttaaagcctttgaatcatagttaaagtcaggaagtcttttcatttttggctttttttaagggatgaaaaaaaactgctctgttgcccaaactggtctcaaacttctgggctcaagctatcctcctgccccagccttctgagtagttgggactacaggtgcctactactccacccggctgccttatttcatgtggggaagagttttgtaaatgtgatcaagtgacaagttgaaattggagcaatacatatctcatattcatttgacagtttgatttattagcttttattatttaaaatgtatcttctcatatacttttagacagaattgaacatataatttacggcaatcttatgcataataatgatttgtatgtctttgttttaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtatatggaatggtcattgcatttcttaaaaaccattctcaactctcaccttgacattgatcacttatattatccaaggacttagtgtctgaatttctctaagggtctcattcaaatttagaactgtaggagtatgtctttaacatgaatccatttagagagtatacaaagtgaggccaaatatctatttggtg

SEQ ID NO: 130897 - DNA, 1648 bp, Homo sapiens
aaagacctcataccatacctgtaatatttaagaagataaattttttgccgcactcttagtttttttgcccgactccagttgcaggtagctactctggaaagtctatataaaatactccttttcttcttagccaaatacttctccttttggatcacaaatgcattgataattttcgtcttagtccccttaatggtagtaggtgtgcctctctcccatgaacggatatcgctttatcagtgttaaagtctaaatgttaacagaaaaaatgaggaagattttattgccactactgtgaggtttgggttacctacctaacaagtgtagctgaacttccttagtatcatagtaagtgtgagaggaaaattatttctgattttaatttggaaagttgtgtgagttgtaaaaaaaaaaaaaaaaaaaatttgctcatttttctgtgtgtcatttggatgacaaaaaatatgcttataagctttcctcttttgtttttataggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcatttgtaagtattattgtttttaagatagacgtaaattatataatttcttaaaatttatataataaactgtagatttctcatgctatgtatttcccttttctttagtgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattc

SEQ ID NO: 130898 - DNA, 1303 bp, Homo sapiens
ccacgtggggctggccctccgcagtgcctgggcgcgctgcagtcgccgcgcctccccggccgcggcaccgcctctctaggcaggggcgggggacgaggggcaaggagtgggcgaggggtgggcgaggggcggggggcgtcactcaatcaggtggcctctggagttccccggggcagggcagagggaacacgctgccggggattgtgtacacgctccactgacaccagcttcacgctgccgggcagtcgccgatcacgcgtggccccgcgagcccattggccggcgcctcacacacctttgccgttgattggccggcctcaggctccgcccccacccccgcccgcggcgcggggcaggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggtaagtcatttggggatgcccctgtgcttcctcgcctggtcttgtctggggggccaaagggggcgcgaaccccgagccccggacatcagccatgcctgagaattggggctgcagcggagtcgtggggaaggaaagggcttcctgcctgcagactatgggcattagtgagggcgtgtgtgttcgggagggggtcgaaccagggggctgggatcttcagacagggacaggggtcttgctctagatgtactgaggggaagggacaactccgcatggagacccgagagggctggtgaggaggaggatgacgagcgggggaggagtggggagggggccgttgccctgcagcgaggttggggtacagtgtggaacgagagtcgcgggagggacaagggggctaccctcacctggtaccgaggagagatgcccggtctggctcaggaacgcgagccaggggaggaaggggctgctcgcaagcactcgggaggcggggtgtccacaggagaggcgagtgggctacccatcctgggggtctgaacccacgcttggaagacgggggctgctcagcagatagctcggggctgggggaaggggcgcctgtcgtcggagcggggggatgacacgagggcccgccgacagccctgggggacgagttgctcccccagacgtctggagggggactcttaccccaggggcaggtggccgccttctgacgactccttggaagaggcggggagccgcctctggggcaggagggtggga

SEQ ID NO: 130899 - DNA, 1012 bp, Homo sapiens
ttttttctaatgtatctaaggcccaggctagcgaacaacagcaataataatgatagtaatactgttggccaggaccagagaggcccagggctgcggggatgaggagggaatggcctcctgtcaccgcccctcctgagtctgctggagaggcgccagctcagcagcccggcagctcttcctgcctctccccaccccatgtccctgcttctgtctgcggggtgtccctccccacaggtttccttccgcctgggctgtcccatcctgttgacccagcctgagggctggagcagttggccctggacactgtggcgggagaggaagctcctgtatgcccctccggcaggcctaccttccttcctgtcgggccctcccctggggtggcttctgctagaccctccaggccagaaccctgtcccttcctcaggaatgtggggcctgctggcctggctccccagcgggctaagaagcagggagcggtcttgacttgtgagagtgattcaaaacaggaaagaaaagagaaaaggggtaggaggaacagtgtggtggtggcacaattcctagagattcagagaaacatgtttgccgggctcctcagacaacatatccaaaactagaattgctgattctactccttcccggatgcgtgccttgtctccttccagccttcaccttctctctcaaagccctggatctgattgttccccaggacccagcagttttgcctcagaaatgtctctgttctcactttccatttctaccctccaaatgttgcactagatcaatctgtcatcaagtcttgctctgattaaacaatctgcaatccccccacccaacctccacccacactccagcttattttccattgcccaagctccatactgtgactggaatggctttttaaaagtcatgatccaatcataacattctctccttaaaaatgatccatggctcctgttgccaggatatgaaaggccattcagttctgagctatccagtcagcctccaactatag

SEQ ID NO: 130900 - DNA, 1379 bp, Homo sapiens
gatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaaggtaacttgtgtgtgattctgaatacatagataaatgtttttattcctcatgttttactttggcttctatctgaaatagaggtaaaattttacatatcagctttatgtgtattaacaatcttgctttattagaaagaaaattgattctgctaaaaaatgctggaagttatatatagaacagtgaaattttggtaaagtccagtatatatgtgagcactgtttccaggacagccttttctagacacttcagttcactagcctcctaacaatttaaaacccggactaaatgaatagattgacaaattaagctagatttattccaagtaaatatgggcattaataccattaaatggaaatactgggttagagaagccacacattgcttaattccttttttcttctttttagagtatatattttagtttcctaacctgtcttggccttaagaagtcttctgaactctgctgaaatgaaaagcatcatctctttgttctttgaacactttagttaactgggtgacttaatattttggggagta

SEQ ID NO: 130901 - DNA, 1099 bp, Homo sapiens
acaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaa

SEQ ID NO: 130902 - DNA, 1035 bp, Homo sapiens
gatgaaccagccttcatgtattatatgaatgatggtgtttatggttcttttgcaagtaaactgtctgaggacttaaataccattccagaggttcacaaggcaagttttatcagaaatatcaaaacctatttggcattttataagctgagctgttatttttaagatgcttcccagttttttgaaaaacatcttagaatggggaaaaatgtcctttttgaggatttgcgttcttctggtggagtcccttttttagtttgttgcctttacgtggagttaatggtaccatcgaggcttaagtagcaccctgcccttggctctaggccttttttccatgagcacattggatctgagacagtgaaaatacttatttactcacaaattcaatacctgcgtaagtatgagtaaaaattaaattgtaaaacttttcctacagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtaaggtgattttattttaaggcagatgggatatttgaactgtccttttagacttgctaataagttttaattctgtaatgaatgctaaacttagaagtacagtcatgtattgcctatacagtgtagttacttaatgatgggaatttgttctgacaaatacaacattaggcgattgtatgatggcataacctactacataatctaggccatgtggtatattgatcctaggctacaaacctgtacagcatgttactctgtttaatactgttggcagttgtaatgcagtggcgtttgtgtatcttaagttacttaaacatagaaaggataatacattgtgctatgacatgattgctgcgatgtaacgaggtgataggactttttaaactt

SEQ ID NO: 130903 - DNA, 1819 bp, Homo sapiens
acctgtaatcccggctactcgggaggctgaggcacaaaaatcgcttgaatccgggaggcagaggttgcagtgagccaagattgtgccactggactccagcctgggtgacaagagtgagactccgtctcaaaaaaaaaaaaaatcttaaagccaaggtcccattccgtaagacttccaaatccaactttcttggtactgatgtttagatacgtgtgttttagataaatgtctagcagatgattaattctcatccattattcagaactacttttattgtgatcttttctgttctccttacctcacatgggtcagagggaggctctgttttcacactttctcacataagggccacaaagagtccctgtaatctaactcaagtcaaaccaacaaaaaggcactagacagtaccatcttgttggctaatattgtaggaaatactgttttacattaagaagacttttttttttggctgtggactaatccacagcccataggaaagttgtccatttccccaatattgtcttttttttacagctttgtttttccttgcttagaatccagtccaggaccacattgaattcgtcatttctccttgaatctagataaagtttctcagctcattactttgtattttttaactttgacatttttgaagagtagaaatttcatagctgatccttagtttgggtttgttggatgattcctcatgattaattttttaggctatgcatttggggcatgaagtccactaaagtgttactctgttcttctcacttcatcatgttaggaggcacatgatagtggccaattctaatattgatgatgctaggtgttttttcttgttgttttgtcgcccaggctggagtacagtggctccatcagggctcattgcagtctccacctcccggcttaagcagtcctcctaccttcaacctcttgcatagctgggactacaggcatatgccaccatgcctggctaggtttttttctatttttattttgtagagggtttcgtcgtgtttctcaggctggtctcaaactcctgagctcaagtgatccacctgcctcagcctcccaaagtgctgggattacaaacttgagtcaatacacctggccttatgattttttttttttttttttttttgagactgttttgctcttgttgcccaagctggaatgcagtggcatgatctcagctcactgcaacctccacctcccaggttcaagcaattctcctgcctcagcctcccaagtagctgggattacaggtgcgtgccaccacacccggctagatttttttttttttttttaatttaaatgctagttttgagcacttgtttaaggttgtgtcaggcaggtttctttccattgtgaagtggcaagtttaaattagagactctgtaaactacctgtttttaaccagattttcaccccattagttttagcatctattgttgaatttctaacttcattattgtttatattagttggcctttacttaaagaatatcttttccttccctcctgtttatgagtttagactcatagatctttattcaataggtttatataatctgttactcttatttttcccttgacatgtctccattattctcagagcaattcgttattttttggtatatcaagatgttccaggctcattttaaccttttaaatgagcctcagtcccgtaatcagttgtttctccagggagccttggtttgttttcgtggagagtgatattttaaaaacctgaaaattagtattggttgtgctaagagtagagtagctgtgagtagaatgggcgttttcaaaggttt

SEQ ID NO: 130904 - DNA, 1809 bp, Homo sapiens
tatcactagtaatactagtgaataatagtaatgctgttactcagcttgattaatgttcatttttatttatttcacaacagacacatttttgtatttggttgggtaaaattgaatgttcagttttatgctcaactgaatgtgatacgatttggtagtgcttgttacttcactatataaacataaaagtgccacatatacataaaagcacaccttattgtataaccgtggaacagtactgataattgacttattgttaagaatttttgtttatagaattacagttttatcttggcattgccttttctataaagctggtactgtaacttttgggtaattagaagctaatgcttctaatactttaaatatttggtaaagttaatggggatacttaatggtatgaatatgatgagtgacagttgaaagaaattacaggaggtgtctctacaactttctgctcctttaaatttagtattctatgtgtttcagatttcatgtttcgagtgcttgcaaagaatctcaagtatatgtacatgctctatctgatgctcgatgtgtgtttgacatggctgtaagttctttcttttaagttattttgatattttattttagccaggatgttaagttaaagactaagtattttctgcctgtgtgaattactctgactacattcaacgtgacacacacctcatttttattatataagcattcagagctctgtacagtcacaccttttaagcaggtaaaggagtgaaatagtaatttacttgcataagtctagaagagagtacaaataaaatcaaagagacagcatacctaacattgaataatctgtttctatcagtaaaaaaccaagaatttgctgtactaaagatcagaacagatatttacctccctaggagggggtttttaaaatgttctcatatccattacaatttggaaaaacatttaaattttttttttccatctctagggagaaattggctttacgatgaacatgttagacattggtggaggattcacgggaactgaatttcaattggaagaggtaaacttctcagtagatgacattaacagaataattgctttctttgttacttaagtggtggatgtgtagagcaggatttttacaatggcagaaactaaaccctataacatctctttaaaattatgttcttagaaaaggaataggcagttagtagacctagctaactttgaaaagtttgatagaattctttgaacattatcataaaacattttctatttcagttgtgtttctgtacttaatggcacaaatgatttaatacttagaaaacttcactactacctttttttttttttttttaaagtcttcctgtgttgcccaggctggagtggagtggcgcaattatagctcactatagcttccaactcctgggctcaagcgatcctcctgcttcaacctcccaagtagctgggacttaaaaaaaaaaaaaaaaaaaaattgagtctttctatattgcccaggctggtctcggaactcctggcctcaaatgatcctcctgtccccaagtgatcctcctgccccagcctcccaaagttttggggttacaggtgtgagccaccactcccagccaactttagcatttaggccagatacacgtcacacctgtttctcaccttcctgctctgccctccttccttctgtgatatctagaaactatgatttgaaaattttacttctgtttttagtgatcaagtatagaaaaatgacttaaaaaaaaacaaaaacaaataccagtgggtatttgttattagagctatttttaaaat

SEQ ID NO: 130905 - DNA, 1011 bp, Homo sapiens
aactccatctcagaaaaaaaagaaaaaaaaatttaaaaaatgcttcctatttttttccagttagagacctgctgggatgtaacaatgttagtaggaagaatgtttgcagtaaccatggaggtttagctagttagcacaatcaaagaaatttgaagacatttaaagccctgatatttttattgaaagacaatgatggcattgctattcaatttagtcttcctaggtggatttatggactgatggacttcatttgaaagtaatgtcgtctttcattacagagcccaaccaactcttgatgctacaacagagtcttaacttgctgcattttccaaaatcccatccttgtaagcttcatgctttaggccctaattgctagttttttctctatacaggattgtttttcattaggttcacttgattcatccgtcgctggatttgggagcactggcaacataatcaacacacttcctacaatcttcaggcttcacatgtgctgatgatgatgtaaaccaactctgccccaatcatctccccttctcttagggtcttactacatattgcaacagaagataatattggaggtgaagagggtaacatgaagtttggcactaccctgaagaactgtaggcatctcttggaatgtgctaaggaacttgatgtccaaataattggggttaagtgagtatttgttttaaacttttaaagctgtgaacattttatggtggtaacctgtctttctggttattgatttaagactttatttgcatgaaatctaagatgcaattttttctagtcttttaacacacatgtatgtgttttcttcttagtttaggcaaaacaacttaaatatgccttgtcccttttcatactgttttgtgactgtacctccttccccacaataaaaagaatagcaaataatattttgattcagttagtgcagagtaacttaaatcgccgccttttaaattggatgggaggggatttgctagaattcttaatgaaaataaaagt

SEQ ID NO: 130906 - DNA, 1381 bp, Homo sapiens
gatggtctcttattttaccatgttgtcttaaggtgcagttttaatggcgatatatagcttgttttatttagcatttctgattctacttactgtattaggaaattatatcctgaactgccaaagtattttaaacagtgggggaagcatgggagaaaataggttcccttccttcaactgccaaaaagtaaaatcaaggcagtttcattctgacttttgtcactgtaattgataatagtttttttatctcaaaggggagaatattttatatgctagtgtagcacagcaaaagtaatcaaatataagaagaaagaacaaatgtattcagagtctcttttaatgtttactaaatctagttaacaagctttaaatgtattactgtatgtaaatatatgtcttgacccatatatttgtggaggaaaagaggtgttctttcctgttttgatacttgattttcaatggttttttgttcatatttgtctttttttttataaccataatagacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaagtaagtatttttcattttttaactaaactgaaacattgaataatttaacttaatgtagttacagcggttagagaacaaatgcaaggaagtttgacttttggatggagtttcaaaataattgtttaaatctccagcctcatgttggaaaattacaagcttttcaagtgcaccaatgaaagggaagtttcagtgtaatgagcctttgaaacgttttatctttattaattgaaaactttaatttgttcctcattcttaggctagagctacttctagaccaaactacagcagatatctaaactctgagatttctttggtgcttctttttagtaatgtttaggccaggagcgatggctaacacctgtaatcccaccactttgagaggctgaggtgagagttgcttgagccaggagtttaggatcagcctgggcaacatagtgagacctcgtctcactttttatttatttatgtttttaaataaaaatattggtttggctaggcacagtgactcatacctgtactcgtagcactttgggaggctgaggcaggaggatcacttgagcagccccagagatggaggctgcattgagctatgattgtgctattgcacttcagcctggaatacaaagagtgagaccctggttttaaaaggggtgggggtaatagtattagaggaagcattaccagaatatgaactgtgacattatgta

SEQ ID NO: 130907 - DNA, 1161 bp, Homo sapiens
ataagacatttatctgcaattacctggcagtgctaatacgtggctgacagtatattggaagttgagactggtattttgatttcttggatgcagatacttatttcactagctttctttactcttaaaatgggtaaaattatgtgtgttataggaacgcaaaacaagataataatacagattgggtctgcaactctgtaagtaaggtgaccatataggcttgtaatacattgtgtatatatgtgagttaccccttcaaattatattgacctttttgggtaaatgtattttaattcatgtatttgcttttttaaatgggcgttaaaggaaattaataatctgatgtttctgaaattgtaaaattgcgtaaattcctcactaaattaggcacttagcacactttcattgactcgtacattatgtctattgaaataatacagacttttatataacttatattttgacagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctggtaagtgccatttctcaaatacagtgtttgtcattttccaagctctgaaacgagtgctttttaatttccaagatggtaatctgatcagaagtacttggttcatatgctatctgatttaacttgaccttcctcccccacacccactccccttgagtagtgatccatttttctttccaatccacattattttaaaatcctccctatggccctttaccttctatgccttttagcatctggcacccacatatgttctgtttattctgttgatgtgatgccagccaaccttctaatcagtacatggcttcttactcatttttctcaattttcttttttttttttttttttggagacgagtctcacgctgtcgcccaggctggagtgcagtggcgtgatcttggctcacgtgcaaccctcgcctcctgggctcaagcagttctctctcagcctcctgaattagctagaattacaggcgcacaccaccacacccggctaatttttgt

SEQ ID NO: 130908 - DNA, 3151 bp, Homo sapiens
ttgttatgcaacgcatgactatacatctggattgcttgcatatcaaagttacgggcttcttttaagaatgtgaaagagctggacagagtggctcatgccggtaattgcaacactttgggaggccatggtgggaggattgcttgaggccaggagcttgagaccagcctggggcaacatagtgagacactatgaacaaagagttttctacaaaaaataaaaaattagctggacatgatggcatgtgcctgtagtctcagctacagggactgactgagtggaggtgggactgaaggctgtggtgggaggatcgcctgagtggttgaggcttcggtgggctgtgatgccactgcactccagtctgggtgacaagagtgagaccttttctcaaaaaaaaaaaaaatgggaaaaattgagctactttttcaatacacttccagggagttcattaccaccacccctaagtttaagaactccccactgtttgttgtgaagtcttttgtccatttgtttctgagtacctattctgggctaggaatttacagcaatctcaaagccttcaagagagcatcaaagaaaataaacctccattagagctttattgtttttttttttttttttttaagagatgggttctccctatattgctcaggctgatctcaaacttctggcctcacaaaatcttgcctcagcttcccaaagtattgggttcaatcaactactttattgtagttctctgtataatgaaagaaaacaaatgttaatgtactacatctgtggattcaggtgatccttaatccattttgtcaagtactgccaatatagcaaatgaattttatttcatttttgcaacagaatgattttgtcactcagctgggacgtggttaacaactctgctgttacttctgaagtaacagttccatttcaaagatgaatagtcaactccacaaacattttatctttcctttagaagaggtcatattttttcactatttttatttatattgataatgacactatatgtcagctgttttggtttagccttcagttgattaaaattatttagcttctataaaagtcttaatttatagtgacaagaagctggtcagtggttgcctggggtggagttggggatttgctgcaaaagggacatcatatgaagaaaggctgtgagtaggcgtgataatgtttttataccagtgtgaataaacttagcatttttcaacaagtatgagtgttcatatgtctgaaaggggttagttgattatgtggatatgataaagttcttttaaagagactgagaactgtgttggatttcccaaaaaaaaaaggagtcctgtgttttatagggatggggtgctggggaagcaaggttttcatattgttttaaatgtagtttgatcattagtatctctagagctaacctacttaattattctattcctcagtatatcaatggagataataccgtcattgtggttttaagggttaagagaattaatattgaatagatgaaacacttaggctgggagactgctataaacatgtttactgttagatttaagctagcttagcaggcagtcagagttgaacctatgaaattatatggtttgaaaatatttgggaaaaaatatctttatccatatcatcatactactgtagcagaagctctgaagaatgtaggtagtcagccagtaagacttgatccagtgggcctgatgtttttataagtactgaggatcctgactgttaaaggaaaattacccttcctaagaacactatggttgtaggaaatggaggtttatcttatcctgacttaaaagctagaccttctgtatttggcagcagttgtgtgttgtcgtttataatcaataaccaaaggttttcaactaagtactaaatactacatatatattagactatgcccagagacttagcaacagcaactgagatacaattaagtcctcattgaacatcatcagtaggttcttggaaactgcgactttaagcaaaaagacatagacagcaagccctcaaataacatttcattataatgttaagaaaaaaaatggtttcgttttacctcttacttaaaagacacagtttgcaagaagctattgacataaagtgaggacacaatttacttatttttttttccatttcaaagtattttatttaggccaaaagtcttgatttcgtattttttcatttattaatagtaagataaatgaaaactggctgctatgccaaaaaggttagtgatgttaaacttaacaggaagtttctaccttattttcttatatttatctttttaaatgagtgacctttatttttttaattgttcttagtgctcagttgaatatccccccaaaattggtgctttaaattgcttaaaataaacatgtattcttagcctaaaatgtctatattttctgggcacagatttacagcagtcctgttataacagtctttagagaatgtgcaggctgtgatttgacgtcactgcacaggtattaggtctatttagataggcctcaattaacttggtaaaataaaaacatcctaaacttttcagtctgtgctatatggcatgaaagatctgatgagttgaactgaatgtagttggcttcttggaaatgaagctgttagtgtttgaaaagttaaaactgagtatttgtatttcatgaaatttgactaatacagcttattaaggactgttttggtgcagccaaaatgctgacacttttaagaaccatcgaaatggagtatactttcaggacagtggccatcacccaagggtgaactctagtttggggcattagggagggtggaggggggtggtgggaggaatcaaggacacaggaaaggatgtgcaggttttaaaacaggctgcccagacagctggtcaatggccattattaatgtggcaaccagaaattagtaccagatattgagtagtatcctgtctggtggacctgttttatctcatttatgtcgaagttatttcctaaagtaacctaaggaccagtgaagttcaacaaagaagataaacctttatgtcagtatagtatgtgctgccttaggacaatgagtgctccgggggagtgggcaggtttatttcattgatttgagtggagagggataggatttagcc

SEQ ID NO: 130909 - DNA, 1506 bp, Homo sapiens
catgttgtattgtaatagttatctttaatgttatcacatcttaattgccaaaagggatataaatatttcacttgagtgcaggtacacacacactttagtacacacacattttctccagaaaaaaaatttagtcttcacattgaatagtcaagacatttttaagggagtctaattgtgttaattccacgtgcaaaaataatattgctgtgagaattgtgtattttgttttctcattaagctacattttaatatttatggtgaggcagttcattgggcagtctttacacaggcacttcaaacttagcctgttgggcttataacttttgggattttttgcccccttatatatttcctattcattcttgttcttctcttttaaaataaatctttagcagtcacctttagtcttcttcctctaaggttactcagttttttcaacctcatcacctgaaaaataagtttaggggtatgcattgtgattactggctttcttattgaagcaagccttgtcctgatttatcctgagtactcaatgtaggctgttgttattgtctatcacttattttggggtccagggtggcagaagtttacctgatcttatgatcactaaatttataggatttcctaccagtttcagtatatagcttcctggaattcttttgtagtgtttcagacctactcaaggtctcacatctatggtagatgtcattctttagaagcttctagtgctcttctggtcaattacttttaaaggtattctatgtggtaagtaacattttctgttgtaggtagaatgcagaggggacttaagcaacgttgtatatttttaaagctgtgagctgggtgctaagtcatcaaatgcctatgtaaaaataaaagtagaaatgcacctaggcatcttcagagtaacagtaatagtgtaaatttcagaatatcttttctcatttttaatgagtaaaaatccttttagaaaaatggttgatgtattaaggttgggtttcctgcttaggtatctctgaaacagtattctcaacctttcagctctccctgttctacttccagggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcaggtgtgtaacaaggcaagtgcccagctcctgcagccactactcttggagctaccctgtcgatgaacatgaggactcagcggcctcatgaaaggctccagggagcagtgtgtggttctttggagccttttgtttcttttggcagctcttcatggaaaaatgtattaaaaaaacacccatatgaaggtgtgaataagggatgttacatattttttcttctcagttatgagtctaagaggaaattattaataaaagtagtattgtggttatacgctactgtattagtgtaaaataacctgag

SEQ ID NO: 130910 - DNA, 1050 bp, Homo sapiens
gttctgggtggttccaaactattgggtcatgctagtacattattcatataaagtcttgtatatacactaggttggtgagggtacttggaattttttaaattctggaccacttaaaaatgtggaattttagaggacaaataaaagcaaaaatgaagttttcatcttcaaaaatgaaggctggtaactcttgagtaggcagataaaacgacttggtaagatggctatgacatcaagttctgtgaattttttatagcagcttggaaatgtttactgcataaagtacttggtactgtggtaaaccctttgaaaatatcacttgtgtaatgtgactttaatgaaacattgttataaaatgaacacgtattctacagttcatgtttaagtcagcctaaacatttttttaacataggactatcttctgctacttttatttccttcttttagggcgaactttctgaccaagtatacaactacccagagggcctaggagaagtgctgtatagagagcagttcgacttcaacgctgagccaccttgggaacctagctgatgataggggggttccatctcccaacttgtccatgtaagtatttgcacatttgttggtggggaggaggtctttaaaatcgaaggaagagtgctgccttgcttagtatttttcagaatttgaaattgcatttacctcttaaagtgcagtgacttttaaatttctgaaatagagataagacagttactggttacagacttgactgatttagttgtgtgcattgtttaccaatgactggatcatttaaaactatcttgtatgcataacttagaaaatatacgttgaagagggcttttgggaaataaggtatagtttatcacatcattcaaccatttaacttagtgaaatgatttttgctactcagctggtaggaacaactaactgattgtttttagaggacttgctgaaagatgatagagatagatagagatacatatatatatctcaatttatatatgtatctaaatatgtatatggtattaaaatatatgtatggtattaaaa

SEQ ID NO: 130911 - DNA, 1876 bp, Homo sapiens
caggcccactctaggccgcacagggttcgcgccacctccggcccaggacagctctcagacgctgccagcgtggagctcgacccggctcacaatgcgctgggccccgcagcgtgagcgcaggcgcccgagaggcggcgggggtcgggcggacggcgcgctccagccgagccgcctccctctctcggcccacacccgcgcggccgcccttcgcctgccggggagctgcgggtggctggagggcgggaagcgaccggccagtctgcacctgcatgacccggtcgcgcgccgacccctcccctctctctcccgggctcagtcctccttcctcttccgtccccctcccttttctccgggctgcaaccgggttccgccccgctcgcgcggctgcccggccagctgtgatgtcaccaggccacgccccctaatataaatactggcgtcgctggcgccgccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgtgagtaccgagccgaggagcgcgggaggggccaggacgcggggctggccttggggggcggctggggggctccggctgggccccgccgcccttaagacgtccccgcagcgccccgcggccggccgcctcgaacatggcggcggcggctgtctgtgcccccggcggcggcggcggcggcggggctgggcggcgggccgcgcctcaggaccttcgggcggctgctggacgcttggcggagccggagccgcagcagttggggcgagggggcgtgtgccagtgggggagcgcgcgggggtctcgccgccgggggtcgccgtcccctcctggcggcgtgcggcccccacccctctcccgtggtgcattgctgtttccggggagggggcccggccgcagccctgaggggccggggtcccgcagcccctactccgcggtgcgccgccgccacctttgcctcccgaagcccggcgggcgggcggcgctgtgggctgcaacggctggggtcctggttatgaatggagcggggcgggccccgcgccggcctctggtgacagctgcggaggaagtcggattcctggggggcgcggggagcgcggtccccctctggtggaggaaagttgacgccacttggggcctggcggcggggaagccccggtgtcaggtagccagcgagaggcttttggccccttctggaagcctcgaggctgctgctccgcccctgcggcgctcctgattgggtcaagtcgccttcactcaccccagtcacctcctggagcctgaggattagtcaccatggcttcgtttttccgtccgcgccatggttcctaggcagaaagagggagattggtagacgggtggcttatcaactactgtcttgactgccaacagttggtggtggtaacatgttctaacccttacacggtatcctgaatgtgtgtttcgtagacaaagctgctggttcagaaacccgaaacagtcggggacacagtttaccgcctcatgtttcagcacatttaactgaattttgtggtggcatcttggttatattagttctgtgtcccgtc

SEQ ID NO: 130912 - DNA, 1030 bp, Homo sapiens
gaggcaccatttggtgcaaaacatgcatgtggtgtcagtttatttgttggacaaatattaagatgttgaggttacagaggttaaaagtaatattttaataaactgcatataatggaattcaagtaatttaaaatctagtgtttgatgttttaatgtaactcctttagtgtaaaattactgaaactatatcctaatatttctttgaggcacttgtcttttgtaaaactgcatgaataactcaaatagagtccccttaatcccaataaaatgtagtcactaaatgtctttgggcaactaatttcaccagctgttccctcatttgcaagtgggggtggtgataacacatcttgtgagggaattaaatacaaaattgctttagtagatgcaagtgcttatcactgggcacaacatgtggtacatattcagtgatagttgttaccagtaaacagaatctcaagcttacttagggtcatgagttggagaaaactaatcttaaagtctttaagttggtgaatttcaggccaaaatacattgtattggagatatcagcaccttctagcagaatgtggtaccgtggtccagtcactattataaattgccagccatgaagaaaagggaagtcatgttttgggagccatgagtgtagattcagggaatcccctggcatggaaggaattatttgcccactgggtcaccgctgagttgcctgtgcagaggaggagtctctagaagctgagaaggttttggtgattacttgcagtaatgggtgtacgacagggccctcctggccatgtctgccaattcagtagctttaccagaagttactagaaattttccaacattgtattatgtattacatccccagcccccactccacaatgtcacagtgtgtttccagtttttgtgataggtatctgtgtgaaagtaaggctttgcttttacagattgctttctaggcaaatgtggaataaaaaaattgtagttgataaaatgagtctaataaagattaaattgcctttcatatttaagt

SEQ ID NO: 130913 - DNA, 1037 bp, Homo sapiens
aatatttttggagttacggatacctttgagacaagatgtttcctccaaaacgtactcacttatgcacagttttgcatgcaaatttaattacagaccctctagcgcacatccgtggacctcctacttaagagcctgtgttgtaaactaagacttcaaatgatccagtgtcattgaatagtacaagcacagacctgtctttgaggagtcttcaagtcttaagtggtgcttataaccatgaattaaaggattatcttgtacatataaatagctttgaaatgtctggcaaacatcttttaactgtacttacacattatgaaataaaatagggagaatttaagatttgtgagaactttaggtcaagatgaatcatcttgttttttttttttaaaaaagcatgccacctaaataacaatatattttccttttaggttggcacgttggatgtcttggttggcttgtcagatgaactggctaaactggatgcatttgtagaagggtaatgtacttatatgcatggagtagagcaaaatgggagacactattatcaggcttcatggacactgggtttattatcacatgtatactctgcttattggaatggttttagaaaacgacttttttcccttcgtatatcaattttatgaaggtacaatttacataaaatgcacctgtttgaaatatgaaaatgctgattctctttttactatctttaatgggatatagtttacatgccatgcatttcacctatttcaggtgtacaattcagtgattcttagtgtattcagacttgtgtaaccattgccacaatcagttttaaatatttcatcatcctctattcctgttcccattagcagtcacttaccgtccccaccacccacaaattgttctgccactatagatttgcttggtctggacatttcttgtaaatggaatacaatacgtggtcttttgtgactgtcttcttttgcttagcataatgttttgaagtttatcccagcagttgcatgtatcagtatttcatttctttttattactaa

SEQ ID NO: 130914 - DNA, 1484 bp, Homo sapiens
agtattcttctgagaaaaacagcttttgtaacatttatgaataaattcaactataattttaatttcatagaaaaatactctgtgtaatagtgatgtttgcagtagtcaaaactcttcatgtaatttagtttactttggaaaatatccttcagtcttgtgaattgaagccttgtaaatagtaatctccaaacccagtggcctagattccatttccatggtttaagaagtaatataattaaaatacatgtggactaaaacattatttttagttgaaaagatttatgtggaaattatatttaaaatgaagtcggctgttttttaaatgacctcctaaagtcgtgcttttaaaataatagaatattcttacactagaaactagtgggtttttttgtagaagttaaagtttagctactttgatagtattagtagaggcagatttaggaaaattttatctatttttcttctttttctttttcaaagggagtaactcagattgataatgacctgaaatctcgagcatctgcatacaataacctgaaaggaaatcttcagaatttggaacgaaagaatgcgtaagcagatcaagtatatttgagtactaagaactggggaagcatactagcatgcaccgaaggagatattgttgggatttagttagtttcagtttatgttgttctgtaatcaaaatggtatttcttttacttcatggagaaaagctcactaaggtaagtttatagaattcagactagtccaaacagatgtgaggctgatttattatacttgttttataaataatacttgtgaactgggtcctggcttattcctttatccatttgatatttcactgaaaaatagtctaaaattaattgttttaaatgaaatcatagtttaactgcatagtaattacctatcacttaactatagaataatccttttatgatgtaatagttattctcttatctgttttcagaatttaggtttttcacttgttaggttttttaaaataggactgaatttttttggttgatccccttgtactatgactacttcaagtgcaactttaagcatgaaagtattcaagttgtgccttcatatcctagagggaaagttggttggatactgtgagtgatacaaacagggcaagacatatttattatgggaaagtgattactggaagacaaatgaggactgatttgaaagagttaattattgggttagctaccaaaattgcctagtatcaaatgatacccaagggagggaagaacactaaaggtattgtgcttagatgacatagtttcataattatatgatggaatagactttaattgatatctaatgagtagatagttttccagtcaagatattatatatgtaggcaagagaagagctgagttataataattaaagcaaacacaaaacactagaggcaaattttggtagaagatatttcgttggttgcaagggtaggatatattcagctaaat

SEQ ID NO: 130915 - DNA, 1028 bp, Homo sapiens
cgtagttgtctctccccacacccctggaagccagtggcctctagagaaggttgttgcacaatgttttgtggcaacatagtttactgtcacttcatttacttactacctcatggtactctgtgctttccataaatatagttttttttcagtccttcataatggccactgagcaggaatgatagtgattttagcatgaccatttttaaaaaatgaggcacaatacatatgaactatgcagcttgaaaacaatttagaatctatactgtgctttacttcctttccgaacatagttctaggatgtgcctcttttgcaatggttactggaggtagggtggtgatctgtttttcctgcattactcagtgtatttgaaattcattctcagtaggaaacccgaattttttttgttaaatagagttgaagtatacttactatagccagatttcctatttgtctcataattttttctcttcctggatatggcaggaaataggacttgtttttcttttccaatgtgtattgtaccttttctgcaggttaaaccacaacgactggattaagcagtatgaaacactagccgaaatggtagttccaaggtctagcaagtaagtagaagtctttgtaaaaccatttgtttcctagaattccttttagagtttggatgttggcttaggaaatatgtttgctgtcttgcctttgtgataaattaacctcatgagtgagttctatgaactctagttgtaataattttagacctagaagggacttggcacagtctgtttgacaacctcctgtttatagacttagaagtttgaggccagtgaggtattaatagtttgcccaggatcacacatctcatttgtggcagggctagaactagaacctaggtctttggtgtggtactttttctgcctcactgtgctgccttttgaaaattctttattcattattgcatacctactatgtgtctataattcctcattttacttggcaaaggaagtgtaccagaatggctactggactgccgtgt

SEQ ID NO: 130916 - DNA, 1079 bp, Homo sapiens
tttttgtattttttgtacagacacagtcttgccatgttgcccaggctggtctcaaagtcctgaactcaagcaatcacccacctcagcctgccaaagtgttgggattacagacataagccactgcacccagcctgtcagtttttgattgagagatgtcatgggagcaaaggaaagatccaaggtttaaggtactggcaatgcagagaggctaggctgggcatcagtggggctgagttggcctggagaaaggaagaaagaattaggcttccagaaaagaagagtgtgcttatcaaggagacactggaaacaaagcagcttggcgctgatgttgattgaaaagtgtggttcttagcgtttggatgctttactggagttaatgtctaattttgttggttagtaagaaataaatgtagagtgttaaggtatcataagcaaaataaatcataaacattcagtatcttcggtgtttgaggcaatccagattgaaaagcattgaggtgatttgggaagggctattataccctacttttctcttccacctgtttctgaattttgcccttaatatgaaagacagcaatacgtataaatctttaaatggactttttttttttccatagtgttctttcagaggaccaagacagttacctgtgtaatgtcaccttgtttaggaaggcagttgatgacttcagacacaaagccagagaaaacaagtaagattattgtttttttgtttatttactttgttagatcagctgtatacaatgtgaacaattttgttttttttcccccaaatttagattcattgttcgtgacttccagtataatgaagaggagatgaaagcagataaagaagaaatgaacaggctttctactgataagaaaaaacaatttgtatgtgtttttaatatttagtattatcagtactaagcagaagaaaaagtggtattgctttcctttgatttaaaagaaagtaaaaatctgctttggttttaagacatttgattttagtttttttttttaattgaataatcagaatgaatttcctctaaagcttaactgttctagagataactattcta

SEQ ID NO: 130917 - DNA, 1079 bp, Homo sapiens
gtaagccaggcgtggtggctcatgcctgtagtcccagcactttgggaggccaaggcgggcagatcatgaggtcaagagattgagaccatgctggccaacatggtgaaaccccgtctctactaaaaatagaaaaatcagctgggcatggtggtatgtgcctgtaatcccagctactcaggaggctgaggcaggagaatggcttgaacccaggaggcggagattgcagtgagccaggattgcaccactgcactccagcctggcaacagtaagaatccgtctcaaaagaaaaaaaaaatgaatggtaattgaagtaattcctagtaattggcgtagagatttctagtggacagtggggaccaaaggtttgcgtttctgtttatattgaagttttttgtgtatattagtttcagtttctatatatattagttgaacttgtaaaggtaaagggagatattctctccccgttaaccatgattaaagagtatgagaatatttgctttgaaaagaaaatctctttacatgtttgcttgtattgcgtactgtatttctgcttttttgtaaggtatggcttgccagtgaacttccaagcaatgctacttcagcccaataagaaaactttgaagaaactgagagaagtattacatgaattgtataaacatctagacagcagtgcagcagctattattgatgtaagtacttattagcccagtagagtaagaattgaagtgaatttcagaaaaaaaatgattgaaagaagatagacagaaaagggagggtaagtatgaaacttaatcattttttattactttgaggttctcaatttgttatgtaaacatagtaatttacattgtttaccctgttttatactaattatatctgtgttttgcttcttggcatttctacaagctagtaattatcttgctgtgtatcagatgtttatagctgcagaaatacagaaaccagtgatactagttatttacaaaaactataaattgcagagaggaagaaaataagcagttattttaattttatttggtagaagcgatagagtcaatagatgagtattttcaaggtaggtt

SEQ ID NO: 130918 - DNA, 1267 bp, Homo sapiens
ctgtctgtgtttcctaggagaagtcagtctttcagagattgttttctcatttgcaaaatgggaataatgtctaactcagataaattagccttaagtgcatacatttagcccagagtagatgttcaataaaaaggtaaatgttaatacttgctttctttttttgagttctgtaaatacaaaattgaataattgtctgttttttccataggctcctatggatattccaggtttaaacctgagtcaacaagaatactacccctatgtgtactacaagattgattgcaacttgctggaattcaagtgaaaatgggctcctcccccgacaatcctgtccttgtgtttgtgtgtgctaacagaaataagttgcagtatggtcgtacttttaactctagtatcctttgcttgcttcttacgccctttcctaggtgaattctcccacagtggtctgtatctcaacattttctttttaaaggaaaaaatatatatatatagtttctttttattgatcaggtctgtaaatgtgtactaaaaaaatcagagtttatttataaacaaaatagtttatttaaagagaaggtctcttccttattgatatcatggtatgcattaattccatttgttactattgtgcacaaaagccctgttcacaggggaatggtgtaaacatttatactgttttgttcactgtatttagtagacataactgttgaatagttactgaatcatgatgtaaagaatatgtgaccatcttcaggtatgggatttctgaacgtttcaaatttcaatcaatgagcactgtcaacacccacaggagagaataaaattacctgtgcaaaggtgtattgtggtgtgtgtaacttaagattacagttctgtttgagagttaaatgatgtcatagctcacttgctatgctgcttccaggattttgttatatgctgaggtgtaaccatttgtgttgtctgactttcgtatgatttaattgagccaaatttgggtcagaacacaaatttgaagatgacttttcagtatatgatgggtatttacatttgaacactagaattttaggtctctcaaataattaagaatagagccagttttgaataaagtctagcagaactatgcagctttagtcatttgttttgtctaagtctgtattttatgtgttgtcttcttaagatctataattttggcatttatgtcatttgtgacatagtctgaaaatagagacattgttggcctttaaaatctcagaaatgaatgacttaa

SEQ ID NO: 130919 - DNA, 1027 bp, Homo sapiens
acacagtttatttttaataaaataggattataccacacacatcctgtcacttgcttttttgcttaagagtatatctaagagaatcctttgtgtcagtgaagctggagctacctcattcttttaactggctgcgtggcgttccattgagtgtctgtcatcatgtgtttagccgagtggatggatagtctgcttgtttttagtttttgctcttaacaaacactgctgcagtcagcatccttgcacagatttctttgtatacttgtattagtatttctgtaagatctgagaagtggaatttgtagggtcataggttatgtacacttaagtttttgacactcactgccaagtcatctgtcagaattctaaactaaagacatgtttggagtgtggatttatcttcagtttttctttggacaagaggaagctgtgaaagattttgctatcagaaaattttggttctttgtcttttgcacatgttctttgagtcttagtatctgtaacgtggcgctactctctctatcatgggggggcatgttttgacattaaattgacttttaagaaaaacatgtcactaacctgaagctcagccacacagtgacttttaaggttttatttagactttactgttgttctcatgagagtaggtacagactgcataaggtttagaatcccagcatatgtctgaaacgacgggactttcactgtgatttccaccagagaaattatagcagagtggctgagcatgtgctctgaggccaggccccagctctgctgctgacgagctgtgtggtcctgggcagagtggtctccgagttccagtccctcctctgtaaaatgggcatgattagagtgcccaccgcattagggatgttggggtgagtcagtgtgaccccacgtgcacagaaagtgctgcgagtggtgcatggtgagaggttgatgcaggtacttagcccttggggaacacaggtagttccttttcactgtgtttaatttgggaaaatccagatccacatcattgtagagtctg

SEQ ID NO: 130920 - DNA, 1042 bp, Homo sapiens
gaaatgtggctagtgtgactgaggaactgaatttttttatctaatttttttttgagacaaggtctggcattgtcgcccaggctgccttctgggctcaagccatcctcccttctcagcctcccaagtaactgggaccacaggcacatgccaccacatccggctatttttttttcccggtagagactgctcaccatgttgtttaggctgatctcaagttcctgagctcaagcaattggcctgacttggcctcccaaagtgctgggattacaggtgaaagccactgcacctgaccaatcttatttaactaattaaatagctacatgtggctggtggctactgcgctggacatagaggtctagttggtcacacctggctaatgagcctttttgaccttgagtttccaatatatcccatatcctttggctttttttgtttgtttttttatgactggaagagccagccttgcttctgtttactttgattgctagatttaacatccccacaagcctgagaaaaagagaggaaaggattgctcttggaatcattgttggtgtgcctcagattgctacgcaggacagcattctctttgatcacaaaagacaactacatatactttgtgcattgatgtgcacgagagtaaactggttgtcatactgaaagaccagaagctgtttctgatgggaaatattgaatcagcagaattgaaaacacagctgtgtggttctaatgggaatataatttcttctgtcaatcagtgctcacttagtatccattgtgtgcagagcattcactattccagcctctgcagggagacatcagggagatgctcaccacgtgcttttgaatgatattatttgtctttattgactctaagaaatgtaagaggttcataaaacattgaagccattaaggccttatttgagaagtctagcaactcacagttgcccttggaaagaggcaaataggaaggggagagccctctgtcagacttgttttccatcggtgacatgtggcatggattttacctcctaccgttagctgg

SEQ ID NO: 130921 - DNA, 1021 bp, Homo sapiens
agaggtgcagcttccttagcaaatgatatattccatgctaaggcaggtggaagagtatctcgttaggacagaattttccgttgtttttccagtgtttgttacctggggtgaaaatcttaactctgcactttgactccacatttgagtttatgacaaatgttgctgatacaccctccttttgtttttacagtaattgacccaggactcattttcaggaaagcctgaaaatgagtaaaatagtgaaatgaggaatttgaacattttatctttggatggggatcttctgaggatgcaaagagtgattcatccaagccatgtggtaaaatcaggaatttgaagaaaatggaaatgtttacatttttgttgacgtgtatttttctacccctcctaagagggcacagtctcttcacctgtgaaccaattactgttcccagatgtatgaaaatggcctacaacatgacgtttttccctaatctgatgggtcattatgaccagagtattgccgcggtggaaatggaggtgagtagtgcttcatacgtttattgaatagtagtttatgctctgttctagaataaactagtaaaaataagtctatttttaaacagagccgatttcttcaagttgtgtacaagttgtgttttgaaaagtccttttgaaaattaaatccctctactgacttatgttttgtgtacctttgcggccctgtttagtagattcgtttgaatagggttcattttatataatgaagtatggttacacatgatttctaaataccttgtacctagaaaatattttgctttcctgaatcaagtatgatagttcttctagaaatgcgaattctgaatatttttctacttcactgaacatgtaatatttattgcctggactaaaactgaagaaatttacaagtttttataagtagttgtaatattcacttggtacagtttttctgaaataaataaattatcagaatattttgttgctgtagactgtattttaaggctatcacaaagtcactaaa

SEQ ID NO: 130922 - DNA, 2192 bp, Homo sapiens
ttagctctacacatattcattagaatttgcttaaagaatttgatttttaaccatttctagttatttatatgaagtaaaggaattcaacttttgatcggaccgttggattataagctatatgagtcagttttttttttttcaaacattgtactttagtccttaagtgtatattccagttgagtactaaattatagctgcttgtaacttggcttttactaaaaatgtgttttatagcttctctaaagatcagattgggttttacacctccaacccgattacctttagtttctgctggttcctattgaatttccaggattcactgtgaattagtgttaggatgaggggctgaaaaattgcctgatggctatggcaatgaattgtactctcttagtcactgagaattccgtataagtcaaaagatctatctcactccttttttgttcctagttttcattttgtaacagctagcctgttttatagaatttaagcatttatggtcatttttaatctgtgattatatgagatggtttagagcagtggttcttaaactttagttcatagaccagcagcttgtgagcttgttggaaatgcaagctcacagactcctatcccaacttactgaatcatgatctctgaagatggagcgcagctgtggtttcacaagctgcccaggtgtttcttttgagtgttaaagttcaagacccactggtttagaagtttggattgcaaatttttactgtaaaagaccaaattattttgactttccagaccatacagtctccgtcacagctattcaactttgaaattgtagcacagaagcagtcagacaatatgccaacaaatgagtgtggctgtgtctcaataaaactttatttacaaaaacaggcagtgggctatatttggcccaggggctacagtttgctgaaccttggtttaaagtacttgaaaatgttttaaggatagtatagaatgaaataagtggacattattgtgcattcttatgttaatacattaactgagttatttgttacttactttccacataaattttttaaagtaaaatttatcacaaaccaaaaggatctgactgggacatcttggttctttagttttgtttcagagattgcttaaaatgagggacttcagttttttcctaattttattatgtgaacctgaaatcatttgtattacaaagagttaatttacaattctgcatagtaacggggctttgtaatgaaaaggatgtacagtctaactctcccaagtggaaaaacaaatggctactggttttccattgtgttccttttgtttcatatctagagcattgtgagattgaggtcccttgagagactgatttcatccagaaagagctgagactgatctagggaaaatggaaacaggaatgttgtatttttctttttcaattgccttcattgaggtctaggcaaaagccaggtcacgtattgtgtttggagcagcaagtggtcattccctttttaaacagtctaaagggaagtgggccaaaagaaaaaaaacaactttcctttccacctgttaatatgtgctgttagaatgtctctattcagttaaaaataaatggagaaaaactggataaacagacttttaaggaaaatatctatttctgttgtatagtggcttttaagcatttttattttcctgcttttagaagagtccagtcccttcctgctttcacctttcttccatattctctacccttgtatgtccatacacaaataaagaaaatgtttagtgagattaacctgtttgtttttcaggaaagactatctgaaaataactgtagctattctgaaagtaagacattaatcatataaaatgaaataaatagtgagaagtgttccaagccagttgcgtgtataatgactactgttgtgttttaaaggtagaaaccttccttcgtgatgttgcattgcagtagcagggaaagtcccttgactccttcttttgaaactgcagaataagggcaggcctgtatgtgaagagaaaggatatttctcctgggaggctctgctgataagcacaaggttcctagtccattccttagtattccatgggaagactgttgtgattatttcctttccccaagaatgtggcatgtaaataatgaagctttattactctaggttatatatttgtcatgtgttcattcatat

SEQ ID NO: 130923 - DNA, 1037 bp, Homo sapiens
gtgattgaagttctgcctgctagggccacctctgaatggagttataatcctatagtagctcacttacaatagctggggccagctattgtaagccaggctgtaattgtttcttcatgagtcatttggtgagagggaactctgcttgaagacgtaggtgtgttttaaggaaagaattataatatggcagaagcaggcattctgagaatgcaagcaatatgctactttcccgtatctttgagatctatccagccacttgaagatggaatgcagttggtccctgacatcatgagtaggtgagttcagtaacactcaattcatgagaggtaacttgacctgatgatctctagatgttctctcctgtttagtttctatgaggaactagtagcaaaagccaaggtcccttttaattatgtagggttaatctcctcatctgcacttgtatcttactatggcatctagggtacatgtctatggcctcatcagctttatgtctttgataagttagattagtgtgatgtcctgtgaagtcggtgatatgtttcactgactgaaattgaggcacagagctgaagagctgatgatgttcccctaaagctgaagctcttaagctttgatgtgcatcagaatcatctgaaggacttgttaaaacacagatcactggctccatccctgagttcctgaatcaataggtctgggatgggatggaaaaattccacatctaacaagttcctaggggatgctgatgctgctcactcaggggccacttgttgggaaccactgctctaaggcaagttggcaaagatatgctgctgtccctactgggtgagaacaaattgcttttgtagaagaaagaactggctagcttagagaggcatacaaagtgcctgagctttactatttgctacaggaaagagaccacatctggagaatcaccttagccaattgagttgaggttgcttaagacaatccactggaaagttgaaatgagcaggtggtaggaactgttacccctgaatatgtttctagtggtgttgcca

SEQ ID NO: 130924 - DNA, 1413 bp, Homo sapiens
tgcactccagcctgggccacagagtgagaacctgtctcttaaaaaaaaaaaaaaaaaaaaagtgttaacttaccaaggagaaaatttcaccatagcacctacagttgttttgaaattgatctccagttcttctactcaattctttgttaccctcttcataaacttttgagccatagaagttaggtatcataaatctccttagtgatcatcgagttcatcactgtcactttactgatggatactctgagactcagaaacagaaaactacctgccaaaggtagcacaggtagttaaactaaatagttagaattaaagtattagaattaaataagaattagaacttagttagaaataaaatgctagcattatttccagtgaaggattatagaaaatactctatgtattttgattctcatttttcatttatcttactgttggctcaggctgtttttcacgatagagatgtgaattgccttctcacttgccctcttctttctcatctctgccagtactaatagtaactgctatttccagggatttctgccagggactgaccatttccttaaaggagcctaccttttatttcttgatttttgaaactgtaattaataacgctgttttagttattgaatggtagaatctcagaaccaatattaatagttattagatgagttttttgagaatgaaatttgaaaggaggagtttataagtgagatcatgaaagcactgggttactaagagagttgaagaaggtggtgtcactaaaggtgagtaaaaggaacagactgatgcgaccaggtttgatatttgctcaattcatagatttgcactttaattcatgagtttaattcacaggtttggcacttaacgtgctaaatcctagtttaatgatgtgatgaaattcatagcataaaattaaggacataagaaatatctcaatgagtcatgttagatttggtttctgagaatggtacccaggacattttgaggaagaacataaaacatttcaatcacaatttttacttcaaaagactgtgaaaatatgttcatcccagttatgtttcaactgattggtataatgagttcaatactaggctgactacccattatttaaagtgctgtgatttgttctgaaagtactccatatgatggaatacttgctcttgcttcaggagataacgcatcatctggaatgtgatcaacatagcttgaggttttatagtctttgatatgtatcctgtgaacatttattttttttaactgaagagtttctttcatgtggaagagtcccaatcctcttgatatattttcttcccttcatcctcattggcatttttgcctgtcgctgtgctttgggaaagggtaattttcagggagaaatgggtagcagcacagagtgaaggttaaagagga

SEQ ID NO: 130925 - DNA, 1190 bp, Homo sapiens
agaagaacaggttgtgataaaggaaaatggtatatgaaaaagcacagtgcctggtttatggtaagtaccaaataagccaaagctctgatttattatcagtagccatagaattggtaaaagtagcattcgatcaggaataaagatacctaacttctaattcagagtacattttggaatgtgagtaacaattttaataagaaattggcttcagttttctcacttgatccaagggcttagattaggtcagtggttttccaattgtgatctctggaggtgctctgaggtcactggtagcaaaggggaatggtgagaagtatctcagcagggagagcttccttttcagcccaagaaactatgcctttatttatttagtatatcggcctccttttaacttcttatttaaagaaaatgtttcttggcaaagtgtgcatgtgtgcacacacagacacacatacacttcgaaaataattaacttaaaggttttctctcaagtcccttccaagtctaaaattctttaagtctattcatctgcaactgaacttggaagttggtagcccacactggatctgacctgagacttgatttttctgtgtgtgtgtgtgtgtgtgtgtgtgtgtgtgtgtgtgtgtgtcagggaaggggggggccctgtttcaaatgtatagattaaagtgccaaaatctaaaatttgggaaattacacataacaatctaggttctgttttcttaggaaaaatggatatacctgacaattctatgcccccatttccaaataatagtctgctggagttgagtagcagcagcttcccaaatactccctatcatcttacaggcattttcatttacctgcctggcctctgaaggtatctgagttttcagcattcagtttatcctctacacagtgcaggaacatcaacattattggattagccaactttggcactgtaaaagaattaaattagggaagtgacttgtgttttccatgtaagaaaattgtttttgtatagcaaaagtacatgtattgcattcattttgcctgcccttgaactatataattacttcttaagtgctgaccaccagttaatcatggcttctgagttagaagaattaaataaacatagtgtgttttaattctttccaccaaaggatctgattaccacatagtcaaaaaatttaggaactaggcttttt

SEQ ID NO: 130926 - DNA, 2198 bp, Homo sapiens
aggatgggcaggaatgcctctttgaggtgaattgagtggagactcaaatgagggcacaagactcactatctgggtgaagaggtgaggggaacagcaagtgcaaagactctgagacagaaatacacatggaactataagaagtagaagtccagtttagtggcaatggagtaaataagagacaaagtggtcagaaatgaaactggagacatagcggggaacacggaaatttaaaggctcatgggaattggaaaagactttggaatttattttactggagtctttgaacaaggataaacttacgttttaaagaatcgcattggttggaaaattgactgtaagattagcaagtgtgggaagtagtgagacctgttaggaggccattttagtagttgaggtgaaagataatagtggcttagactgggtggtaatagtgagaaatggtcagatttggaatatactttaaagggagagccaacaggatttgctgatgggttggagatggagtgaaagaagagaggagtaaagaataagttgtaagaccagcctggccaacatggtgaaacttcgtctctactaaaaatacaaaaattagccgggcgtagtggcatgcgcctatagtcctagctgcttgggaggctgaggcaggagaattgcttgaacctgggaggcagaggttgtggtgagctgagattatgccactgcactccagcctgggcaacagagcaagactctgtctcaaaaaaaaaaaaaaaagaaagaaagaaagaaagaaaaaagaatgagttgtaagattcttggcctgagcaacttggtaaatggtggcattatttactgagatggagagtactaagggagtgtttgggaggcagagatacggtgggattgagttgtattttgcatactttgggttcaagatgcccattaacagccaaatggagttgtcccggagcagatgctcattcaagtctgtggttcacagtagacatggggactggatgagtttcccttgagagtcagtagagatagagaagaggtcttggggactgagctctggagcatttcaatgatcataattgggaaatggaagaggactagaaaaggaacagccagtgagacagccagaaatccaagagaattcgtgtcctagaagacaagtgcaaaaggggcctcaagaggaagctaggagtcactgtgtcgattgctgttaagagctgagtagaagggatgttcagaatttaccatcagatttgacaatgtggagtttgttggtgactctggcaagtgatttcactggaataatccatgtcttcttgaaaaatatatgattgaataaaatagtagtatcccattgtgtatgaagagttcataagtctgatagagggagatttaaagattcttttgcagtataagtgaaaaagcatatactttaaacagtaaatatattaattttattcatttgttattaaaatgttttctaactgtatcttgatgtctttaatagcattttcttcctctcgcaaatctggaatgttcaccaaacattgaaactttcctctgcaaagcatttgtaccaacctgcatagaacaaattcatgtggttccaccttgtcgtaaactttgtgagaaagtatattctgattgcaaaaaattaattgacacttttgggatccgatggcctgaggagcttgaatgtgacaggtaaacaatgtttttcatggaaagctactaatggtattttactactggtactagctctctgggatgttagtgagaagctttcattatttaattccataaatgtttattacacacttaatatatgtcaggcactatggtgctaagtgctgtggacacaaaggtgggcaaaaaacagacttggttcttgctctcagggaacttacagtgaggtgagagggacagacagtaatcaaataattatgcaaataagtgcaaaattatgactgtgatagatacaacaaaggaaaggtagataattctatgagaatatataatgatacctttgacctaaactggggaaaggggaaggaaatgactgttgagctaaagtacgaagggtaagggtaagacagaggtaactaggcaatgagaggagggaagagcatttcgggcagtgggaatagcttatttagagaccctgcagggcccctgaacagggagtgagggagcatggcatatac

SEQ ID NO: 130927 - DNA, 1302 bp, Homo sapiens
ctcatttcattcattttaattatcatcactttagttatatggttgctttacttttcttatggacattagaaaataaaagtgaatagacaagatatatttcatatgatataaagacatatttcatatgctataaagagacaagccagtacttatctggagcctaccaattaagataaattcttttaaatatttagtcttaaaaacagaaattattttaaaattatgaattggctaattttttccaagtaagtgcattttcatgttcacctgctttgtatttaatataaattattgtgttgaggccccattaacagccacaagtttttagtcaacttcaaaaatttctactcaactcttatctgtaatccatttagatttgtatctcttcccatcaatcatgaatacataaggtaatattttatagttggaaagcattgcttaatatattgaatcaataaaaatgttgatttcatatatttaatttttataatctttacagattacaatactgtgatgagactgttcctgtaacttttgatccacacacagaatttcttggtcctcagaagaaaacagaacaagtccaaagagacattggattttggtgtccaaggcatcttaagacttctgggggacaaggatataagtttctgggaattgaccagtgtgcgcctccatgccccaacatgtattttaaaagtgatgagctagagtttgcaaaaagttttattggaacagtttcaatattttgtctttgtgcaactctgttcacattccttacttttttaattgatgttagaagattcagatacccagagagaccaattatatattactctgtctgttacagcattgtatctcttatgtacttcattggatttttgctaggcgatagcacagcctgcaataaggcagatgagaagctagaacttggtgacactgttgtcctaggctctcaaaataaggcttgcaccgttttgttcatgcttttgtattttttcacaatggctggcactgtgtggtgggtgattcttaccattacttggttcttagctgcaggaagaaaatggagttgtgaagccatcgagcaaaaagcagtgtggtttcatgctgttgcatggggaacaccaggtttcctgactgttatgcttcttgctatgaacaaagttgaaggagacaacattagtggagtttgctttgttggcctttatgacctggatgcttctcgctactttgtactcttgccactgtgcctttgtgtgtttgttgggctctctcttcttttagctggcattatttcct

SEQ ID NO: 130928 - DNA, 1048 bp, Homo sapiens
agattctgcgtgacaaaaaaaaacaaacaaacaatccataatcaatgtcaaaagactaactgggaaagtttatttgcatatgacatcatagctgaaaggctaatttctctaatttataaagagttgctacagatcaataagaaaaaaaccatccatctgatataaaaatgagaaaagagtaggaaaaaggttcacaggaaataaaaatgaaaaaactattcttaaacatgtgaaaaagttatagtaaaataaatgtaaaattaaaattaaattatatttccatgtatgatacggcaaacatcttaaaggtgttctaaccactgtgtggtgaaacaataaatagcaaaatacatattttcagactttgctattaagagttagttcaaccttctgttgaagcaatttcgcggtatgtacagatgtataatgtgtgtacactgatactgcccttctgggaatttatagacagatttgcttacaaatatgagaaattaaataataccaagatagtcactacaacattatttgcaaatgacaatagattggaagtaagtatctattaacagggatagtagaataagttatggttcactcacacaatgcaacagcctttacaaagaataaagagctctggccgggtgcggtggcttacgcctgtaatcctagcattttgggaggctgaggagggcggattgcctgagctcaagagttcaagaccagcctgggcaacatggtaaaaccctgtctctactaaaatacaaaaaaattagccaggcatggtggcgtacacttgtagtcccagctacttgggaggctgaggcgggagaattgcttgaacgcgggaggcggaggttgtagtgagctgagatcacgccactgcactccagcctgggtgacagagtgagactccatctcaaaaaataaaaataaaataaaaaataaaagaaataaagagctctatttgtattgatacagaatggtctccaagaaatattagtaagtaaaaaaggcaagaaatgcagagtatgtaatatcgtgacccttgtgc

SEQ ID NO: 130929 - DNA, 1055 bp, Homo sapiens
agtattttaagatgtactatgctattttacttttttgatataaaatcaagatatttctttgctgaagtatttaaatcttatccttgtatctttttatacatatttgaaaataagcttatatgtatttgaacttttttgaaatcctattcaagtatttttatcatgctattgtgatattttagcactttggtagcttttacactgaatttctaagaaaattgtaaaatagtcttcttttatactgtaaaaaaagatataccaaaaagtcttataataggaatttaactttaaaaacccacttattgataccttaccatctaaaatgtgtgatttttatagtctcgttttaggaatttcacagatctaaattatgtaactgaaataaggtgcttactcaaagagtgtccactattgattgtattatgctgctcactgatccttctgcatatttaaaataaaatgtcctaaagggttagtagacaaaatgttagtcttttgtatattaggccaagtgcaattgacttcccttttttaatgtttcatgaccacccattgattgtattataaccacttacagttgcttatattttttgttttaacttttgttttttaacatttagaatattacattttgtattatacagtacctttctcagacattttgtagaattcatttcggcagctcactaggattttgctgaacattaaaaagtgtgatagcgatattagtgccaatcaaatggaaaaaaggtagttttaataaacaagacacaacgtttttatacaacatactttaaaatattaaggagttttcttaattttgtttcctattaagtattattctttgggcaagattttctgatgcttttgattttctctcaatttagcatttgcttttggtttttttctctatttagcattctgttaaggcacaaaaactatgtactgtatgggaaatgttgtaaatattaccttttccacattttaaacagacaactttgaatacaaaaactttgttttgtgtgatcttttcattaataaaattatctttgtat

SEQ ID NO: 130930 - DNA, 1033 bp, Homo sapiens
gtgtacccaggttaagccacgtgtctctaaaatgttcatttaggcggcgctgtgttacctgcgggaatccccgacctgcggctcctgaccacgggccaccccgcccagaccctgcaggcgggctctccacgagggtctgcgcagccccgcgggggtcctgacaggccgagcgactgcagtaggagggggcgggcccggctctcggtccgcccccacgccgggctcggggtgggggctcggggcctattacgggatggaagctccgggtgtcgcgggggcgggaggaattaagggagggagagaggcgcgcgggtgaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctggtgagtccgagggagccgagccgggaccgccgcgctggtggaggggacctggccgcgcgccccacgggcagggcgtcagtctggctgttgggggtgtctgtctgtacagctgtgtgtcgtgtgtcttgctgcgccggggtgtcatgctttttatttacaggtgaagaaggacctggttatgcgtgcagtgagtcttggaactcagaggggagaccaaaatgggaggccatcgtggagcggacatgcgatatgggcccggtgggtctccccgaagtacagggagtcccccaataatttctggccccagggggaccccttgggaagggtgggagggatagggcggcagtgagagtaggatgaggagcttgggtacgtccgaagtggacctgggaaaaaccctggcctcgctgatcacatggacctgggcctgggccagggcggtgcaacgtg

SEQ ID NO: 130931 - DNA, 1057 bp, Homo sapiens
gggaggctgaggcgggcgggtcacgagatcaggagatcgagaccatcctggccaacatggtgaaacttactaaaaatacaacaattagctgggcgtggtggtgcgtgcttgtaatcccagctgctctggaggctgaggcaggagaatagcttgaaccagggagtcagaggttgcagtgagctgagatcacgccaccgtacaacctggcgacaaagcgagactccgtttcaaacaaacaaaaaaaaaaaaccaacttgctggagctgtgcaccagagaatgtaatcaaagacaatggacaatgatgggtactatgccttgtgaaaagaagactatcatatttcaatacgtgcttttgtagtctgacaatatttagaaagtcatgtcttctaaacacactaaaagagggatatcaactaaaaagtatgttggagtttatgagtcatcagagttaatattttcttttgaatgtggacacttaatataaaatcctccagataaagtatgtattattaccatttttataacaaggtctctttagctattgtaaaatagcttataggaagaaaatcctatgacatgatttagttaccgttatgcctgttttcaaaagatgtgttaggtaacatgcagaaactatgtgaggtttggggttaaagtcttaaatttcattctaaaggcctaaataggagaaagactctggaagtacctgtaatgaatacctgttaattggctgcacagcatccgtctcttcttccttcttggagtagtagtctaaagttctttttttgttgttgtttattttttgagacggggtctcgctctgtcacccagtttggagtgtagtgacgtgatcacgtgatcatagctcactgcaggctcaaactcctggactcaagggatcttcccacctcatagctgagactacaggcatgagctacctcacctggaccctgaatttctttttggaacctaccccctccctccattttcagttttgtgatttagatgggatcagcctcacctgcgccagagataggccctaataaacagagccga

SEQ ID NO: 130932 - DNA, 2037 bp, Homo sapiens
attatctatttttccctctaaaggaaagaaggcgtcggtggattttacaagggaattgctcctaatttgattagagtgactccagcctgctgtattacctttgtggtatatgaaaacgtctcacattttttacttgaccttagagaaaagagaaagtaagctcaaagaggacaattccagtatatctgcccaaggcagcaacaagctcttttgtgtttaaggcataaaagaagaattctgcatagaaacatggctcatattcgaaattgctctatagtcattagaagccagagaactgctaagtctcctgcaatgtttttcttgctttttgccttccccatatatatggaacttggctacctctgcctgaaatggctgccatcaacacaatgttaaaactgacacgaaggatagagtttcacagatttctacgttttattggtggaagctgatttgcaacatttgctaaatggattagatgaatgtacttctttttgtgagcttacttgcctggattgctttaaaattaacctttgtgcaataccaagaaaatagctctttaaaagaatgtctttgtatgtctcaaggtaaattaaggatttactgaataaggtgttgaccaaatccagaccattttattttatttttttatttatttattttttgagatggagtcttgctttgtcgcccaggctggagtgcagtggcgtgatctcagctcactgcaacctccacctcccgggttcacgccattctcctgcctcagcctcctgagtagctgggactacaggcacctgccaccacgcctggctaacttttttttatattttgagtagaaatggggtttcaccatgttagccaggatggtctcaatctcctgaccttgtgatccgcctgccttggcctcccaaagtgctgggattacaggcgtgagccactgcgcctggccagaccattttagaattgggaaattttagtgagaaaaaatgcactgtaaatatgctttagttttaattcagttgggatgcactacctagcgaaaattgagaaactatatacttctcagagaaatatctgacatctattgtcattccattgctattttttttccccagagacttccataatttaaaataaaatcctagatccagttcttgttttttggcataaatacttaatctattttaaatttataaaatctgagcttctaggatccagctgtgtcaacctttatttagcatatataactataaatcacttattacagatgctaaatagatcaccttttacagatgctgaaatgtttgggatatgtttgttgacaaggtaaatggaaatgagaaactttatacttcagttttcagatatatggatctagatcccaaataaatgattaatcttcattggtttctcaaattcaggttgaaatacaaattaatagcctttattgattttacttttatgagtcattgtagacatctataaatataaaagggcctgtacccaaaggatgccagaatactagtatttttatttatcgtaaacatccacgagtgctgttgcactaccatctatttgttgtaaataaaagtgttgttttcaaagccatctttaaatagttctttaaaaataggtcttttttttatattttggaaaaggcattgtttttaaagtaaagataaaatggtaagtacctaattgtatttactgtaatatcttataacatgcagatgaatgctttataagttaaatatgatgtattttttcatacttctggattatactataattcatatgaaatcttgatattagtccccacacggaaaaagtgaactgcagttgatatttggtgtttaagatagcaccattgtttaaataccgcctatgtactcccaaatgaataaaacataattcttgtcctctgagagcatacaagcttgtgtgatagataaatatgcattaaataattacagctatagattaagaactcgtaaggaatatctcacaaagcctggtaagagttctgacagaagagaa

SEQ ID NO: 130933 - DNA, 1055 bp, Homo sapiens
cgtaagtctttgtaactcctactttaataccttgatttcttaatgttgattagtcaaaacctaacttaatcatttttgaacacatagccactagcaaaaacctgagtcataacaggaccaaatatttgttgaataaaggactacttaggaaacctggcaaatgagaaacttaaccagatgaattttttaataaaattgtcactctataaaggatgtaaaatgtgacttactgtattacataattatttaatttttgaggggtagtagttactttggatttgaggaagattgtgataaagttggggtagatatatgtgtcacatgcacagattattggggtgccagattcctggttcttttcgcctatcttcaacccctctgggattataccatgtgctacacctaaggtctgtatctgcttaccatctgttctctgcaccaggccacgttgtttaggagtcaagacatttttgctatccttacacttcaaagagaaagcatttcacatttccatctcccttttaatttacctctagctaactgcatgaggaactttttatgactaccaaaaacaatgtctaccttttgaccctaagactgtgcctcagaaactacatttcacagtttcagatatggtcctgtgcattatctttttttttttttttttttttacataaatgtactgtttctaatttgggttgtcataagtgcgaaagtatctgtatgctgaataatcttattgaaatctcattttaggagccatgaccctctgcattacaaacccattatgggtaacaaaaactcgccttatgttacagtatgatgctgttgttaactccccacaccgacaatataaaggaatgtttgatacacttgtgaaaatatataagtatgaaggtgtgcgtggattatataaggtaacaaattatcaatatattttaaataactgaaaaatttgaatttccgttggctctgttgtcttagttctgaatgacctatagtaagtcctaaaaagaagccacacttaggcaaaaaacaatttaatgaaaactgaa

SEQ ID NO: 130934 - DNA, 1601 bp, Homo sapiens
caggtgcaagagaaatttgtgatgtggaatcaaaaggacttgttatttgataaaaagggatgggaaggaggagggttcatggatagtccccaggtatctggtgtgggcatcaatgcagatgatgatggcgtttgttgagttatatggaacactctagtaagagcagcttcagaagggatggggaaaactagttcaattttggatatgttcaagtgaaatgcttttctactttctacttggattttgacatatgttggtggggaggatagaaagaatttccaggaaaaaaagtttaccccatcctctgcattttctttcctgccactcctcagtcttgatagcattcgatataaattgaggctcctagctagtttattttttgagtaatattttttaacattcaaatccttaaccttggagcaaaaacaaaacctaagtgttgaaacctagttacctaagagacttttggattaagagctaatctaatatttccttaaatattatttgagtgcttagtatgccctcaataaacacttgaataaattcatgaatgtagtagttttaaaatattaaagcctgggctgggcatagtggctcacacctgtaatcccagcactttggaaggccgaggtgggtggatcacctgaggtcaggggtttgagaccaggctggccaacatggtgaaagcctgtctgtacttaaaaaaaaaaaaatacaaaaattagctgggcatggtgatgtgtacctgttatcccagctactaggggagctgaggcaggaggattgcttgaacctgggaggcggagattgcagtgagccaagatcgtgccactgcactccagccggggcaatagagcgggactctgacacaaaaatgtatattttacatatttatatatatatatatttatatatatatgtaatatatatataaaagcctggaaaataattttttctacctaaaaaagtttttcttctaagtttatctcctttatataaccaattgtacagtgtctgtgtttatatgtgatacagagctagaactttgttcttacctgactttgtgtatcccttgatgcagtgagtgatggattggaactgagaccgaaatataatggaattttacattgcttgactaccatttggaaacttgatggactacggggactttatcaaggagtaaccccaaatatatggggtgcaggtttatcctggggactctactttttcttgtgagtagatttgggagattttacagtattaaattaaaaaggaatttttgttttcggtgatttttacatgtaaatgtaaaatgataagttgagtcatttaatcagtttctctgaattggaaggatcaggaagaacaaaatggctgattagttatttgattagtttgattcaaaatggcttattagtttgattatcagatgcctattaatagctaatggcttattagctattatcagaggcattatttggtctggaagaaaattcttaataggaaaaaggcaaagagatgaggtggaatgatacttttagagaagccatttctgtgaggtgaattcaggaagatgaaatgtataactgattacttttgta

SEQ ID NO: 130935 - DNA, 1068 bp, Homo sapiens
cggcgcccagggccgcggaggtgggacgcgatgcagtggccgccaccgtggcgacggtcgccccttgtgagcgcaaccccacctccgggaccaacgagaggactcttatgcccaaggcgcgtgagcgaagccggagactctagtactgagggggcaagaacggggcacagacactacgtcacgccggcggaaagcgcgatggaggggaggtcccagcctctcccgagtctccgccctgcctcgcccacaaatgctccagcccacggacgcggaagcgactgcacagctaaagaaccgccccttgctaacgtttgccggcaaaactacggagcggcgcaggatccagttgagccagcaggccgccgctccgcgagtcacgtgactggaagtagtctgggaaaagcggaagtcgcctgtgggaggaggtggcggtgggcggaactcctagcggacacctcgtggagtccggccggaagagcaaccgagatgaaggtgaagatgctgagccggaatccggacaattatgtccgcgaaaccaagttggacttacagagaggtaagataagttggtagggagaaagggacggtttccgcaagtcgttgggtctagcctcggctttcgcggagtaaagccgggggaggctggcactctggtctggttctttctcagttacctttcgctaaggcaaactttgtgcttacggagtcgctgcggaactggatggatagcaagtaaagtctgttcaagtcctttttctaagaatttcctctagtggtgagtgggaaacagttgtctatagtggagaaaaattccagctgctgctctgggattgtcttcaggttcctattactgaaaagtggacttgaatgagccaaactcgtgggttgaagggctgagagttaaacaggcttttaaaaccttcctactgctcttcttgccgctttactacttcacattagttgtggatgttggaagagacaaagatgaatttaaaagcatcagttttctcttaccatcccttaagaagtttgatgaaagaatggttaaatgaaattaatttatccttc

SEQ ID NO: 130936 - DNA, 1153 bp, Homo sapiens
aaaaaaagaaaaaaaaagacatctgataatagtgtaaattgccgccaaatcaagtagggatgatattaaagtagcccaagtataagataatgaagacccaaactgcctgggaatgcagtggctcacattcataaacccaacactttgggcggcaaaggtgggaggatctcttgagcccaggagttcgagagtagcctgggcatcataaggagacccccgtctctacaaaaaatttaaagattaatggggcatggtggtgcatgcctcaggtccaagctacttgggaggctgaggtgagaggctaaggtgggaggatcacttaagccctggaggttgaggctgcagtaggctatagtcatatcactgcattccagcttgggtgacagaatgataccgcatctcaaaacaaaaacaaaaacaaaacacaaaaaactagaaatagagagttgaaagatgagtaagtgttgcaaagagatgatgagtaggactttgagttttggtagtagggaatatggaagatggaatacataagaatgacctaggctagagctttgttgaatgttagatataacaccattaccagggagtcagaaagaaacagcaggatgaagtcatggggtaagaagatgcatttactttttactcactgagtttttttagacatacgagcttaaaattactttctaagcataattatatatatatatatatatatatatatatatatatatatatatttttttttttttttttttttttttttttttttttgagatgaagtcacactctgtcagccaggctggagtgcagtggcgcgatctcggctcactgcaacctccacctcccaggttcaagtgattcttttgcctcagcctcctgagtagctgggactgcaggcacataccacccccaccgctggctaactttttgtatttttagtagatgggatttcactgtggtagccaggatggtctcgatctcctgacctcgtgatccgtccgtcccggccccccaaagtgctgggattacaggcgtgagccaccacgcccggccctaagcgtgattattaaccaagacaatgtgtttagcagcgtatcaggacagttaaaacatagattctggagccatactgccttggtttgaatcctggctc

SEQ ID NO: 130937 - DNA, 1194 bp, Homo sapiens
catgtttataattaaagtatttaagtatgagttttttcacagatgttgtcaacacctaatttcctactatggcaagtgaaaaagttttgtaacactttagaatcaacagagtatttgtcaggttgtattttttgctcatcagtatacttatccatatgcattgcattgttttaatccaaaggattttggttttagctgcccagtagagtgattcgtagccttgtcagtgttgaatttatcctgaacattttacatttatagttcactgaaatttcctggtatgccttatcataggttagaatttggaatctaactcagcggaattgtatccgtacaatacaagcacatgaaggctttgtacgaggaatatgtactcgcttttgtgggacttcttttttcactgtaagtataataccattaagtcattaaatttgatcaacataggtaagaataatctaattgaatacattttttttcaagttcatttatttgttcctaggcccttttggagtttcacaatgcaaaatagcttattaaaccttgaaaattactagttttctttatataattcagccttccccataacttaacatgattaaactaatattcaatttaccacaaaagtggaattaatgagaggtaagtctagaaagagtttggcttactctggaggatttttgatgctaagatgagtaatttgtacttttgttagtcagataataaggaatcatcgaagttttgtgcctgtgtgtggcaagatatccggaacgtaaaatttactctctgtttttaaatatacagtttggtggcatccagtacattcacatcactgtgcaaccatcaccaccatctgtcttcagaactttttcatcatccccagctgaaactatagtcattaaacaataactcctctgtcccctcagtccccaacccctggtaactactattttactttttgcctctgtgattttgactattctgggtacctcatataaatagaagcatattttaaagaattataccattttgtgtatgtggaataaggcttttgggtctggcttattttacttaacataattgtcttcaaggtttatccatgttgtagtacatgtcagaatttcctttctttttatggctaaataacattccattgtatgtgtcacattttgtttatccgttcattcatcaatgagc

SEQ ID NO: 130938 - DNA, 2108 bp, Homo sapiens
tagtttctgcagttcatgcagaaaaggactttatctatttcaatattataacaatgccttctctccagtattttcatgtttttcattttattttttacatttaaaattacctggaattttattttcacataaggcatcaaattggctcaatttttttgaatgactaaccagatattataataccattttttataatccattttttctccaagttgaaatgccatgtttatcacaatatgcatgacctaactttgcccctgttcttgtttttcttttgctctactcattatatttttagttttatgtactttatgtatttgtcacaaatctttactaaaacaaggtgggatataaatggatcaataagtgtaatactggaatgatatggtatgttacctgttttaaacaagatacttatttgatatgtgttggcaagttttaatttataactgttgttccttaccatcatcataataaaacaaatatttctaggttggtgatgacaaaactgtgaagcagtggaaaatggatgggccaggctatggagacgaggaagagccattacatacaatattaggaaaggtacaaaagtaaattgactaatagcttgcctattaacattcttttatttaaaattattttatagttataatttcctaagatggggaagaagatgcagataagaaacgaaagactttaggctgtaattgttgacccatttacgcaatatttaatgcagctaaagtcctttgatgctaaagaattttaacagttttttttttttttggtattcattgtagtagagtttgatttctgtttttagccagaggatacaatgaaacatttcccatgggaagaccacggagaaaaagatagaagttcagaaaatgcttcagcttgtctagttgatgtcatcatagatcttacacaaaactcagaatttcttagttgaaagactcctttaagaaatgaagaaatttaatagtattatgcatcatgtataaatcttattaatgtttctaccaaattattctgcaaatcaggtgatgggtggtttagttttagcataagaataatttagaacatttggtctatccatgttttataatgtttacatttttatattaagcaaacaattccaaaattagatttaatctttaaattaaatctaccttttaaaaatcactttgtcgtttcaatattatggttagtatataatatttaggttctgctttaggtttcaagaagactaaatgttcttaaagggataggggaatggggtatgagtatgaggtagagataatttgtagttggaaacacgttagtaatttctaaaacaaaattggtttcattcttaaaatgtcttgtctcattatggtattgtttccccctttaagtaaggacttcaaagaagtttctttgtgaacagggcttttctctaaaaagatagtatagataaatatatttaaaatattattctgcagatttgaattagtaatgaaaaaaatcctcttaacctttttgcttttaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgaggtaatgtttttttttaagtatgttttacttattatggcttaataatttcagttctgtttagaaaacttttgaatgtatgatagaaacttctgaattttaatggtgttttggcattttgtcagttttcccgattgtaaatgagttctgatacctttgctcaaatcccaacatgtttcccagcagtttagtcccagatactagagttaagcattgttagaggagtggtgtgtgcatttgcccattggggtaaaatccaagtaaatatagtcttgttttaactttagttttactcatgccttcaacttcatgttccatagattatgtcattgtacatttaggaaaatgttaatttttctacctgccttggaggtcagaagaaggagcattggacatcattttgtctatttgtaattggtaag

SEQ ID NO: 130939 - DNA, 1077 bp, Homo sapiens
gcttgaacctgggaggtagaggttgcagtgagccaagattgcaccactgcactccagcctgggtgacagagcaagactctgtctctaaataaataaataaataaataaaatacaagcatgaggattttacagtgaaaatacttggtttaagttgctgagattatggatgatttattgtaccctcttaaaatggactttgttttttaacataaatattaagggcaattaaatcatttgtttactgaatggatgtggtttgctgccaggtctggctttgaactggtgattgttatacttgtttttagacatttctcttgggaagttgtgcatctgacaggaatatagtactgtacgatatgaggcaagctactcctttgaaaaaggtgagtttcagttttgacttttgctttatacagttggcattatatatttctctgtaaatagagtgactaacaatatggagcaaatattttctcagaattaaaaaaatcttttatacaggtgttcttagaactctacatgatgatagtcatgttctttcagctccctattgctttttagagactcttaaatttctgctaggtattgtatcctagtcaccaaccttgtgtcttccatgatgccagtacattttaggcctctaattaatacttactgaattgaaagttcttaaaggtattgcatcctgttacttaacagtgtaataatattcaaataatattcaataaattcaagccccatgattatcgtatgacatgtacactattttattccagaaggttttagaactcattcacgtaaccagctttatttgttcagttacatgctgatcaatactagtttgacatttaggcaaccactatcctgttcaaagtaacagatttcctaacaattctaaagtagtaatttcaggacttacatatcagagctaataatacaacttaagctaactctcaagagggagacagatactgtctgtaagtaaggaaaggagtgccattgtaagtaaaagggtataaagtttatttcaggtactagaattttgagtgacagaaagggctggacatcattgagatg

SEQ ID NO: 130940 - DNA, 1034 bp, Homo sapiens
aaagtgtgttgacctgaattgatttgatatggggaagaggccttttaagatcaagtcctttctttttgttacaaagttaccttggttgaacatcatattttatttgcattttatgcttttagttattctgtgaacttttctgtacatctggttttgcttagtttgttcatatttatttctcttactagatagtaagttctctgagagcagaaatttgtttactaccccagcacttaacacggaaccttattagttgggttcaataaaaatacattgacaagaatttgagtttttattttatactcctataggactcagaaatagtatcctgatacttaataggcagtggttactcaaaatctgtaccaaaatccaaagggttttaacttaattcgttttctatagggaggtatatcatacaaagagaatgcaacatgttatctgtgtaaaatggacttctgacagcaagtatattatgtgtggatctgatgaaatgaacattcgcctgtggaaagctaatgcttctgaaaaattgggtgtggtaagagaattcattttctttcattgtcataaagctgatttctaattttattagatattacattatgaaaatttacttttaggtatttttgggtattttgattaaattgacatagctgtgataaaaaaagcaataaatggacaaggttgtattgataattatttgcttcattctgatctattattgtagacactgtacattcaaattgacatttaagaccttcagaatgcctttgttaattcagatgtttgataatattgagtcttactggttttttgtgttttccttgaggtagggacagaagatgcaggaactagaggctcagaacttagagctcgtatctcttgttagagaaatagtcatccagcaactcaaaggctgcaagtccctgggagatcttgtaatatcaaagacacaatggaacatttaataaatacagaaagcttcatactttaaaaaagattccatgaaaaaatagcaggtgttatcattg

SEQ ID NO: 130941 - DNA, 1045 bp, Homo sapiens
cagtcatctgagttaaagattcactgggtcacttttttaaaataccacctgggcccataggtcaaatgaatcagactctggtgttaggaccctggctgtgaatatagtttgaaagttccccaagtgattaaggtatagcaaatgttgagaactgcactatatgcattgcaaaataaataacggagaaggaaaaaaaaagtgacaaactaaaaaaaaaagcgacaactaaaaccaacagttttaaagagaacataattttttacctgaaattgaaattgacgcttactatccgtactttcctctcatacacaatgacaggtaccagtaaatacatttatctttgactttcgcttaggaaaacctaagtgctgctaaaatccacaaactgctcctttagaagaaaggagagcagaactaaaaataatcaaaaggaatgggtggaacagtctaccttattcaactatttctgtgccagatttaaaaaaacaaacaccacttcccacccccagctaactatcaacccaagcagaaccagaagccagaatatacacactactctgaggtttaaactttttgaggttaaaatagcttagttattttgagtctataaaatgtgaacttcaaagtcatggtccaaattagacgattttggcttcctttacagtagagggtcaccccctgggccctgcactgctttctagcggtcatatggttagcatgctgggtgcctgaggctgtgtctccctgcacccccacccatgcttcgcctacctggagacagtgccagctcatgaaatacagtgggcatgagccagtatcactggaacatatgactttttacaggaatgaagcagaagtgagtggggttactgttacggtgtttcctttttacagtttttactacaactagatgtgtttttcctattaaagggactacttaggagtggaaggaagtcttttaaaccatcttccactgttattcacacacctggacgaagtaaaaatttgtcacagtatttatatatcgcatacatagaatatatat

SEQ ID NO: 130942 - DNA, 1744 bp, Homo sapiens
gctacctaacttagtcttagaaaggagtcttacctcaaaatggctttcatggtttcacattcttgttatatttattttaacaaaaagttatttggaggttaaagcataatatatttggacatttggttttaaatgttcttaatttttttttaacgaaagagtaggcaaggaaatgaaatgaatagactttataatggaattatagtaatgagagacaaatcattttgaagattttgacagtttactaaataatacattatcaatattgggtattaaattacaaatacataagaaaaataatactaacggtcttcaatggttactatttcccatgaagttttagggttcgcttacctagtcattactatcctttgtttctttttagtgctgttcattacattgaaaattaacatgtattttaagagtagagagaaaaataaactgaaatttaaatgcatgtctgctgccttttaacatttatgttaaaaaatacatttgatgtgtgaagatactgcaatggttagataaaaatatttttgcatgatctgtgagtttcaatgttcatattaagtattcatgcaaagtggagagaaagaaggaatttgaaccttattaatatttaatatatagatgacaatacctagatgcatataattttaaatatgcatgtagtgaaagattcatgcttgagatatttttaataagagaactgagtgatcaaaactgagaccattactgttatctctcaccttaggagcctgaataattaaaagctattcctaattattagtaatttcctcaaagtccagctgaacatccacataggaagtctatcatcatcaaataataccattttacatatgagcgaggtactataattttggaagcatttaaaaatctcagtagaaccctaatcagtaattactttaaagaatcctttcatgtattgctgtagcagtttaaatttggctaattcaatttatcagtaaaatttataatgtccttttactgactaatgtttttttttcaatcttccaagacatctgaatgattaatgtttttaagtcttgtctttcaagattgtaaacttcttgagggcaagaatcaaaatttaccctttttttgagtttgtgttttgcagcatccttaacacctgcacgtaataagtacttaataaattgtgtttatttaaattgtggtaatgttaatgaggtagcttatcaattttgtgggacaatgaggaatcattgtttgaaagaaaaacataatttattaaaagttgaatttccagtgggtttttgtgtaattgtgaaaaaatgtctgaggaaagcaaacccactaaatcaatagaaaagtattcagtaaatactgagtttctaatatgtacatatcatagcctttcagataagctttttgtaacacaaattagaaattatgtgtttcttgatgtgtatattttcattcatagtttagattttctgttaaagggttaatttgcttcccaaataaaggaaggcaataagtaaaaattttcctgataggttaggataacaattagtatatatttagcacatatatagtgagcagttctctattttttaaaataattcaattttaaaagtattttctaaagttaatttataaaattttgaaataaaatctttttttttctttcttttcttttctttctttctttttttttttttttttttgagatagggtctttcttggtttgaggcccagg

SEQ ID NO: 130943 - DNA, 2869 bp, Homo sapiens
ctcttacatgttatttgttttaggaccttgtttatgccttttttactggtcacgatttaaaaaaattgaatttattgtagttttgttttatggattttgagtttgtgatcttcttagaatgatcttccctattctagtatttttaaaaagtaccaattgaatcatgaatacttttaaataaaaattgcatatgtaaaccactgttgccattgccaaaaaaatgaaaaactatagtttttaaggattcaaaatgcattctaaaaaattgattgacattttataagaaaacaagcaaacaaaaaattgacttatattttatgaaagagtacccaataaatttatatatattctattttgaaataagggcaattaaataatatcttcctcttgacaatagattttgataaagaactaattatattgtgcgatgaagaaagagatagtggaagcaagtgtgataaaccagatgaactttgacttgacaccttactttactaattaataatggtaacgttttgcttatattattaaactctgagtttcctcatctatactatttgagtaataacacctattttgaaggattgtgattgttattattaaactctgagtttcctcatctatactatttgagtaataacacctattttgaaggattgtgattgttatagactaagtatcctggcataagtagtggtgcaataaataatcattattgttaactgacatagatagcactctttaaaccttatcataggattgctgggtgaaattttcttattttctaaaaattgagagattcttttccttgtctattatgaagtcaaaatatgccaggagggcttttaagcgacttcattatttgtttagaagactagggatggggagagggtgggtgacaacttgaaaatagtttcctcagcaaataccattcttaaggagcctgataactaagacatagcagtgaaaatagcactgacatcaagttattggtaatcggcaagatactgatagtcaaaggtgaattgaggggacttacttgtggaaactactttgtaattgactttagatttgccttggttaaactttttactctattatttaactaaaatctatatttacctatttgtcttattcacattgtatctaagaacccagagaaccgtattaggttaagctaattctgaagtatggttattgagcttagaatgctgatcttcacatcgcccctcaaatacacttaagctttgtatgattgccggtttctcatccttctggcttagcttcaaatttggatctttagagagctcttttctgaccactctttcttatgtagattctctccattattctttataacaataccttttatatttccccaattatgcttatcaaaatttataatgatttatttacttgtttatggtctgtccactctgctagattatcaactcaaagagagcacacaccatgtctgttttgttcactaatgcagcttcaacttctaatgtaatacaatgccttacacatagtagtactcaaaaatattaatcgggtgaatgaacgcacattgggaatgaaatattatgttcatctaggtggtacaaactttcaaggtgaactccaataatcttaaaaaaagatttgcttatgtagtagtgtccttatttttgaaatcaaatgtaatttttaaacatgcctaattttgcttattttacatggaaggaaacttacagtgtttgtgtatgattgcagcttatctttcttttggactaagagcatatcttttttgactagaaactagaagaacattgtgatagatatcatttttaaatttaaggaatattaggaattagggaaaatttggctgtaaaagtgatcctttaagagaattgatacatttccattgtgtttagcacagatgagtgataaagagtacacagaaggctttggatagaaatagttcatgccctccagggacagataatctaaggccaaccataatcatatgaacacataaaaatgtaaagtgtcatgaaaaaatactgtaaaggtgtttttagtacattataaccatggtaaaaaatatgtcagactaatcttactagtagtttattgcctctatggtattgtttgattatattgtgttatattacatggtgtcacatagtttttcctgttaaaatatctgaaagtttcactgctagatattaaaaacttttgtattctctagtcacctaatgaaatacagatatctctgggagttgaaataattttaaccattatcaggtaattcttaaggagctcattgtaagaaacgtgataaaccacatgaaaattttgcatggtaagtaccaggagactactgtgcactacagtgtatcatggatatattttacaagaggagcacgtgattcagtcctgggaagatgccatctaggctgaatctcaaatgatgagtagatgttagctgggcagattgttctctaagcaaaaatcttaaaactcccaattcctctttgcccccaaaacctttcatttgttaaaaaaaaaaaaaaaaaagaagacgatgcaggacatggtcaagaagtttgcttgaagtggttcagaagagcacagatttaaatggtgatgcgtcaatagaggagactggagagatggcaaggttcagagcctaaaaagccttctatgctattctttggatttggcaatagggagtcatggagggattttaagcagtgacacaatataattagacttctgttggaacaaaaaccactctcatttaatagattggttagaaggtgtaatactagagataaaggcactatttaggagattcttacagtaatccaggtaataaatgatg

SEQ ID NO: 130944 - DNA, 1092 bp, Homo sapiens
tatgttcagctcgaagagacaaatagtttggtagtttcttgtatcctgtaactaggcttctgggaggctaaaactaggggaaaaggatacactaaacaatataactgggtagcagaataaccacaatggtgtttggtgctttggtattgttcagttgacagatggaggtggtgctcacattcatcttgttttgttggcatatttggtatctgttatcatttttataatagtttgcttcccaggcacatagatgaaaatctgttttatcacacataaaacagtcttcaatctgaaagaattaattaatacttctattagcacacttatttttctcactgggccaaaatctaggtgtaggtagggccgcatttctttctagaaactaaaggaggattgtttccttgctcatttgggttgttgaaagaattacgttctttaagttataggaccgagattcttgttggctattcagctgagggctgttcttacctcctagaggcctctttctggtacttgcacataacttgctatatctctgaacaagcagtggggcattttgaatctttattgcgatgccgtctctctgacctttcttctgtcattgcatctctctctgcccacgactaggaaagattttttctcttttaagaactcatgtgattagcttgaattcacccagatattccggaataatcttcttattttaatcatatctgtagagttctttttgccatataaggaaacatatttatgtgttcctgcaattaggacagaacatctttggggggccatttattctccttatgacattcctctaaagagtgccagtagatataaatttggatatatatttttttataaagtagatactgaactattcttattttttaaaaagtattttgtattcagagatacaaattccagaatatctctgaaataatattttactatatatgttgtactatagtttataatactatattgccttcaaagtgccgccaatctgcattccactttttatttatttaacagtttcctccagagttaaaatgtttgtgtaactgggttttaggtggagggactgggggcaag

SEQ ID NO: 130945 - DNA, 1036 bp, Homo sapiens
tttaggaaacagagaggaataggacacagtctctgcccttgaggtgcttataatttagtggtaaagagtcatgtaaataaataatccaaatgcatgataagtgccttaaagtagttatataccaagtgttgaacagaggaaggggctagtatacgaacatggaggatttaaggaagtctttataaccaaagatcacattcaaactggccttgcaggaaaaagtatgtggagaagaagggcattttagacatatgctgtgaaaagcatttagacacggactgtgaaaagcatagtgcatggtgtctttggggaatagccagtattcctatattgctaggtgcatggaagatggaaagaagggatggagtggtggaaggtgaagctagttggtgagagtcagttacaaagggcatcatatgcaggactgatattcaattgacctgcaccagtacagagacactaatttttaaaaactgaatcactttgatgcatactactaaatattattgagagaataaattatctaatgatgttgtctagtgcagtcttatagaattatgaaacctagtaaccttgctggtatgtattaacatggtccttggaaggcatgtactgcctgtagtgtcagtgcctacctgatacccctgtgccctgttgttggtggaggcaatggaaggctgcagtgcaagtggttttcgtggtaactgcattttgcagggagtgtcctgaggcacagtgctttcagtctctgtggaaaacactaacagctagatctggggtatccaatcttttggcttccctaggccacactggaagaagaagaattgtcttgggccacacataaaatgcacgaatatgatagctgatgagctaaaaaaaaaaaattgcaaaaaaatctcatcatattttaaggtttacaaatttatgttgggccacattcaaagctgcccttggcccgcgggttggacaggctcaatctagatgtttatgtgactatgacatgcaggcagcctgcccagtttgttttaaagttgta

SEQ ID NO: 130946 - DNA, 1286 bp, Homo sapiens
ttacatagatgcagttatggtatatatacagttttatattttgcttatttattataattttttacttaataggatatcataaatatttcttccatgaatagattttctcagccatctacctcagcatctgtcacatgcttgccatattcaattaaatgggttcctctccattctagttttcagtaattgcagaaaatttcattgcaattaaaacaaaaatagtcaacattttactattcatttttgctgtgtgttttgctttgatttttgctccggtgtcatgccaaatgtgggacataaccctatttcctggattctaaagttgtactcatatcaggcagctgcattagtagcatttctctggagatttggggataaagatgatgaggttcccaagagtggataattcaaaattgaagtagactttctcattcttaaaaaaaaaaaacaaaaaacactttgagcatttctacccacttatgtccattttgttgcccctgcttcttcctgctctaccttgcttctctcatttcttttccactctccaatctctattagttttgtaatatcaggctagtaatgttttttttctttcagtctattttctgttggagtttcctttcaactctgcagtagtttatcaaagtattttcctaaatggacagtttcttcctcaaagaaaaaatcttcaatatcatttggtaaagtatttttcctccattctactgcatagtcttttctatcaattgttgttcaattgaattttgttggtctttaggggattccttcagacttaggtttgcctagacctaactaatattaagatttcagtaagggttttactgcatctacttaagcgaaaggtgaagagccattaggttgtcattataattagatttcagcaattttttttcttaagatcatatggagtagagtgatactttgattaacaattcttcgaggatatagctcctttaaaatagcctcggtaaaatagaagaaaaaattattggtcatgttaaacagagttgttctgattcttgtggctctaagacagtgttactagtggcagtgcagtttctatttatctgcccaagtttgataacaatgaagcctgggccaaggtaaagtagtgagcttgttggaacctatcttgtgctctttgtcattttcccatttgatacctttctttttaccacttacaaatgacttcttcctttgggtatctgatggtttccaactctttattctctcctcagtccctagtgcattagaaaaagagtaat

SEQ ID NO: 130947 - DNA, 1732 bp, Homo sapiens
tacatttgaaatgaagcatttgaaatgaggagatccacgccaccgaaagttgtgtgattaagaaaacaaaaaccacactaaatattttaaacaaagaaaatttaatacatacggaatcaattgccaaaagtcctggtagggctggagaagcagaaaatggacagtgaattcatcaaaagatcagtaactgcaggaagacactactgctcctagggctggcagagaaaaaaaggaaaatggtgttaaacagctaatgagtactatgatgctaaggttgttggagtactactgctacccttgaagctgctgctgctgctttacaggatgctatgagcctgcacttctattgatccagaaaacctatagtcctgttgatggtgctggactcacctcagaggatgctggagcctgcagtcacccattgctacccctgccagaactgcactgttgttacagtagccagaatttgcattgtagttatctggtgctgctattgctgctagaaccagagaccatgggcaatctgctgagtttcctggaatactgatgctgctcctgcaggaattagaaacagaaggaagaaaataaaatgatctaccttcttctgtcatccagtttttaccagtgcttcccagtggcagaacataattggaaaccagctttcaagggagtgtgacaaatgtaatctttagagaggatagtctgaaataagagcaggaatgggctgagagccaatataaagccagcacaggaagaagttacaaaatattgattctttaatcataataagaagaaagaagcatttttgcaaattttctgaataacatcaagactcttcttttttttgtggtcaaatgattaagttacaggggctggtagaaaaactttgaaagtgtgatagttcttcattgaggtatcaaggtatttttgtttcaagcagcaaaaatggcccctgttaacttaaacagaaaataatttattgtaagccctaaggaatagctcttagaaaagttgactagtccctggaaaagacagaaattaggttagctctggatagctgtttgcagaaactaatggatggcctgttcaatgtgctacccactgtttgtatggatcagcttcactatttgctgcttgaagttcacattacatggaaagaggcagtccggcctagcttgggttagttaccaacccttggacagaggagggtatggcaccttgattgacatcaagactatattcaataattgaggactagttctcaaagaaaatttgagatattagaggagaatagatactagacaggcaaaaatgacaaaatatctactaattgaagcttgttttaaattagcaataggtagctcaaaaccatacctgaaagttcttgagcccttaatatgtaataggcactatgatctcttttaataatatctttgaggaagttgtcattattatcctcattttacagatgagaaaaattgagaggtgcacttctgatgatggtggattaggcaatttggactaactcttccactgagaacaactagaaaagctggatcaaatataaaaatcatctgttcgtatcagagagctaacacatcaatgaaggctgtggagacaagatcctggagaagaaggaaacccaaaaggtgagctgtgcatttgaagcctctttctactatgggaatctcgctgtttccagtagaggtggccaagaggctgagaagctaag

SEQ ID NO: 130948 - DNA, 1082 bp, Homo sapiens
gaatgcccgcagagctttgccagaattcaacgttagcttttggctagactccaggagccagtggtgtactttggccatctgttctgcttcctcaccttcagttcttcccaaactgtggggcaacaatttggtgcattttgattaatgataggtttagcaatgggtgatggcttagtctttcaggtagctaaatgtgacaagataagtagagctcaactttaataagcttctgaatactctgagattcgagtgatgaagagaatgtgaaatcacataaggaacaaagttcagaaggagctaacatgtatagagcagtaggcatggtgtgaggtgctttatgtgtatcattttattatagcaaaaaatccagggggaagttgctaccatgcttattttataggtggaactcagagttcaagtaattacagtagcaggtagtatgttaaaagccaagtccatctgtcttcaatacttgtattcttatgatatagttgacacaagtagagactatagcaaaagtagaagcagctaataataaaatagtagtttgggtcacctctgactttagtgtcatcatattgtgttttactggggagccaattatttggttcagacttattttctgggaatggaaactgcagagatattctgataacctactttggttgtagtaagttctagaaagatgctctcttgactttgtgttagcagaaacaaacaagggcacttttgtgtgtatgggaccaaattaaaaatttaaagtttatttaaatacttttataaatgtgatttatggcagagaagactttaagactctccatggacctaagaacaagcagtaagaaaggagaagtattaatgcagagtatagaaacggtgaaataatcttaagatgtacattggtcactgtatcagtccattcttgcattgctgtaaaggaatacctgagactaggtaatttataaagaaaagcaggttaatttaattaacctcatggttcctcaggctgtacaggaagcatgatgctgacgtctgctcggtttctggggagacctttcaatcatggtggaaggtgaggggga

SEQ ID NO: 130949 - DNA, 1014 bp, Homo sapiens
aagatttagaaaaggatagacttactctcaaatctatgaagtaagaagagaagtgttggggctgtggaaaattccaagagagagacctaagcagtcatttggatttgtgcttagacatggcaaacttcaaatttaggaactgcagtataagaagatataattttctgtacttagcagttgggtcagtcagttcattcttcttggggagcagtggagcatctcaatggaagagatgtagttgttgctaaccttagtgatttacctcaaccctccaaatagtatggtatttagtcgtagtataattttaagaagaaatgaggacttcctcttcgatcccatcccacagaaaacctcttccatcttttttttcctatgaataaacagcgggaggtttttgttcttgtttttggtaactaattaacataccaagaagttactttcaatatttctctctcttacaaatcatgttgctgtgaacacaatggctaattcatggattgtagggcatttataccttttacactcttagatctttctaacctaatcttctgaaatttgtcttaatttgaacttattttcatatctttttcttttacaaacaacttttatgtacttcttaaataataagccaattaattgaatagggacaatttctaaatttcataattgttcaagatattatcagtgctatatgttttattttttgaaatatttatttaagttggtatgtgtttacatgttattcacttgcttattgaaattatttaaccataaataatactttgccaattaatttaggtgatcgccaattaatttaagtgatcaccaattaagatgacagcaaatactcaaatactttataaaccttgggtttttgttttgtttttgttgttttttggtagaggtggtgcacctttgcttaatagtgaactggattgaataggctttgctgaattaccatgtggtgaattagctctcctcataaatgtaaatatctcaaatattaataatatc

SEQ ID NO: 130950 - DNA, 1063 bp, Homo sapiens
tttaaatactaaatgatgtgactttcattcttgcaaataagatattacactctgaattttataaagagaatacaggatataattttattgttaatatagaaatagataccaattatatttgttattgtgacacaaatatgtctaagaatatggctttcatttattactatatcattaaaaaatgaacacagtgtaaaagtgaatcaatttgatctaaagagaatttaatttacagtgttaggtatagccttgtaatgaaagtctaggattttgctgaccagttttcatgactaattcttagtttccctctgagagggtaaaaactaataaactgatcacatagtcataagtttacctcttaggataagttctaggaaattgtgagaaaccaaatttcagaggcctttattatccttgtgcatgatttttctctgccttataaatatccagtcttatttcattttgatactcagtgatctatattgggccagtctcccttaatttcccgaatattgtgaaaccagtacacactaataggtctgtagaaggaataatttaattttaataaaggaatattaaaaaaatgaataatattaatttcatacacgtccatgtgaagagaccaccaaacaggctttctgtgagcaataaagctgtttatttcacctgggtgcaggtgggctgagtctgaaaagagagtcagtgaagggagatacgggtggggctgttttataagatttgggtaggtaaaggaaaattacagtcaaaggggggttgttctctggtgggcagttgtggggttcacaaagtgctcagcaggggagcttttgagccaggatgagccaggagaaggaatttcacaagataatgtcatcagttaaggcaggaacaggacattttcacttcttttgtggtggaatgtcatcagttaaggcaggaactggccatctggatgtgtaggagcaggccacaggggatatgatggcttaacttgggctcagaggcctgagaattaatcccaagaatgactcactaaatgtgtgccacgtgaggtagaagtttt

SEQ ID NO: 130951 - DNA, 1092 bp, Homo sapiens
tccagacctattgtagatctctgcattcttgttttttttccaaacacaatgtgggccagagggaaagatctatggtgggactgcattccttttgtaacatttaccgtaattataacaatatttgtgcaattatttgtttgcttattgtctccctagtacactttatactctgtagcaaaatgtatatttgttgagctttattcaccagctgttagcatagcatttggcatatagtagccatttagtaaatattgtataagtaaataaataatgaattggtgttaatagttacttgcccatctataaataaattggaattctatgatttcaattaatttttatggcaaattatagcttcatctaagtttatctactaaactaaatgtaatattattcttttagtagaatgtagtgaatatattatagtcactggtgtgttcatacgtgctaacaaccagctctcttttagaaaaatctctgacttttggcattttccaatttatttagtctaaatacatccaccacagctgatttcaagctaacccacattacttcatggaatgtggagttagggagaaagcacacaatttgttttcatgagttagtgaacaacaccgaagctctttcatattcatgccctggtaatggattgttcttcacatacaagattgtgctagtaatacacattgaataagcatgtactttaaaaagactgtgaattagtcaaggtaatgcaatcaattatagaaggtaaactcaaaaaatctttaaagctcaacttagtagaagtttagttttcacctatgtgaagtccacactggtaagctgatcagctgagtgctctcctcctagtgattattcaggttcccaggcacctttttttcctgtggcttccttatctccaaggtcttggctgaacagcatgaagatagcacatgagaatttttaaaagtttatgaaagtggcacacccattccacttataatccattggtagaatataattgtatggtcatagctgcccaagataacatggaaaatgtagttttctaagaggaaaggaaataagttgttgaatagctagccagaatct

SEQ ID NO: 130952 - DNA, 1726 bp, Homo sapiens
ggtgagaccctgtctctactaaaaatacaaaaaaattagccaggcatggtggtgggtgcctgtaatcccatctacttgggaggctgaggcaggagaatcgcttgaactcgggaggcggaggttgcagtgagctgagatcatggcactgcactccagtctgagcaaaaagagacttctgtctcaaaacaaaaacaaacaaacaaacaaaaaacaaagattacagataggctttaccttgtctatgatgaattaattactcataaatttattgaatttatttttaacacacgtaacttcctgatgaaatgcattccaaaacttaatattctattatgtgacctagtgctttagtatttcattttattcttactaaccctgcctctctaagctccacaaaaagctatctcatgtggttaatttttaaacaaatggagtctatattcctattatccttttttttttagtctgatcttatcgatttgttattcaaaaaatcttatttctgactggattcagacttagaagtagaagcttgcagacaggaaagcctgcatttcttagcaatttgttcctgacgcttctgtttagcctccttcattctcttggccaaaagttaagcatattctgcagcctcttcctaatttttcttagtatgctgcttctccagagcaatatggcaccatttgtgctgcaggacacatggagtaataagacgctgaattttgggtgctttggtcctaggtttcttaccttctttgtttaaaggctttcttacaacatactggtggacatcatcttctttagagagattgaaaagtttgtggattctgctagctcttttgggccccaggtgatgaggcatcgtagtatcagtcaatcctggaatatttttatctcctttttttacaataaccaagttagagcactccgattggcatccacaatgcaaccacgaactgattttctctttctttctccagttctccttggtctgtaacaggaatgccccttactcattagcaggcggacacggccatgaatcaagacacccctcttcatggggaaccattgtttgtcattcccaccactgattaggaccacataacccttccattcttcaaccagagcatcagcagcaacttctgtggccatatgcttctcataaaaagtgcagagtttgcgtttatcatccacttcaatgagtttctggcagccagtggctgggaaagagatgtccagcttcatcttgaagcaggtgaatgcctccaaggcaccacgaaaaagagcccattattcattttacttagtcattcattcactcattttttaaaaattctatctccactggttatctatttttttcatataccttgaccattataactgccatttggggaactttcttgatctctgaagtcactgtgtagcagatactaccagcaacccaaccacattgcctcatcattcaccattccctacatagcaaaatctgctgactgtaagtgtttgttacactctgcctgagtgctttctctagccagtgagtttcagagagttaacaattcccaggatcagccctggaccaacaataaaggagagttgataaattaaatactccaacttccttgtcctctatataggataactctgaggtctttctacccagtctcccagaggaagtccccacaagattaagatgattgttttccccaaagataggattaca

SEQ ID NO: 130953 - DNA, 1141 bp, Homo sapiens
atgataaacgcaaactctgcactttttatgagaagcatatggccacagaagttgctgctgatgctctggttgaagaatggaagggttatgtggtcctaatcagtggtgggaatgacaaacaatggttccccatgaagaggggtgtcttgattcatggccgtgtccgcctgctaatgagtaaggggcattcctgttacagaccaaggagaactggagaaagaaagagaaaatcagttcgtggttgcattgtggatgccaatcggagtgctctaacttggttattgtaaaaaaaggagataaaaatattccaggattgactgatactacgatgcctcatcacctggggcccaaaagagctagcagaatccacaaacttttcaatctctctaaagaagatgatgtccaccagtatgttgtaagaaagcctttaaacaaagaaggtaagaaacctaggaccaaagcacccaaaattcagcgtcttattactccatgtgtcctgcagcacaaatggtgccatattgctctggagaagcagcatactaagaaaaattaggaagaggctgcagaatatgcttaacttttggccaagagaatgaaggaggctaaacagaagcgtcaggaacaaattgctaagaaatgcaggctttcctgtctgcaagcttctacttctaagtctgaatccagtcagaaataagattttttgaataacaaatcgataagatcagactaaaaaaaaaaggataataggaatatagactccatttgtttaaaaattaaccacatgagatagctttttgtggagcttagagaggcagggttagtaagaataaaatgaaatactaaagcactaggtcacataatagaatattaagttttggaatgcatttcatcaggaagttacgtgtgttaaaaataaattcaataaatttatgagtaattaattcatcatagacaaggtaaagcctatctgtaatctttgttttttgtttgtttgtttgtttttgttttgagacagaagtctctttttgctcagactggagtgcagtgccatgatctcagctcactgcaacctccgcctcccgagttcaagcgattctcctgcctcagcctcccaagtagatgggattacaggcacccacca

SEQ ID NO: 130954 - DNA, 1140 bp, Homo sapiens
tagaatacaggtgaaacaaaaaggcaacaaagatggctatgtctttggtgccactttctgtgaattatgcacattcaataaatgcttggtgcatatgatgaatgagagaaagctgtaataattaaataacaaatgtctttaacatgactgatgtcttttctgtagcatttttatcttttattgaaaggatgattaatcaatagacttgaagacaaataatgatctgttcttatatggccaatgcttaatagacttctattttcaagaatatgatatgagctctgaaagacaaagtatctctcttaaaaaagatgtttaacatagtataataattggttttactgcatagaagtcagtttgttctcatggaatatgtaacttaaatatttcaatttttaggtgaaaaaaagaatctatttctattttcaactgaattaaacttgaaccattgtcaagtttccttcatttaagtgacctataaatagagttgcaacatgtgccagcttgcctaggacagtcccagtttacacatgctgtcccagcattcttcatagattgacatttgttctggattttatatgaagtattttattaagagttgcattaaaataagctggggtgagtttggaaggtctccattttgtacttacatactgctgctgccatgatttcatcctgtgtgggatgcatgtatggtgaagggttctcaactgaaatataatcagcaataacccatcttttccctaacttttcagacacaagacagctaacatttcttgtttaaggacaggatgaaggtaccactactaaaacgaagtgtgatagaaagatctttggtggtggtggtagaagtatttgacattgctgtgccatttgccttttgatgtattggtcagtttagtcatgatccattctttggcatttgagatgggagactataaggttgttggagattataaattagggtaggaaatagaggttgaacagtcctgtcatagaatgtacagaaggtagtctggatgtttttttctccagtggttttgtcatttattgtatagtgtaaatttataaatatttttgtattttattatttggtaattttaaaaatttgcaataaatatttcagcagcaagatgctaa

SEQ ID NO: 130955 - DNA, 1047 bp, Homo sapiens
caggctggaggacggtagcacagtcatgctcacagcagcctcaacctcccaggctgtagcaattcttcctcctcagcgtcccaaatagctgggactacaagtgtgtgctaccatgtccagatatttttttctatttttaaactcttagtagagatggcatctctctagcctgtttaggccgatctcaaactcctgagctcaagtgatcctcctgccttggcttcccaaagtggtgggattacaggtatgagccaccctgcccagcatgtgtttttcttttatggctcttgatttatttatttgtaatggagatataattcatgtgtcataaaattaacccttacaaatgtacacctaagtggtgtttagtttaattttgaagttgtccaactattacgactatctaattccagaatatttccataaaccctggaaaacttgtgcccattagcagtcacttgtcattcttctctttcctcagtcctctggcaaccactaatctactttatgtctctggagttgcctattctggacatttcataaaaatagtatcatgcaattatgtagccttttgttactggctctttcagttagcataatgttttcaaagttcattgattatatagcatgaatcaataattcattcctttttatgatggaatatttcattgtatgtttataccacatttcttttattcatcagttgatggacatttgagtttctcctttttagccttatgaataatgctattatagacatttgtgtgtaactttttgtgtggacatatgtttttaattctcttgtctgtatttttattataatcattccagggagtatgaagtggtttttatttgtatttccctaatgaccagtgatgttgagcatcttttcttgtgttcaatggctatttatatatcttctttggagaaatatcaaatcaaatcctttgttggggttatatttaaaaggccctttcttcttcactaagattaatacatatttctgttattgtaatactgttatgattttatgtttacattgtaaaa

SEQ ID NO: 130956 - DNA, 1357 bp, Homo sapiens
caccctgatccctggaacccctggatgttaccttacctggcaaagggactttgcagacatgattaaggttatggaccttgagatagggagattaacttagattgtctatgtgggcccaatctaatcacacgaagccttaaaggtagaaaacttttttttttttttttggctgcgtcaatgagatgagatagaaggaggagagattcaaagcaggaaaaggacgaaaatgcctattgttgagtttgaagatgggggaaggggaccatgagtcaaagaatttgccagcctctagaagctggaaatctccctcagtttatagccagcaagaaaatggggaccttggtcttacaaccacaacgtgaattctgccaatagtttgaatgagcaaaaaatagactcccctcagaacctccaaaaagagactcagctggcatcttaattttagtccaatgagacttctaccagactttctgacctacataagtgtaagacaacaaacttgtgttttgaaccatttaattggtggtaattttctttacctcaacaatggaaaattaatagatactcccttgtgtgaatatactatattttatttgacatcccattagtgatggacaatctaggctatgtcaaaactcgttactataaactgtgagtcagtgaacatccttgtacatgtctccttatggacctatgcaagactttgtagtctgtctatgtagatgtataattaatgtggcatagggtatgtatactttatttcactagttttgttctcaaaaatgcctcagtccatacttctacttgtagtgcttaaggatttgtgatttcccatatcattactaatatttgatattactaagcatttcatgtgtttgcagtctggtggatatgagggggtatttttgttttaatttgcagtttcctcattacattgaagctgaggatcccctcacatacatattagctacttggattgccattactatgaagtatttatttatctgtcaatttgaaaaaattagctccacatcatttttgtctgttgttttttttagcaggcattttaatgttgatgtagttaaattcattactttttaaaatttatagtttgtgctcttttagtcatgattaaaaagtcagtcatcattcagaatccctagaaatactcttttacacttctactaccagctttacagtttttacctttctcatgtatattttaaattaagtcagagttcacttgtggacatgatgaagtatgaatcccaagttttatttccccatatggtgagccactgttcccagcagaagctattagacaaactattctcacatcactggtttttgcacttat

SEQ ID NO: 130957 - DNA, 1053 bp, Homo sapiens
tttatagagctgttatttctttaaatgtttgatagaatttgcctctactgccatttgggcctagagttctcttgtagctctgtctttatttttatttatttatttattctatttttttctatttttgagatgaagtcttgctttgtcgcccaggctggagtgcggtggcatgatctccgctcactgcaatctccgcctttggcaattctcctgcatcagcctcccaagtagctgggactacaggtgcacaccaccacactcggctaattttttttgtattttaatagagacggggtttcaccatgttgcccaggctgatcatgaactcctgagctcaggcaatcctcccgcctccgcctcccaaagtgctgggattacaggcatgggccacagcacccagccagcaatgtctttaaagactatgaattcagttttttcaatgattatgcagccattcaggttacttatttatccttgagcatatggatatttttacagtctagtaaatatatagccatggtagctatatttattctagggttgtctaaataatcatttaaaagtattctttcttttccttttaaaatattagaggcagaatagacattttcatactctttttcaacataacctttttcatgttccatactaatctgtatatcttacacctatatttaattccaatttcaactaacctttatatctgccagtactattgggataattttagtgataatttctcgttgtctcaggctggacttagtgactttttacttttcatctgagatattcaatcattgtcattcacctttaccttgcagaagttttgccttttagtctgctatccacttgttttgtccttcttatttaaagtctagtgaagccgttatccatttcctgtagggcatgacttcactagattgtccacttttgaagcacttgcttttcaataatactttaactattttatgccaatatccaatgtcataatcggtgacatttaattgagcaagacactacttattacttgctatttcttgacaatatctgtaa

SEQ ID NO: 130958 - DNA, 1085 bp, Homo sapiens
tgttcatggatttgtgttccattttgaagatagagttgatagaacctaccgatagatttgatttgtgtggtggagtgtgaaagcaaaagagatatcaaggttaattcctagataaatcatggtgttgttttaagacagaaaaaaaatgggaggaacaggtttgggtgaggaaatcaggaattctgtttggccttgttatgtttgagatgcccttttgacttccgtttggggattccaaattgacagatggttaaatgagtctggagttttaggggaagataagggcaaagatatacagaagatatttaaagccatgggacctaagtcaccgggaagggggagctgtaaataaaaagagcagagagggttcacaacacagccaaaacagggccttggacattccacacatttaaagatctaagagaggaatgagagccaacaaaagacactgtgaaaaaattgacactgtgaaagaaaatcagaagaatgtgtctcaggaatgaagagtaaaaatggtttaaaagtcatggatagcattagtgtcaaatgatacagataagtcatggtaaaaaaagaacagagaattgtctgtttagtttgataacatgcaagtaattggtgagaacaatctcaatagaacattagtgctagaaaattgattagtatggatttaaaagaggatgtgaaatgaaaacatggccatagcaactaaagacaacttcttcaagaaattttgctgtgaagaggagcagaaaaatggggtagtacctggaagggaatatgaggtcaagggaaattctgttaagataggaaataatatagtaataaaatcactgataacttgattcacatatacaattaatattatttgtttatcattacaagtatcattggaaccaagggagttctaaaatagactaaagagtaaataaactaggtattttatggaggagctggtaataaaaagggtaagacagatggaaaattgatagaatagatcttgtttatattatattttcctttcttttctattttcacatttggtgcttaaacacctttacttttaagtagctaggatctttgat

SEQ ID NO: 130959 - DNA, 1091 bp, Homo sapiens
ttactttactcaagcaaattaacatatcctaatgttcttaaagcttctaaagcacttttttctgacagccaatgtcaaagtgaaacaaatatttgtatttatagaataggtagcctttgggagaaaagatccctcaccgccttttttcatagtgtaatgagtagagagaggaattatatgaaagaaaggaattatgaatgggcactcttggaggccaatgttattccataatatttcatttgttcacatattttgctgaaacacatttatagttgtgcaaatgactattatttctaatatcttatataatagcaatgtgcagtcaatatttgtttctcaaggaatctaggtgtacttggaagttactagatagcagaggtgacttgcagaggcagtttgcaagtttaggtgtgagttcttgaagttccagggctataaacattccttatattgtggctgttggtgaatgtaactattggagatggagttgaagcttattcatgttgatatagctccctgaaattgtaatgttgctttcagtggttctcttgttagttaccaaggaaatatatacttggaacaagcagtcctaacgctaaaaggattttccaaatttttttttcagggatcttggtcctctttcttttaattggtagaatcttcaggtgtcactctggacattctcattgtggagcttaaatctaggtttggtactctataactaactcttgtattcaacaagaaatatatttctgctgttgccagcttttatttttatttaattaaattaattaatttatttttgagtcggagtctcactctgtcacccaggctggagtgcagtggcgtgatcttggctcactgcaacctctgcctcctgggttcaagtgattctcctgcctcagcctcccgagtagctgggattacaggcacccgccgctacatctggctaattttttgcatttttaatagagacggggtttcaccatgttggccaggctggtctcaaactcctggcctcaggtgatgcacccacctcggcctcccagagttctaggattacaggcgtgggccaccacacccagctgttg

SEQ ID NO: 130960 - DNA, 1048 bp, Homo sapiens
tgtttttgattgcaaatattggttactcttgtatttatgacccttatagaagatgatgtggcaggctaaaaataaacaagcaaaaaaataaataaataaaataaacactgtagaaactgagaaccagatgaagtcctgtggcggtttcctatcctgtctatgtaagtgattgaaaaagaattaactttttgataacatgtaggcatccatttattcaacaaatgtttaatgaaccgcctaccctgtactaggcactatgctagatgaatgagacaagaatgcaggacttaacctcatggaattgagggtgaaagatattaaacattttttcaagtaaatatatggtcacatatatcaaatgttgtgaagaataagcacagggtataatgagaatgtataataggggacctaatttaggtcagacaaagtctttctaaaggagggacatttgaaaccttaaggatgagtaggggcaggtgaaagggtggtaatggagagggaaggtggaagagatcatttctgggatactgagggaactagaagaaagctgctcactagcatgggtgtagtatagtgagagctggaaaaataagtctctgaggaaggcagttgatgtatcgttgactctttcaaatgagtcatttttaagtctcattctagtgtttccattacttagaccacttcgatgctttttctatgacttagtcttcatatccaattttgaaatataaaagaaacctttttaacagtaaatgttgatttgcagtataatcaccttcttacttagtagacttgtttctaaaggggttctgattatttataaaaattaaatctatttaaaaggggaaaatttacattttttcccctcacagatagtatgagctgtgaaattgacttgaaaataagaaatttaaaaatgtttgtttacacttgtagaaattgacctttcaaaggtgtgaaaaatcaactcataatcagaggcttaaaaattaaagcacctcaggttgcttctgcttgaggtaaatggaagaagcccatttaaagttac

SEQ ID NO: 130961 - DNA, 1022 bp, Homo sapiens
gatagatgttttctttgtgatcatggcagtgattacattgcatatataaggatggggctatataatcatatgtgatttgtttgaaaatgtgaattagctcctgtaaaacatgtggaagatgttttctaggtttaagacatttctctatgctgggtagctcaataatcacttttaaacaagatatattgtggaaccgcgaataatgctttgcattaggtcagctaatttggcaggattctttgttataaattcctattgctttttcaacctgatcatttttctatggtgaaggctgttaaattatgaacatatctctcagatggtttctctggcttacactaaaagatattctattaaagaatgtttttggaatgcagttttatcatccagttctttcctcatttaagttgtttggcttttgagaatttctcatgttacatgcttagtaaaaaaaagaccccatttaactaaatatatgtggagaagactgagaaagaaattctgtgaacatggcaatgcactgaaaccttctggaaaccgatggggaactaatagtgcataaaatattgagtggttttacttgtctcttcttcttagtatctctgaacaatgtgaggcatcctattttggagattaaaaaaataccggttatacaatatgtattttaatttagcaaatgaaaaaaaggcttttaaaatttgttggcatttaaaatgtttactgatgataaatatatttataacctttactttgaaaatgggataacatatctatttcttataaaatttcactttctttcctcaatccagttctgttcaataaactaattggattttgtttatattttatcttgagacaaattaaaaacatcaaacagtatatgaaatgttaggatattctaaattggatatctgtattttaagatgctgttttccttttttaaagtgatacatcactttagtgtctataatttatcataaaaatatatattttatgttatatttaaattaaaaagcaagtat

SEQ ID NO: 130962 - DNA, 1095 bp, Homo sapiens
ggccccaacaaaagaattcctaggactcatccacaattttagttttgctttcaaatttgagaaattgtaagtattttagaaaaatgtgtgaacatttcttatagggaaaaatggaaaaacccattgcacgttaaaaattatagtatcttaaaatatgagggctctttattttgcctagtgtgttttaaactatgctttctgttttgggcagagaacgctttcaaggtctaactcaatatgcaaagcagatagaagtagagcagctctggtatagaaagtgggacatgggacccatgtttggttctaagaaacacatttggagacttttttattctactgctgtcattttactcttgaacaaactaacgtccagctgcttacttaaactcaggacttacggttactcatatggctttaaacttttcatttcatcataagtcctttgaaatgtgagacgtagagttaatggaaaatgataaggaaaactgctgcatttaagtaaggatttatttgtgcctgacttttctgctacacattgtagctttatgttgggtagtattgaacatagaagtcgtgctcatatctagggtctgctgcttactggctatgtgttactggtaaagttgctgtcctatgagctccttgaattaggggctacatatttattaatctctgaattcccacagttatattcttcacactccttcccagtcaatacccactcccctcagcctccagaaccaactgttgtactgcttccccacctagtgtagattagttttgcttgttctaaaacttcacataatgaaattttatagaaggtaatctttttttgataaggcattttactcagcataattttatttatttgtttgtttttatttttattttttgatgttgtctctctctgtcacccaggctggagtgcagtggcgtgatctcggctcattacaacctcccccaagctcaagtgatcctcccacttcagccttctgagaagctaggaccacaggcatgtgccacaatggctagctaattttttttttttttttttgttagagatggggtttcgccatgttgtccaggctggtctca

SEQ ID NO: 130963 - DNA, 1006 bp, Homo sapiens
gtgctgaagaattttatgataattatttataatcatggctgatcttttaaattaataagttttcaagctgggcatggtgtttgtaaccccacccctttgggaaacccgggcagcaggatccttgaggctaggagtttgagaccagcctgggcaatatcgtgagatccccttctttacaaaaacaaggaaagaaagaaaaaaaatagccagtcatggtgttgcacacctgtcatcccagctgcttgggaggcggatgcaggaggatcattgagcccaagagttgaacgctgcagtgagccatgacatgtttgcaccactgcactttagcttgagtggcagactgagaccccatctctaaataaataaataaataaataaaatttcctatgccaatgtatttttttgcagtaagtttctcaacaataattttttgggtctttctgagttatatcttaattttggaacaaaacatgatgaacataaaaataggacacactaccttttctagagaagttgaacagcttgttataaaaactatttgcacaaaatgtaaatctgatgatgaaaatacacatagagaaatgtgtgctttaaaaactattaccatatttcccatgaaacacacacagctaaggacattcttatttgtattttttagtgttggcattgcaacaaatgtatagatgagcagtttcaatgaaaagtggtaccacagtttgatagtacagtgcaaagattatatggaattgttcacctgcatgagcatatgaatcttttaattttctctacgtattttttatgacggttaatacaaagaagattcattactttataaaatgcttaatgcaaatacactatatgttagttgtctattgttgtctaataaattaccatagcttagtgggttaaaacactccacctatttactgtcttgcagttctataggtcagaagtccaggtgggcttgtttgagttctctgcttagggtctcacaaggttgaaatca

SEQ ID NO: 130964 - DNA, 1065 bp, Homo sapiens
cagaacttctattcctatttctggagcttattcacttagctctcttctgccctagtactttgcatcaaaaattctagctgccaagaccatactttcagggattatttctgcagttcattactaaaagaagtttctatgaatatgtagcgcaaaacaaaaacaaaaacaaaaacaaaattctagctgtcttaacaagcctgaattttaatctctatttttaacaccggactgtgtttcttatgctccatgaaaccaatgctttctgcttggactccagttcctaatactacagttggaagattgtttccaggtggaaagctaatgtgaagcttaccgctttctcaagaatctcagccttatgttttgtcttgtccaacacattaaagtggttgtttcatattctgcccagttttatagttgtttatagaaagaaggcaaacctaatactagctactcaggaacctgttaattatttcataataatgtaataaacattcatgaacataccctatcaagcaagagctagaaccttggcaatcatttccttgactcctccagtttgtggctatcatgatattcagccccaagttcatcatttctgttttttcttctatacaggtttcttatatgtatttctaaaaatctttggttatttcatctttgtaaaaagtcattgttctatttttcccactagttctacattgcattcatattgttgtgggttgtggtaattcatttattttgactgctgtataatattttagagtttgattatatcacagtttttaatccactctcccacagagagattgttggggttgtttccctcttttgccactgtgaaagtgctgctgtgaagatttttgtgtatgttttctgttgcacatatgtaggaacttctcgtggatacattccgttcatatgttaactttaggaaaaatactataagtatttcctatatactatatacgatatactatatatatcctatatacctatatactataattaggaataataatagttttaaggcaatgacagttcagtgtattcactgtatactgt

SEQ ID NO: 130965 - DNA, 1041 bp, Homo sapiens
gaatgctatgtacacacacacacacacacacacacacacacacacacacacacacacacaggcaactcaaaagtttaagattcaaagaatgacacttttggactgaaataaattaaaccaaacaaattatgtgcactgataagcaaaatgggactttattcatattatgatttcatttgctgcattatttttgattgcattgcaaggacatgtagaatatgaaaatgaattgcacttttagaaaaatcattaattgtatggttcagccctgtaaagaacaaaaaaaaaaattagaactagctagattgcatgtttttgtatctctcatgtgtagatgctgcaaatcgtactcgggcagatgggcatttagaccaatcctccactgcagtttccgtattcttctcccttactccaagacgggatagacactaatgacttttccccgaaaacattacttagagagtgaagaggctattttaacagtaggattgtgattgcaacttccagcaagattggatcctgttttttctcttatgtcagaaaagctggtttgcctgaggggaattagcattaattgaactaagaagcaagctagtgacaaaagaaaatagtatagatataatagtgatggactcacatagggacttgggggctaattttagcaatttaatcatgaattaattaaatacattttaaaatgatttcatttatttgaagtctgaaactaagatcataggtagtattacagtagaattaaattttgtagttacaaagcattttctttttttttttttactttttttaagatacaagatgtacatgggcaggtttgtgctcaattgcagtatatctcagtgggtatattgcaaccaggttgcaagcatggtacctaataggtagttttttgacccaaacctcgctctctccctcccgcctcaagtgcagcacagtgtctattgttcccatgtttatgtccatgggtgttcaatatttagcccccacttgtaagtaagaccatatggtatatggttttctgttcct

SEQ ID NO: 130966 - DNA, 1771 bp, Homo sapiens
ggggaaacattgcctttttactgaagattaagaaacttgttagtgaataattgaaaagaagttacagaataggcctgttaaactattactatacattttatggtgaaagcttaagcagcacaattatcaataacaagcacatagttattttagaaatactgcaattcatataggagaaggtgatttataaatttctaaatccaccagttttaagcgtagtgcccagaaatgccttggatgcagcttgcatttggtgttcagtattgtgaggcactaatcagctaagtaccataatcctccttacagggtacattcttacttgacctggagctatatacagccacatagtaacagcattaaagaataacctttttcttaacaggcccatcactagaggattctatgactccatcctttgaatgagtgttgtttttgtgtaattttttagtaacttagttttgaaataaaacaattgtaaacaagtagagactttcaaatcatctgattaaggatggctcctatgattttgccagggctagaaggattaaatgaaagcactgcctggcacactgttgatgtatttttgtcaacatgatgcttcatgctcgacagatgtgcattggttgaacaaaggtaaaataatgaaaatatattaaatcttaattgtgatatgtaaaaatttatatatttttgtttttttataaatagaaattgatttattcaaagctttttgtaggaattatagaaacgggcctttgttttcatgttttacaggattatatacttctgttaaatccttgatttaatgtgttttaacaatttaaaattttagaatttggttgcaatgttatgcttaaactgcatggttagttagcattgtgtaattgtattcatgaagtattacattagtttatttagcaatatccatgctttataaagatttttaaaaacaagtaggtattttttcaggttattgatttttaaagagtgatttacatatttttatttataaagtaacaattttttaatgatctctactaataatgcttatgagtcaggaattttcatataggtagtacttaatttaataatataaaatttgaatttacaaaaattagtaatcttcaaattttgcactgtatgtccagtgttgtcataatttttaaaaattgcatatttctacagttgagttaaaatatgtaaatattacagtgtaggtttccatgtaatttttcactgtttataaatgttttcaaatgttcattagactatattttcagagatttgatgattcttttatcaatatggtcagaattatagctggtattagtaacacaaatcacttaagatggtaaagcctgtaaatattaaaatggaagttatggtaaaaacatgatgaattaatttatggcatgtaaaccctggatgcctttgggaaatctggaagtgattttaattgggaaagaagcttctttggagttttcccatcagtcagtatgctttttggacatagaatttaaggagtctaattggtaggatttcctacgcaaactattttgcatagttagaataacatttataatggagcatcagatgtgttatacaagctagaatatttagaaatagattgaatagtccacatgacaaacaattgtaagcaaggaatagaaatgatacttactacagtagatttaggatgtttaaaatgtggttttctataaactggttctaattaaggacagaatactctggcaaaagagaaagcaattct

SEQ ID NO: 130967 - DNA, 1099 bp, Homo sapiens
agaggctcagggaccaagttcttatgcacaaaggaccacaaaccatagtcctcctacccccaggaggagtccactacccatagatagaccagacttgaggcgtactgactcactacggaaacagcaccacttagatcctagctctgctgtaagaaaaacaaaacgggaaaaaatggaaacaatgttaaggaatgattctctcagttcagaccagtcagagtcagtgagacctccaccaccaaagcctcataaatcaaagaaaggcggtaaaatgcgccagatttcgttgagcagttcagaggaggaattggcttccacgcctgaatatacaagttgtgatgatgttgagattgaaagtgagagtgtaagtgaaaaaggtaagctttctaatcatacattttgctgtaattgattagataagcgttttttttaatagattgcatttctgagtgaaaatttaataggtattactagtagctttattttaaaagtcttttaatggcatcgaacgtgtgaagaaaatttcgtgttataaaaagtatcttctgttgttcatgtataagaacgacagaatgatgttctattgatttttaaaaattgccttcttgctttgtttctgaaagttttcttgtatcatttgacagcatatttcaaaaatatccattaactgtagtttttaaaataacatttattttttgtctccttataaaagtaacaatatattcactataaaacatctgaaaaagtcctcaaagcataaagaatgaaatgcaagttatccatatttcttcccccagatataaccattgttaaccttttattgtattttctttcttttttttcctatgcatgtatggtttatagatttataaaattgatatcatgctatatataattttgtatactgatgctttcaattgttatcacatcataaatgatttttttcaagccattagatgttctttagtaatacgttttaaatagctacactaatattctatcataagattataccacaactaaatatttctttatttggggcattgctgtggcttccatttgccaatgtaaaaattataatggttatctttatacatac

SEQ ID NO: 130968 - DNA, 1004 bp, Homo sapiens
cctttattttctcccttatctcataatggacttgtcttaaatattttctttatatatgttgaaaaccacatcagacaatgtatgttctgcactttaaatatcagaaacataatttagaaaactcaagaggagaagaaaacccatatttttgtttagtatctttatttcttcttgatactttcagattccttctttttttgtttctcttttgtttcaagaacttcctttagttatttttttaggatagatctgctggtgacagattgtctttgttttcttttgcctgagaatgtatttctcattcatttctgagagataatttcatcatatttagaattcaggttgacatttctcttattttagcaattgaaaaatattgtgccacttccttttggcctctgtttctgatgaggggttggctatcatttgaattgtttttcccctttaggtaaggtgttgcttttttcttggagcttttaagatatttcgtttttagttttagtttgattatggtgtatcttgtaacagatatctttgggtattgtttgtatagggttttacatagtttttcaatctgtaggcttatatctttggccaaatttgggaaattttcagtctttatttctttgaatactttttttttttttagcccattcactttcttttctcctggacttacaatgatatgagtgttagactttttgctatagtttcttaggcccttgaggctccgttcattttcttttcttttttttttttttctgtagtctgttttctgtctgtttttcagattgggtcatttttattgttccatcttcaagttcattgagtcattcctctgtcctctccattctgtggttgagcccatcaatttgctttttgtatttcagtaattttttagttctaaaatttccatttggttctttatgtgctttctagttcttgttctagaactggaaagcccaataatacatttttgtactgttactaaagaaagatatttt

SEQ ID NO: 130969 - DNA, 1179 bp, Homo sapiens
ctttttgaatattagctttcttttggcatatatatagcactcactatatatatatatatatagtgagtgctacagacaaagttcttgagaccagacaggatcacacagtttaaaatgtttataatgtctctgtctgtcccttttttcaccatctcctttactgcactcttttgtctgactctcacaggagacatggattacaactggttggatcatacgtcttggcatagcagtgaggcatccccaatgtctttggtgagacatgtggagccttactatttaattttcgttatcatttcacttttccttttttatttacacctttgcatgtttcttttttgtatcttttttttttttttatcccatacctgtaggggacagtcaaaagggaaaaagaaaaactagtgagcaggcagttttgtcggactctaacaccaggtctgagagacaaaaggaaatgatgtactttggtggccactctttggaagaggatttggaatggtctgaacctcagattaaggactctggggtagatacgtgtagtagcacaacccttaacgaggagcatagccatagtgataaggtactgagattgtggagcctgccttttaacctgctcatttggtcttcgtttgctctctgtcactcattaaaacagaacataataaaaggacagggcatctcaagggtcactgtagcatttcttaaggtgcagaaaagaaaaacaaaaccaaactaaacaaacaacaaaccaaaaaaaacctcttgcttgctttgctgtttttattgtttgacggcataccaaaaaataagtatatgaaaataaaacttaggaacaaaggaatgttttgtcttttgtcgcatgagagaactttgtaatgttattaaaaaccacaaataataaataagttttggattggcttatttgattgtttgcatatattttccttgggatgaaaattaaattattaatagtttgaatcccaggcaaaagggagataattgggtctgtttgcacagaaaaagttgtttttcttttttccctttcactgtcattttggtcttttgttttattgtcatagcattttaatgtggtattaattagtattagagcccttgccatctgctttgatatttatcattgttgctcttaggatagtgggacttttgatatctttt

SEQ ID NO: 130970 - DNA, 1179 bp, Homo sapiens
cagcaggtatacatatgactccacagcattattcctaacatttttattcattttctaaaagttatattttaatagaaacataaaaatgaaaaattgggattcagatggtctgaattttatgttacttctgatgcgattacgtaaattttgtaatttttttcaagaaagatccatcatcattaagcacattatcagtgtttctaaaagattatcaatgaaaatttggtggtatatcctaattatagtaaaagaaacaaaaattttgtattaaagtatttacatctataactagaaatgtttatataattaatgatactgtaaaatgtttttgtaaatgacaaaagcaagaattcctgaatcaggacaaaaattaccaattgttatgttgtttctaagttatgcaacacttcagcaaattatggattaaatggcaaaacagttggaatatgtgaaaaagacctagctcttagggcatgtgctaacctaatagagacaataaattatttaagaaatcattttctgtacattaaattagcgttttaggtgttgcaaattgttctaggtattcttttacctgaatcttcaaccatgctcattttaacaatattcccatgttaatactttcctcttttaaacaggttgtaggaggaaagatgactgaatcaggtcggctttgtgcatttattactaaagtaaaaaaaggaagtttagctgatactgtaggacatcttagaccaggtagggttttacctttgattatttacatttaaaccattcaactttagtagttatgagttattttcatttatttagaagtgatttgacaataacaaagagctcatttaacttagatataaatctctattcattaatggaaaggcaaaactattatttcttgagtcatagtagataaaaatcatttttatttgactttatcttacttttttctgattggtgttctaatctgtatctaatattaacctgttttgtttcccctaagacctttttcttttgagaaaattccaacatagtttagaataaactttatggataaaggcatatttcctaccgtgtgtgtcaccccttatctctttgttaatggatactgttggagaaatccttgagtaccttaaagaggatttgataatatactaattattaaggtttttacaagagaat

SEQ ID NO: 130971 - DNA, 1021 bp, Homo sapiens
taattgccactgaattgtatactttaaaatagtcagttgtatgttttgtgaattttaccttaattgaaaaaatattgtcaacgcaaaaatatatttttatagccatatttaaaatataaactcatgggtgaagattaggtgtaaattgccataggtttcagaaggttgatttcagaagtctgtgagatgcatgtctgagttcattttagaacatggaaaaatgtttgcttttaaaggattaatttatttgaaagtattccttttaaagtgaatcttttattttatgacataatatttacttgtaaaaatattctgtaacgttaatatttttggtctaaaacaaaacaggtaggaagacaggggaaataaaatgtatttctaaagtaccttgtttagtccctttcttcaacatgccaaatttctctatgaatttcatatatcccctctgtcatttgctaaagcattataatagcctgtggttatgccaacagacatcagtaacacactccacatctgaatatttctttcttcctttgggaatatttccacataaaaaggaagacagcttagatttgaaactgccttggttttgaaagagacagagacagagagagagagattgagagagagagaaagatgactcatgactgaatgacagtctgcttttaagtctgctttcctttgggttttagatttatgtcttaaataaacgtgtctgttcaatgccaactgaattgagcaaaagtactcctagtactcattatctgtttccagttagcagtggaaagagagaagcctttaactatttatgattttgaagtaggcaagagagacatccataagaaatgtgaggaatgggatggaatcttggtgatagaagcagaattaaatgccttgaaatccattcccaaacctgattatgttctgattaactgttggaatgcctaataaaggcacaacattctgattattgtgatgtcttttggaaactgtttcaacatgaaaacaaaagtcagtaaga

SEQ ID NO: 130972 - DNA, 1011 bp, Homo sapiens
agtatgggcaagtatgactagcccttttctgtgtttcctcatctacaaattgtaagtagaagcaactacctcataaggttgttggacataccatgaggcaataaacttacaataaactgtcaataaaggcttggaaaagtataacgaactgtataagcaaaaagaaacaagatattgtcattaataggtgtgattagcagtaagcagtgttatcttgagtgatacataataaatatctgatgatggtgtttcaatactagaacctgatagggattcaccaagtatgaatcaactaattagtccaacgtatttctgcacacttttattttaatgtgtttattcttttaagaaattctaaagccaacttggctaatagtttttggactttgggtagacatactttggagaagtcacacaattacttccacagatggcttttcactaatgactctgtaatacattttcaactaacttctttttgcactattctattttttatgtagtgtgtttaaggataaaatatgaaatttattgattcttgggttatgcttataatcattctttcaaagtacatgagcccaaatatattattttatatccagtcttaattcttgttatgtgaactacatttgaaaaattggattatacaaattctaatattttgtatagtttttaatgttttttggcattggacaaaattaatttattcatcacactgaagtacttaattttgataaatattgtcatggaaaaattgtatttaagggatagttgtatgtgtttgtttttacttttggtcttttagttccagcgtgttgtcctttttggttttgttttattgcttttttctttaattttgcttaccagagccaaagccttagtagaagaacaacgccttttgttcctagggttcaggtaaaggccttgtctgcctgatagaaactaaagttgtgtttaaccctatttgtatgtttttggaaaatgcgttagtaggaaaactttttttgttat

SEQ ID NO: 130973 - DNA, 1048 bp, Homo sapiens
cgaactcatgtccaaccacctatgaggcatctctatctgcaatcctataggtcatgtatgcaaatgtgtctaacactgaacatattttctccatacaaatcttctcctcttgagtatattattgagtatcagtactagagacctggtagtcatccatatgatggttatatataaggatatatgatagtccttatcatatccccactgttattagtttaatttgagctccttgtgctgcatctcttgtagcagtaatcttacttaactgtcaaccttccactgaaacttatacctttagttagagatgcaattaattaaaacaaaatttggacttcaccatatagtgactttgtctttttctactgtgctttaaaataaacctcgtttcttagtgtttcaaatggtttactaagatattgaatagatcttgttgttttagtcggaatgtggaacaggggcttcgagggacccgcactatgaccggacattataatacaattagccgaatggacagacatcgtgtcatggatgaccattattctccagatagagacaggtaaatatgattaaatactattagaccttattattaatataatcactgctttcaggaaggggttaccataaaatattttcacatattcctttttcttagtttctgaaacaatgtttttctcttacaacgcttacattatttcttatgactgccacattgttaaaggtaaataaatacaaacaaccttttctctggtaagaaaaaaacaaaattatctttctcctgccattttgtttttggtttaatcaaaccagttaagttagtgaatctgtataagtgattataatgttaattatagtgaaaccaagatgttttattatttttcttgtcataaacaattatatatataaatactttcatgagacaaaagattttaaagtcttttacattcatcagagaaattggtgtgacttttcacatatggaagtattgagacggagtctgatttgtttaggaaacattttatgattcatgaagaggtttttcctcatg

SEQ ID NO: 130974 - DNA, 1006 bp, Homo sapiens
taatggagtactcggcatatagttcagtgtatatgaactgaactataagttaaataaagactatttttaatagctagagaggtttcagaaaccaaaaaaggagagagtattaaaaaatagaggtttgaaaatcaatgtctaataccaaacgtaagtggagtatgatgaggattaagaggagacgaaagaattttgggggaattgcacattcataagacagcttcgagagtgtggtagaagcagaagtcaaattacagtaagcttaaagcatgaaagcaaactctagcagaggtggcaagaattgtagatatgtattttaagatgttctatgttgaaaagaaaatgagcgagatacagtggcttgagaggaaggaaagattagcaagggttttatttttaggattaagtgcagttgaggaagggaataataaatgaagcaaggtcatatgggaagcaggattacaagtagaggcatctcttttggtgcagaagacaagaacaagtgaagatttaaatgtatgtttactttatatttagagatagaattgtggaatttgagagagttcaaggttcatttccattgtttatggaaacataatgataatctgctaagattaattgttttagtattaaaggttctaagaaagtaggaaattttaaattagtgctgtggaaagaagagatgggtaaaagatcagtgtgctgcttggattgcttatggtagttatgaggcatgaaaggtagcaaagccaatagcatgtaatacataatacataataaacatagtgaatggaaaaatgaatagcacccaataaatttaataaatacaattaataatcaaagtaatttggatcagtttactctttattaaatggaattgttaaggccctttgtagttatttttaattattaataattaaaagagaaatagttaccttttaaatttcccaacttttataagtatttgaaattacctcatttattatttccttcttaaactttctgc

SEQ ID NO: 130975 - DNA, 1074 bp, Homo sapiens
tattttcttataacctcattttgattcttctgtttaaatgttcaggtgtatagtgttttctgaaagcctttttatatcttagttggtatagtactaaacagcttcaggtgctacagaattaatgcttatatggttttcttcactcttgaaaatgttaggaaaagtcattgaattcttttaaaatagaataattcacatatttcacgtattccatttagggaattcattttggaaagcaggcagttttgtttgttgtttattataactgagcaactattatctttgctgggaattactttgaaaggcagattttggttttttagaaattcttaacaagtttcgtttgaaattgctcagaatatgttggggaaaagaaaaatttttacatactccataattttaaacaattacctttttcaaaatcagtttgatgcatcataaccaaatagcagaagggcactaaagatcaactgagctgctttttgactaacgtttcagggattgtgaagcagcagatagacagccatatcacagatccagatcaacagaacaacggcctctccttgagcggaccaccacccgctccagatccactgaacgtcctgatacaaacctcatgaggtcgatgccttcattaatgactggaagatctgcccctccttcacctgccttatcgaggtgaaagataaatcaatcagactaatttcccctttgccccaccagcacaccattttattttcccaacagttaactggtctcttctatcatctttggctgatcactagtaacaatcgatactaaccttttcaatgtaaacacactatttatattcactggatataatagtgtgtggctaccattgtaatttgtttattaactgtcctgactgcatttgttttgtgatttctcattaatcaggagtcctgggtaaattctgtcattaactgtcatgttcctctcctacagaatgagaaactatctgtgtccattacacatcacttttcaaatcatcataatgattataaataaaactagattttttaagtttctttctatcgatactaatattatgta

SEQ ID NO: 130976 - DNA, 1524 bp, Homo sapiens
gatgtcctttcgttgtgtagacttaaatacagtaaaattattttgttttatgatatctgacaaagtattcaacttttttttaacttggaaattataccaaggagttaaatatctttgattcatcaaataagaatgcaaagagtttaaattcttttaaatgaccagataaaatgtgctctttcataaaatttttatgtaccttttaaccagaaactagatttcgagtaagactttaaccaaagatatcaattgcagtctacgtttacatcattgaggatgtacacatagtgtagttatatttaccatcatatatttcattttttatgatgatgtttttaattattaaatttggctttctagaaaagaaagttgttgaattagaaagtgattgtggcttgcgtttccaacatcatttttcatgttgtagcaagactgcttacagtatatcagagttaaatatgatatagttttattatcaaacactacattatgactcagaagaaaatactgaatggtgatatatggagtgtcatacatttgctagatcaatacaaaatcctctaccagttatggaaatctgaaattaactttgtatctttaaaaacttgttgactgtttacttatgaatctctagcacatagaataatgcctggcacattgtagaccctcaataaatctttgttgaatgaattcatgaaatatttatttaaaaagggaaaagctacctcaaatagtatacaaagtaccactaaaataatctcgtcattatatatatgtttatattaaattcgtatttctgtaacctatttgtaacaaatttgtaagcgtgctgcattcgagcagcaatattttatacccttatataacttgttgatataagttgtgttcttgttaactggatgatggtcaacttctgttttgtcgttctttctatttccaagtaccataattttgaacaatccagtgatattgtgactgatggtctgttatgctgcctgagaaaaagacttcacagcatttttatagttcttaattatttgcttaaaattgggggcatagaattttaaatcacttttcctaaggaaagtttagtaatatttatggaactttttgtctcttcagtgtttttaaagatggagtttcaacatcatttattggcatttaaagtcagaaactataatttatgcacatttttaaaattgaatttttaatgttgttcatagcaatagtctattgaaatataagtagctctattctttgtaatagcaagtatcctagaaaacagagcctattggtaatactgaaattcagagatggtgaagtttctgatgggcttctcaataaagattatctttactattgtttttgtccctataaaattaattaaaaccacagttttcctttaaagtccccaattgtgatttttccattttttttatttcataaaacaaagaggagccaaaacctcccttatcctttttagtatgaaataaaaggggttttgttttttagttttgttttata

SEQ ID NO: 130977 - DNA, 1891 bp, Homo sapiens
tgaccactttttatttatgaataatagagtgtactttttgtgcctttttttcctctggttttcatggtgtgaaagcaatgccattacatatattgtacataagatatattttcatggaagcattctctcaatggagtttttagttttacaactgaaaacatctcttaagctactagaattactcattatcagtaactttttaatgtcataaaggcgacaaatatcatcagtcatctgtaatggaaacaggcaagtttaattgcatatttctagacatgtagaattgctttggttctgaatatctactatctaacttttagaatgtcacccttcttccattttcctgcaataatttaggaattgcatttttatggaatactataagaatgaatttcattttagcttagctgttaagttaatgttttcccattagctcattcctctgtatctcatatagtccatacaaacactgcagcctttcacactgttaattgtcttccacattaaagtcattttttaaggtagcattagtttggggacttcagcaatagttaatatcacttttatttattttaaattcattaagataaagaagcccatgtgctaaaccagtttgttgctgctgttttattgtcaaaagtaattagtaagttgcatcagtttttaaattaacataaaagcataaccatatactataaaaatgatttttcatttatttggttttttttacttttcctatgagataggaagtatatacttttctcttgtgttcattaatacagagtgtcatgtttagtgcatggatttgtttccctattgtgtgatttcatcttttttgatgtgcttggtttttattttggttattaatgatcttaatcattaatcactattgtctattttcaatattataaagacaatgagggagaaacatcaacaccacctactaatgggaaaaaaggcaagtcttaaaatgaagtttatggtgtctttctagatattagacactccatactgacatttgtaatatatttgaatatgctttttaaaataagcataagtattagtctcaatttaagttatccagtatttaaaatgtctattcttttttatttctgaatatgaaattagtcttcaaaatacttacctttaatgattctgatgcaattctattttattgaatgtaatggcattaaaattggaagatttactttgttgatcatgttaagggaaaggattctgaggaagatactagtggtcatgttatacatttacaaaatcacagcatggatatttttcaatccagaaattgttttaaaattgaattattttaaaaacattttaaagtagaagtttaaagtagaaaatgagacaaatttaatcataagttaaacaataatataaaaggaagatttataacatttgtagatttttcatagttctatacacatgaattaatattgcctggaaagtaaaaagatgattgattttaatacttagatttgattttcctataattattgctgacataattctgtaatctaccacaaccaaattctatcaaaatggtaggactgtgtatgttttgcagtaattgataatcaaatatgtctacatatattgatttagaatattagcattttaaaatgattttatcaaaaaagtaacatcccgttctatatcataaaatttggcccattactggaccaaattaagaaataagtagttttatgcttcattaatttcattgaaatggtttttagtcttgaatgtattcttccctgtcttcatcttttataaagaatgtctacagtgttatttgtaaaacctaattaacactaaaatacagtttttcttactgcgaagtattaattattctttaatgcacattcta

SEQ ID NO: 130978 - DNA, 1157 bp, Homo sapiens
tgcattaccgcagattaatgctgatcagggagcagtagtgtatccaaaatcacctatatttgatgttacagtatagcatatttttccatttttggcagtggtttcatctttccagttatgttttacttagcttgatattataaaatatgttagtattccactatttatggctaaaggtagataggataccagagcattgtgtatggcatggtgaaactctatagggattaaaatacacatagagcctggcaaggtggctcatgccataatcccagctactcgggaagctgaagcgggaggataacttgagaccagaagttcaagaccagcctgagcaacatagcaagatcgtgtggctaaaatatttcttaaataaaaatcaaatatatataattaataactaattgacttatagtatggctttagaaacatataaataaaaagaaagacaagttataagatatataattatttgtgaatgctactatgagaataagattaaatggtggccagtgaatcttttgttccatggcctataaggccctacatgacctgtgctcccccacttcccatctccattactacttcaatcttatctattacttttttctttgtttgttatgccccagccaaagtgacctccatgcttttctggaacatatcagacatgcttctaactcaggacatttgcacatgctgctcctctgcctggaataccttctctttaaataaccatatggctaactcccttactatcttaagttctgtactcaaaagttgccttcttagagaagacttcccttcctgccttatcaaaaatttcattacctctggatattttatttccttcttacctactttgtttgtctttttagcatttatcaatatttaggtcatagtatattttacttatcttgtttataatcactctctcccattaaaatataaactttatgaatgtatggggttttgcctgttttgtttgttgttatatccctgtacccagacatgcctggattatagtaggtgctgaatatatatttattaaatgaatgattgttaaccacatgagaaataattgtagataatcttagatgagccaagtaactcatattcaatgataccaagctgttactactaaatatctttgtcttcct

SEQ ID NO: 130979 - DNA, 1030 bp, Homo sapiens
tttctaaaaggaaattgggatatttaaagaatatttttaattatcaaaactttggagtgataaaatgggaggaaagtagtaggatgtaggtatagcagatgatatttcaacaacatgtttatatatgcctatgctttacagaagacatgtttggagttatttctcttatgtttaagtgcatttatgatattaataatctattgaatataaagtgcttaatgtataatttttatgtgctgaaatctaagaaacccacttcaataaattgtcaaagattccttgtcaaagggttaatggggcaaacttgtggcatcagaaaaactgtatgggaatgagcccaaacttgagatggaaagttggctgtgcatcaatagcatatattgttttctttttcaattggtgttttatgaaaatctatgctagaacaatttataatacctgggaatttgccatttctgggatgtttactagcaatacaaataacacttgaaatttttattttaaatgtgagactatagaaccaaggagctaaatggtatgacatggactagaaaacgagttaacaagtatttggatgaattttgagtactatgactagtaattgctttttttaaagaatgatcttggtatttctgaactgggatgtcttgagaggattatcagcaaaacaagtgatttacttgcagtatctttttttttttttttttttttttttgaaacagagtttcactcttgttgcccaggctggagtgcaatggggtgatctcggctcactgtagcctccacctcctggttcaagcgattctcctgcctcagcctaccaagtagctgggattataggcacccgccaccacgcctggataatttttgtatttttagtagagacggggtttcaccatgttggccaggatggtctcaaactcctgaactcaggtgatccacccacctcagcctcccaaagtgctggaattacaggcatgagctacggtgcccagccctacttgcagtatttttaccttaattgacatca

SEQ ID NO: 130980 - DNA, 1070 bp, Homo sapiens
tactatatgcaaaataaatacttacagcatattatcatttgcctaagacatggctgcttacgtaagggagttgactataagtttctcttttaaaatgaggctgtttaaatgcaatagtacataataaaactataaccacaggaaatccaaaaaaccaaaaatgttttaaatatatctgatacaactatagttatatattgagattttatgcattacatgaatttttatttgctaaagttatatttttatgtaggcttagttatggactaattattaatggatcatattcagataaactatggcaaatgacttaattgatacttttagtagtgaaatcattttcaaaatatttcattttcatcaccttattaatcatataaattttgtacttcctgaaaaaaaaatttttattgttgattctaagataagttttgccatattccttataagaatgaaagcattggtgaattacttgacagttgtagaatgtgccactttgaaaaaaactgtttccaattaaatactatataataaaatatccagttcaggcgtcaccatgagagaattattttttcttctttgtttgattttgtattttacatgtttttattgggtcatatagtacctagtccaaagaaaattgacctggtaatcaggagacctgtgttctatttctggctctgcaactgaacttgttttgtatcattgggtaagtcactggaactatgtgtgcctctgctattcactaaaattaattcatgagtgaattgagaataatttttcatgtttggatccacataatatgaaaaccattgcattgatgacacataaagtaattcaaaatataggaaaatactagatgaagaaaaaagcttcatttgtttacgtagtttttatactttctgcaaacaataagatcttttcttagagatggaatatatggaagccattatttcatccacttcataccaatttcatttttacttgtgagggaactattttagtagtatggaaaatgtgtatctagggaaattttgtgtataaaaacacaatgcaacatacgaaagtcg

SEQ ID NO: 130981 - DNA, 1474 bp, Homo sapiens
tttatcactattcatataaagagacaaatttgtcataggaaatcattctctaaagagctataattttaatatgttgatattgcaagtatattttgatgcaatatgctttgctatataagtcaactcaaaaataatgatgcaactcttgcagaacttaaatgtggtgtttgattttagaatttgtagtatctgattcaaagctaagtgtttaaattaaaataggagattttggttttgtggcatattgttcatctgtgtcaatcatactagtacactaatatctttggaagaaattttttcttagaatgctcagtttaacagacatttttctgtttccaagtcactgtataaaatgttatttgaacttcttcactagcactagggaaaaaagtttttccaaaacatatcatgtcatatctgttatagttgatggatttggatggatacattttagcgtaaattttaataatctataaagtggcatttgtaagaatctgttgaatgaataggcattaaaagggaatatgatcaaagaaaatttgtctacattgaagtttagtttggatttttaatgctgaaatgaagccatgtatttcagctactcttctagtaaagacttgtactataattattacttcataaaattttaatgatattttgctgtattgaaataattcaattaaatattggcctgatgaccattctttgtttttgtgtgcacactggtttactggggaaacataaaaggaatagaaatctgttgaaactatttttattgctctttttggtgatgactcaattaaatcttttcttcagataattaaaagtttgaaagcattgtaacagactttaaattgactcagtaatgtcttgaacaatgtggtcatgcaactaacactgtttttactaatggtatctttcttcagcattggtgttcaggatttgctgtacgtaaataattgtaaacttctggatcttctttatttctacactaactttatttttctgaatccgctaacctatagtaacaaaatcaacttgccatcagttcttacgtattttttgtggaatgcatttgattatatcttccctaaaactgtacacaggattctttctcaaaatgatctgaggccctttccatcagtgtcactttttaccttttgagtacatccactcactcccatctcctttgtctatgtctgtccattacacgatgtgatcacagaagaactggactctacaaggagaagatatgcaggtctgtctcttctgctttttttgttattattttatttatctaacttgtcctagaaatgtttaatcatttttttactcatttcatagtttttcattcctttgtaatataacaaaatattaaatcttatgagcattttaatttaggtatttgtgtattcaactatcaacagcaactgctccaattagatggataaaagtaaaataattaatttttatg

SEQ ID NO: 130982 - DNA, 1983 bp, Homo sapiens
tacaagaacctctttgttgatcctagttctagaaaattcaaattcaaaagtttctgataattggattcacacatatactggggcaaactgcttcaatgcatagcctaattttatgataacagtttctaaatgcagttctaaaattgtatttgaaagcaacttataactttaatacctataaataaatcatgatgaattaaaagtcagagttcacatgatattattattgtcaaatttctgtgcagtcaaatgtattctggacatacacataccagaaattgttttctatctaatgaagatttgttatcttctctttaaacttatttatattttattcagattgaaattattttacatatttaacatcatgtttttacttatgaaattgtatactttaaataaatctgtaaaataatatgacatttaatttgtacatgctacattgagtgaaagtaatataccagcctggcttttcttcgtttatacatcctgtaagtcggactcagaaataagaactgaacattaattttatgggtttttttctactcgataggtactatggatatagaggagagaaatcgccaaatgaaaattaacaaatacaaacaggtagccggatcagatcccagactggaacaagattaccattcgaaggcaagacatttttctttttaaaagttgtaaaataatcaatcatatgaaacagttagattcttttaaactactaaatgcagattagtcagacacaaacatataatgccatggccccatgatattattaagtgctaaaatttatgtgtttgtataccgctcttagcaatagaatttgccttacttaaaaaaactattataaaatacagaagattaaacatctgaaggacaaatcttttacagtttttcattttgtaaaatctatagcccctcaaaaatgtttaagaacttaaatgatcttatggttttctttcatatagattttttcccattttatagtattttaatggaatctggtttattactgaattattggaacaaaatacaaatggtgcctgccttatagtggatcaacttacaagtttttgactttagggtagtgtaaaagcaatacacattcagtagaagccatatatcaagtactaatacaaccattctgtttttcactttcagtattcaataaattacatgagctattccatactttattataaaataggctttcagttagatgattttgcccaactataggcaaatgttaagtgttctaaacatgtttgaggtaggctaagctaagctgtgatgttcagaagatgtattaaatgcattttcaacttacagtgggttcattgggacataagcccgtcatgaagcaaagagcttctgtacatattcacgaagtgctgttagaggttcaaaagtcttttggtatgaatcttttttaactactttttgggaataagttgaagtatgaggtctaccaagggaggaaataaagtattaattaattgttctttttttttttttttttttttttgagatggagtctcactctgttgcccagactggagtgcagtggtgcaatcttggctcactgcaacctccgcctcccgggttcaagcgattctcctgcctcagcctgccaagtacctggggctacagacatgcgccaccatgcccagctaatttttgtatttttaggagagacgaggtttcactattgttggccaggctggtctcaaactcctgacctggcgatccgcctgcctcagcccaaagtgctgggattacaagcgtgagccactgcgcccggcctatttcattgttcttgtactccattacctttttatattcaagacatttttagttgcttgatattattcgtggtcaaagtcatgaaaatactttgttctgatatagctattgaagatttaataaaagaattaaaatagcaaaatttactcataacatgtagctgttatatgctgttat

SEQ ID NO: 130983 - DNA, 1043 bp, Homo sapiens
aaattttagcgattttgtatttttatttgtgattaatcttcgattttaaaagtttctagtttaggtttctttttccttaacatcccatattagttgattagggctgctataacaaaataccatagaaggggtggcttaaagaacagaaatgtattttcccagttttggaggctagaactttaaggtgttggctaggctggctccttctgaggcctttccatggctttcagatggctgccttcttgctgtgtcttcactttgtgtgtgtctgtgtcctaatctcttcttataaggacaccaatcatattggattaggaactacctatgtgacctcattttaccttaattacctcttgaaaagctctagcgtcaagtacagtcacattctgaggtactgaagactaggacttcagtataggaatttgggaggaacacaattcagtctataacacatctctacaaagtagctaatgatcttttaaattaaaactttattgcattgtgaaagcatatttgattagaatgtgaatagggatttttaggcaactaaccgtagctgttttgctttgaactttttatttcttttttgattttattacttttctctatttcttcctatttttacaactgccttctcaaatcctaagagataaaatattttggttttgtgtttgcaaatgcatcttaaaaattagctgtcttagccatgaaaaccacatttaaatatgactcgcgtagccataattttatgctgatattcaagcatgggtccctttcctttagatgtatttgtgaattgctaccttttaccatatattcacattttaagccaggaaatataaaaagactatttttaattatgagtaagtcttccagtgtggcagtattatgcaaaaaaaaaagtcatttgagatgacaaaaacagcaacttgtatattatagaacactgtagaattatagcagaaattttaacttctccctttttagtaacataaagtttctaaaaactgacaaagagagaattgtagataagttgcaggcag

SEQ ID NO: 130984 - DNA, 1786 bp, Homo sapiens
cctgagtggcaatatctaagaagtcattatgggaaattttcaagaagggaggggaaagaaaaaacctaaaaagataccactgactggtaaattaggatgttattggggaattttgttctggtgggtttttttttttttttttttttgagaacagttttagtacatgatagaatggcttaagagttgttgattctcttgaagaacatggtaaattcatttgttaagggcaaaagcataagctttgcagctacctgagatctctaaacctggggtttcattgcagcgctggcacttctatctctgaaaactgagaaatcgatagaagtaaattaagattgtttctcaaggagaagctgattactaatagacattgagttcccacaaagccaagccttagggaaggtcataattgactactggcaataattcttcctctgtaaattatccaggaaaaattattcacctcataaatttccttcatatcaagcgacagctggttcattagtaagtcttggcatacatgctaatggctaccctttcttcgactaccgctttttactttaagctgttcttgctatgtcatgtttcaaagacttccctgagtgagtctgtttctagatctatagaatggagaaaatgccttcttcacaggtccaaggtgaactttaaatgagatcacaggtcttgatacacagtaaatatttattgtcccttactcattctctcctaaggagtcttagccctataaacaaagcctgtattcctaaaccccacaaccagtggtgtgcccaactgtctgttcagtgaccacttggtaacttgaaatcagccataatgggagtatttatatcacggaaatcagaaaactccgtaaattggaattttttttcctcagaaagctagttgttaaacatttactgtaacagcactgcctatacccaccacagagaatgaaataattaggtgactaaactctatacagctatcaatgtatcttgtacactgatttgatacttcataatggaataatacttcagtatatagcccagataaagctaaatcattccattcattttgatcattaaacattcattgagttgcttctaaatgccaggcccagatatagataataagattactaaaatcaacaaaagtcattatcctctgggagtttataatctagtggggtgggtacattacaaatagatggctaaatagctggatagatgattgatacatggatggatggatggatggatggacaagggagaagtacacataataccacatgataaaactgtaataaaggcatgagtaaagtagttgaggaacattcgaagcagtgcttctctttgaaggagttaaggaagacttcacagaggaggtgacatcttaaactgtgccttagaagatgactagacctatttaatggagagggtgttgagtatggctcatcctacctaactgtacttccttctgactccagctatcacaaaggcgacctcataaggtttgggagaactaaataaaataatccacacatattatttacaacagtatgtttcacagggtatacaaataataattgtagctagtttaattactataccaaactgaagaggccatcaggcctgaggaccaacaagggagaaaattcagtgcctcagtctccagtgaaaattttatgtcctagactcctttccagactgaggcatgatgttcgttaggctcagctttactgcagactccttccttttgagctctgcagctatcagaaatctttcaa

SEQ ID NO: 130985 - DNA, 1052 bp, Homo sapiens
tgcttactacatcactggaaataatatcttttttcatgtttgtaatttaaaaattaagacctcttatatctttattgaaataaaagtgatggctgagacttgaatttttcatgttccaaggaatatgaaaaataatatattttgttattagaaaacataagaatgttactttttcagtaggatgctttcctatcctcttgaaatttttatatatgcatagaaaaagtcctcatcttctcaagaaaatttatacatatagtatataagttagtataatttgcatttcttacttgtcctatagattttatagatgcctaagctaaattttgttttactcttattggattaaaaattttataacagggagatcacaacttttaccttttttcatgtaattttgtaaaaggaaaatatgatttaaaaactattacaattaagtgctatttatacagtgcttctctagtatacactgaagtaagttttcaacatttaaaagatataatttttacttatgttttgatagtttttattacctttctgtttaatttcataagtgttttttcttgactttctttttttgtgtgtttatttgcatgccttcaatttctgttgctttcaaaagaccaaagggaatagaagagggagggaaagaaggggataagcatgaagagatagttcatgagaaggaagaggtaaaggaagaaagaattaatgagaatgagaaagggaaagagattgccaaaacgtgtaataaggagaaaaacagagaatcaggagacgaggaaaaaacacaagatatacacgagcaagggaaagaaaaagaacagtggaataaagaggatttgcaaaggagattctcacaagatgataccaggtaaaatatgttatttgtaggcatttcccattagtaatgtagtcttttttaccattcctaaaaattattttgccatttccatttgctttattttcttgtgttttatctatttagcttctaatattactaattaatatgttggcaaactattatcaaatagattgatttattaaacagt

SEQ ID NO: 130986 - DNA, 2075 bp, Homo sapiens
ccttccacttcactgcagaataccttttgaagacataaactgtgacaagaaaagataagtgaaactctttcagccttatataaggcagaaaaacattctcaaaagaaaatctataatttcttgctgcctctaaccattaaaaagtctttttctgaattaatagcttaagaacatatttgagaagcttaaacagtttttcttatccttgatccaaaccaagcataaggtttttaaactgtaaaaaatacagtaattaaaacattacatattattttgcacatgagtcccatgggttctcttgttaagtctttttaaaatattccagctatgtgaatctgagaggacatttagctaaaatcagtcaacaagataagaatatgagctatgaatacttagaaatataaaattgaatcttttaaatcagtgcttttcaagtgtattttcagaaagttaatcccctgcactgatgctttaaaaaaattattccactatcaaataaatttgggaactactacacatacagtccttctcatcaacattcacagcatacctgaacactctgagatgcactataataaagttgtatttaaaccagcattttccaaactttgtttatagtggaactattttagtgtaatactttcagagtcattcagggaatgtgcttaaaactcattgacatgctttaattttccatttcaaactttggcctctattctttcagtaaaataaatatttttattcttgttgagtttaagcataaaattatggtacaaaatatggggttgtctagaaaaaactcactgtagggattgatattatctctaaaaaagctgacagatggaactagcaaatgaattgtaaaatcaagtaaggattaacaaatccagtaaagaggaaaaatgttatccaaggaatacaagatgagatttatctctcaagcaatgacactaatagagggaatataaaaatagtttctatagttcaataaatattatgagaattgatcatttttgctgacttcccaaatatattttaaaaattcagtctgtctgttgtttggggaatcacttcaaacaaagcagttaagccacagtataaagagatggaattgacaagtggctcattttctttttgtgcgtttgtttgtttttgagacagagtctcactctgtcatccaggctggagtgcagtggtgcgatctcagctcactgcaacctctgcctcacaggttcaagtgattctcctgcctcagcctctccagtagctgggactacaggtgcctgccaccacgtccggctactttttgtatttttaatagagatggggtttcaccgtgttggccaggatggtctccatctcttgaccgcgtgatccacctgcctcagcctaccaaactgctgggattacaggcatgagccaccgcacccggcctcccattggctatctgtctgtctttttctatgcttccaacaatacgttggcttggaaacattagctgtaataaaggaggttacagctctagaactcccttttatgtcatatatacatgtgtgcatgcatgcatatgtgtgtctatgtatacatgtgtatataccatgctctaatctagcgcatgcttagaagactctctcccagtttccctctttatgaattgctctatcctattcttgccataatgtctgtttatttctctcctcctcattttcatttccaggttggttttacattgttatttaatgattatgagtccattattcccatatctaatatttcaacacatcattaaagtttcctatttccactattaattggaatataccctcttcattaaaagaattaattttacatattacacaaaatgagcaaattcccttatatttgtcaaataaaatattcaaggtcaatcaatgtaataacgagtgaatgttataaggagatatttagagacttctgttaagataaaatattgctacctcatttcctgttatactttcagagtcttcaccattttattttaatcatgattttaacaaataataatgttgatatctcatttgtagggtgcttttctg

SEQ ID NO: 130987 - DNA, 1031 bp, Homo sapiens
cagagaacaatatttagggcatactgaaattttaggttcatgggagcaaagtcttcatctgttgtgagcactgctgtatccccagtgcctagaacactgcctagcacagcacaggtcctcagcaaatacctgttgaaggatgaatgagtccctatttcagtcgtttttaaaactgcagtttttcattaaaactactgaactcagacaataaatgagaaagataattctaaaaatcaaattttaaatatcaaagtattaggtaaaatttagtgcccttttcattaatcctttaactgttatgaaatataatcatcatgttccttttgttcatacttttctgctaatggttcattcttaaaattgtaacatagtacttctctttcataattagattataatatccagaaaaccataggccatcattggaaaggactttagaagttaactatctagtaccctgaactaaactaggactcttcctatgtcagtggttgtcaaatcaggctcataaacaaaacactgggggagctttttaaaaacataaattttctggccttgacatgagaattctattccagtttgtatctaaatgtgatgaatgctctaacgctatacgatatcactaatagttgattgtccaatctgcttgaacagttgagagccctctaccttatgaggcagttcatattcttggacatttgtaattattataaagatttttcccaattgggccaaatcctacctgcctataacttctttaaaggagactgctctttacttgggagatgattagaaagatattaattttaaaattatcttttgattgagcatatatcttacgcatttctgtatttatgatatgtttcacggttcttaaaacatgaaaacaggactggaagaaagaattgcatcagggactatcattttggaattggctctagttatgctttaacccactgactatatatataaagtaactagtggattacatacatatatatatcatatatatacatataatatgtacatat

SEQ ID NO: 130988 - DNA, 1708 bp, Homo sapiens
gtaatcagaatgacacaaagaagccaatatggttctagatatactaagaactaactgaaaataatgcagaacatatttaaccaaaaaggaaaatgtgaatagctggggctggagaaatccagtattatctattatctgctttctgcttgccagtggacttagaaatataaccataaaaatcttttctaagcacaggaaaagcaaaactaacaaagtgagattaaaaatatatcacttggttagatggtgagttagtgagttcattttgcctcttctcactcaatgtcactttttgttagcctctaccagggttctcaaatggtttttgtcacttgcaatagaatcgccagagaaatctcaaaataaaatatctgcccctcatgccaaaagtatcttattagaattcctgaggctaagaccacagactgtattcttgaaaagctcttcaagtggttgtggtgaatactaaaatttgagaactatttttctaattaatttagaaattgtatacttcatatgctcttccaattggaccatataattcaagggcaaaatttagtgcttggctttttgcccagatgccttggagaatgtccagctttatggaattttcaccaaaagctttgccaaaagagaagcagacctgtccaacctgcagtaaaaggagctgaagaccaatgatgacaatcagcattctgtgatttgtcagtttgccctatagagaacaaagagcactttgatttaatggtcatgtctatagatattttatcattaaatatgaaaaacaagaagacaaagcagaaaaaaatagatcaaatcttagtgagtggggagtagctgcagcaggaggcagtggaggtggtaagcagcagactaccacccagaaaagagaatcagcggtagaggaaagactaaaatccaaacagtatatagaattgtgttgtgctgcccgtggtaaaggactatgtctgcatacatataaatctggatgtctagaccatgttctctctcagttattgtagctgaatagaaagtaagtgtctgtatgttctggtcaagttaaaagtctaaacacttttaaatgacaattgactgagcgatatgtattttaagaaagcttcacttcaagagagacagcacaaatgctagggccatgttgcttttgttgaaaccctgattccaacatcctcctcaagttttatgatttctcagttttctcttctttaatctggataatcatagtacttatatcagattctttatgaggtttaaattagtgcatgtacctacttagaataatgcctagtacataatagatggttattgtcatcattgttactattcaaactaagagacaaaattaaagagcttgagtaaagtgttagtaaatcataaagctttaaaaggatgctgtggcactatgaataacatctctattactacaggagatatcttaaatgatcctagagaataatttttttaaaattgatatgttaatgatgaccaacttataccatgatattgaatcagtaaatcaggtgtctccagtttgaaaacaaataagaattgactacctgttcttaaatgtatggtattcttggtgacaaaaaattataattctaaaacctttcaaaaggtcacacatatttaactactcaaaaactgcaagctaaatctaatttttatatttgcggggaaagttttcaga

SEQ ID NO: 130989 - DNA, 1006 bp, Homo sapiens
tctttgctatttattatctttaagccaaaccacttacctctattcattcaaacctataaatgaaaactttggccctatagcatataaacttcatttgatttaatcacatcttccaataatccctatatgctatttatgtatttggggaatacttgtgtttcacttgctttgtagttacttgtttttctcctaatgattgacaatactagatttgcctttttctttaaccattcaggatacaacttttcaacaactataattttgccataaatcaatctctgtattggcagttttatatatttaacttcgataatactaaatatatacagtttttattgtttttctaaagccaaaaattagaaatatgcacaaaacaatatttagaaatgtaaaaacagtgtccttttctagaaccgaacaccctatatcaacactcaatctattgtgtagtaatctgttaggattagctagaaatccatactgtacctttaacccatgacaagaactaatgtgggttgagtaatttgatttacataaaagaagaagcgatgttggaccttgattgctcttttcgtttgtctgttttaattttttttagttaccgacactttttatgtttattctggaaaaaacaaaatagaaaaagataaactttttttaaaacatagctatcaaccagaaaaaattaaaatgacttttagcagactggtcacagtatatcctttcatatttttggctacatacatttatatttttcccctaaaaataaaatttttctgaacacataattttatttttcttcatatctcttcattcttcttttgtgcagatgactggcgcatcatctcatgaatctaggcttctcaaattacttagtttagcacaaaatattgcttcttttttttataaaactatttttggatttctgtgactggaaaaactctgggatttgaatttacctgtgtcccctagtagtagggtaattccatatttgatacatatgtcg

SEQ ID NO: 130990 - DNA, 1084 bp, Homo sapiens
gatttttctttctttcaaaagagtgcaagaagaaaatctttcttttctttatttttgtaatatagatttatatcagtaatgattaagtaaagtgaaataaagttattttttaattcaaagctaatgaaaatagcaagcctttttagaaaatttaaccattattagataaaccttattataagaaaacttacagggccactcttgaaatggatattatattatcagcctttttttttttttttttttggtaaaattttcccacttgtctaattaccttttgaaggcaacagtaaaatagagaagaatgtttttgtaagcttctcccttatgtcgtatggctacctttaggtgctgcaggacagcatagtgtcttaaatgaacccactgatttttcatgaatttttttcctgtgatcatgcaaatttgcaccttgtctttgacagcagaaataaaatcataaatctgattttgcatatttgctctaaggttggcccagagtaacaaagcacaatcaagaccatggtatttgaaattttttaactcctaaaaatatattccatagatgatataatttaattatactccaaatgttttatctaaaatgcattttctgtcttttcctttttactcttgtcctcacttttaatgatccatcggctgacagtgtctttacatccaaaatgcaaagcagacaaatgggcatatcagggaagaacatgacaaaaagcaccagcatcagtggagacatgtgctcactggagaagaatgatggcagccagtctgacactgcagtgggcaccttgggcaccagtggcaaaaagcggcgctctagccttggtgccaaaatggtagctatcgttggtctgtcacggaaaagtcgcagtgcttctcagctcagccaaacgggtaggaatttcaatgttacttttaacttgatatttgagttgtcattacaagatatatttcttttctcttactcattttattgcagtaatgtgtggatgatgacatgttccagagggaaagggcattttaaactagttaacctttctgaaatcaacaatgatgttttttccagtgatca

SEQ ID NO: 130991 - DNA, 1066 bp, Homo sapiens
aacttccttttcagtttgtaagcaacatttaccagtagttatcaattttctcactgcaatttttatttccctgttaaaacttcaaacagcaatattctccagcagcagggatggaggaattttctgctgacagtgaagatattcaaagctttgctactttaaaattcagttgctaaatcacatctgcaaaaataaattatatacaacactcctactcagaaaagccactgttagcaattaagaaatttgtgaatcaaagcaatgtcttttttcaaatgggtgtagataattaaacattaaatccttggtatcttggaaataatagcatatcttctacttgacaaacaaatgcatgtaatatggtgtttcttttatagcaaaataaattataggcagctggattaaatctaatttgtgtttgactactaggactcttgtacatagaagtcagatataaatctacagcacaaaagaatttaaggttacattaattcctggacccggctaatcttgatttttgcaaaccgtacttgtgattctgggaatttagtcttatttaacaatattatattgaaataattatttggtggtattttttatattctggttgtaactaaagatatttaaagtgatttttgtcataggatttttaatttggtgttgtaaaatactattttgcattttaatatataaatagaagtttaatttatggacagtggacatacagatcatattttaatgatttttaaaattgttagtatttatacctaattaactatgttgtgctaatatgatacatgttggccttttgaaattgaggtttttttatacttctctaatagaacttcattgcatgtttttctttaaaacttacaaacatctgtcaatctaaaacttctctaaaaaataaagtctactaattttttttaaattaggaacctaaaatggacgttagtaagactacaagttagaaaatatatgaaactaaataattaattccattcactcagggttcttatttataagtattgaacgcttaccgtgtgccagacacatgaagaaaaaa

SEQ ID NO: 130992 - DNA, 1052 bp, Homo sapiens
tagaacatttaaataaacacttttgaagcttgtgtcagaagcagggacataaatctgagagttacaaagtttaggtaatacttaaactcatgaacgtggctgaaattgcccaagaagaattatacagataaaacagcagtaggccaagacaatgccctgtggaagattaacattttagaattgcgcggaggaagagcccaagaagaagaagaaggaacaatcacaaagaaaagaccaaaattatgagaggatagtatcacagaaattaagagggtagaatattcaaaaacagaagggtcagtatttctcaataatcaatttcatgtctttacatgtttggcacaactgtcccatatatctttctttgattgtatttgtattacaaaattatagctctattgaccatacattgagattctgtaacaacactgattttcatgtatgagtagttataggtttttgtctcaaaaacattgtgatgttggcagatttaagaaatgtagtcttgtttcttgttatatcataaagttccttcctatatattacatagcaaatgataaaatctctttgtcactgtcttcattactattcagtgacattataatgggtacatttttaattgttcttaaaatttgcagttattcatacctactccccttaatagatttgacctgctgacaatagaattcagattatctctcattttaaagcccaagtttaactgtagcatagccaacagagattgttttacaattactggatttcaaacttccaatgggtttctcagttctgtatttgtgtgcatatgtatatgtgttcaaaataaggttttaattatgctttattttcttaagaaaaaaatggaatcataagctccaaaagtatttgaaacaaatcttcaaatttcagtatttgagcatatgatctagtagcttagatattaaattatcaaaagtcattatctacaataatgaactagttttataatgctggatcttataatagcttctttcttcagacataaatatataagatgtattgagtaacttgcc

SEQ ID NO: 130993 - DNA, 1070 bp, Homo sapiens
taggggataaatattttaatgtaccattattgcagaaactttaaatcccacaaactactgttaatattaggaatattttcttctaatccattagcatgtttttatacaacgggttctgtgtatattccaaataatattatgacacaagtatattcttaggttatcacagatattttggctacaaaaataatctgtcacggaaatataatacaatttaattaacattgtacttttaacaatgtactgaatttagaaaaatatcttatttttaacagctttattgagattcatacagcacatatctgcatatttaaaatgtacaatccagtagtttttagtgtactcagagatatgtacaaccatctccacaattttagaacacctttattacctcaaaaagaaaccgcataccctttagctattcctccccctcctcatttcacccattcatccctcctcccctcaccttaatcaactactaatctactttctgtctctatagctttccctattctgggctttcatacaaatggagtcatatagtatgtggtgtctttgactggcttctttcgcttagcataattattgcacatctcagttcacaccagcaacatttcaagtgctcagttgccatgtgtgacttctggttgccatcttggacagtgtaggtttagactctatcggttttataggtgtgcattttcttcagccctggttttctcctctatgaagtgaagataatatccatttcaataggctaagatcaagttatataatttgtgtgaaagtatttgtgcactgtttacaaatattgatgattatttacttttaatataagccatggaacagctgcagctattccagtgatccagctaaaagcacactcttcctttgagatttaggggaaaaaaagaaataaatgagccattgaaaatgaatccataaggatatagaagtgactaaaacttttacccatattaaatgttgcttgcaggtctgtattctgctctgcctgatagagtacaacttaacaaaataaatccaatcacttagcccactagctttctaaa

SEQ ID NO: 130994 - DNA, 1244 bp, Homo sapiens
aagtcttagttgtataaagattatgccatggattctgcttctgaaatggagactctttcacaaaatatagctgttttaaattcccatgtttatgaatcagcatactctacctaataggtatttttgtggtgaaaatcatcttctaattcactagtttcatatatatatgagtgtcagaactctgatttatcagatctgatttagtaaagtgtgacaccaatcatacatgtatagagtgagttctatgcctttccaagaaacaattgagcttaagaccaaaagataaaagaagtttagcaggaagtatattgaaaataaaacatgattagaaagccaaaagaaatatttagaagctttagccgtttcaaggaaattattatctaagtgcaaattagtttgtattaaccagtctttaacccttatgatatttggctctttctaatttgctaataataaacaattaaatagcacaatgaaaatttgttagtgtagagctgatcagcgtagccccagagcaaaattcttttattattattattactatattaatttttaagacggggtctcactatgttggctaggttggttttgaattcctggcctcagccaatcctccctcttcagcctcccaaagtgctaggattacaggcagaagcctccgtgcccagtcacaaaattatatttaagtaaattatcttatgccctggaatagaaattcattttccaagaagagcagttatcctagaaaaatatttgttcccagaagaattaagcctaatgaaaattttcactatactatgtatgagccaaaaaatgtatggttttactataaagagaagctagggtctttatgcaagttaattcattagtaagagttctctcaactgcaggcagtagtgataggcatttataaattccagtaggaaaaacatatgaaatgcaaatatcaacagtatctgcattgaaagaatagggccatttgttcagtataatacagtatttagtgctgagtgatatactttaaaaatgcatgctttgtgaaactgataggtagagtgctagtctgaattattttgtagtaattattataaactctgaaaggaaaactcactgacagcatttgtggctaagaaattccattaaaaaaaagcataacaatcatattttgatgtgaaagttccaattcttatactttaaatttcattttcaaaataatatttcttgttatttgagcagtagtgttt

SEQ ID NO: 130995 - DNA, 1047 bp, Homo sapiens
accctctccctcctcccaccctctcccctcaagtaggccctggtgtctattgttcccatctttgtgtctatgtgtactcaaggctgagacaaagttttaatcctaacataggaagtaatttttaaaacataattagatgtaggtgctttgtcttattctttttgtgggaaatttttaattgctgcatagaattcagggctttccaagctaattttgtaacaacttaaggtttctatattttttcagaaccatcaaaaaattctaaaaagattctcaaaataagttttaagtctcttcaatgaaatatatgtcattaatgatatctaagagaagaatatagtcataaaagctaatgcataatcgaggaatgtaaaaaattcggcatcatagatttaaatgatattggattgagacattttagaaatgtaagattttatgtttctattatatttaattaagtagctagaaaattacacagttaatttttagtgtattctgtcttaaaaaattatccaggcttctagtactgaaccctttaaatgatgaaatgagaaacatgttcacttttgatttgcttcctgataagtggagatataaaaatgggttcggggcatctattttctttggtgatttgaacgagttataattccattttgtagagctttctaaatatcaaaaatagaatttgtaatgatttaggatgctaatgtagaaaaattaatttcaaaagctacaatccacagtaatagtattcagatgactcattcagctctattgtagaagctagtattaacagttttcattttaaaatattttctgtagaagaataatgaaataagagttgaagtatgcctgttggtaataatgtagtttctttattacaatttgtttagataaaatagcgtccttagaagcaaatcagtgagctgatcattgtggtaggccctgggaattagaataacatcattattaaaataaaatttttgcttttaggaaacttgaagtcttacatatgtaaaaatgcaataacaagtgtggtttttaaga

SEQ ID NO: 130996 - DNA, 1001 bp, Homo sapiens
gactttattacaaatcttatgtcttcatacataataaaaaataaagtgtctgcaatttgaaaagtcaactagacagttaagcaaaaaatctatgaaaaatgccaaattttctatttttatgtcagcatatcaagcagtataagcaacttataaccatttatatccactaacatatgacttagttgaacaaagtggtaatcaaaagaagtctttattgccataaatgttgtaatgaatacatgaagcttggctagtaatgaaaaaaaggaacaagtaagaattagactttaattgtggttaaggtacttttttatttttccattcatacctaatattattctagtcacactatggtgtaaggagtaaatgaatagtgaatgaataaataataaataaggaaaagtgtaaatatgcaaactttttacaaatattgcataaagttattgacattggtatctgaaacttaaagtttttagatcttgccatatatttgtgtagaatgtttacactcacaaaatctcaaagtgctgttcatctcataatgatataagaagttgctaggtgatgttcatctggaatttcaaggaaattataataggagacatgtttcttcttttctcaagtgtttgaggatattcttctaacattgccatgaagactttgtatgaatttatcacaaagctggagcattgcttggaacagtggaacagaatgcgtgagcagggaatttcttaaacttggaaaccatccttgccactaccactgccctagggagactgggaaaaatagaagccctcatgagaagcccaaactcttgcccattttcaaagatcaaaaataggcatatatagtagttattatgggcagggtagagaaacttccattttcagttttctttgtccctattttctgcctaccaaacatccttcaaaatgtttggtttatgattgattatatttcatttttggaaatatactttcatgggtggccaaatagcaatg

SEQ ID NO: 130997 - DNA, 1010 bp, Homo sapiens
caccaacctggcttctggcccactggtcccggaaccgctgcggacgctgcgccccagccgccaagacgccgcgtatcttgtaccgcgggaaaagcgggtcctcgtccaagatgggccggcagggcttggggggtgccagcgctgcggggcgctccatgcagcgctcccagagccggagtagcctgtctgcctccttcgaggcactggccggctactttccctgcatgaactccctggaggaggaagaaggaggtgagacaccccttcccccgtagttggtgtctctatctgtttagaaagtcggtggctggagggttggccggggcagagagaactccacgtagcagtgtcccagcccctctgctctccgggactgtgccgggggcgacagccctagagcacgtcagctgagcagagaagttgtttcttggttatttggagagctccacaggcgccgacttgggaaaaggctctcctagtggagttgtattacaagtgcttggaagttgaaagagaatgtaaactggtgggaggcaaggcggcgcctcttcggtgcaccccactctgttttggtttacccttcgcagtccgggtattagcattcggcctggaggacagaaatacttgaaaactggagggaaatgcagcagcaaaactttgaaacaggaatgtcagcctatgaaaacccaagatcggatgaggtgaaggggttacacagtggacagacagttagagggttgctagtaccgaaggtgagtttgtgctcaaggcacaatctctggtgtttcagcaatgccattgtaattaagctaatgaaaaacacgaggaggaggactcgctgttttaaacttttcaccagttgatttggagttcgtaaagttttgaataacataacatgtattttcttcatgaactttcctataagatttaacaactaacactgaaaatacaatttgtcaatcaaaatgataattgactggtaaatagtaagtagtgtcccaacatttgaa

SEQ ID NO: 130998 - DNA, 1062 bp, Homo sapiens
ttgtatatttagtggagacagggtttcaccgtgttagccagggtggtctcaatctcctgacctcgtgatcagcccgcctcgacctcccaaagtgctgagattacaggcatgagccaccgtgcccggcctagcttcactctttaagaggtttattcacccagcaagaagagtataaagagacatatcttattctagtctttgtgtatagtaaataatgtacttaattcttaataatcagtcccatttgattaaaatagtttagaactttgcccttacgccgttgaaataagaaaaattcttcatacatttaaatgtaatcctcttaaagtgcaaacatcatacctagcacagtgatattcagtgtctattaataattaacagtatatagttccaccattcttttcacactgaatatcagtataactgactgccatccatccattatatttatactgtttaaaatgtaacatgtgatagagacttttttaaatgcagtgatcatagtttttacccatcttcatgaagccaaccttggaagcaggacatggatagacagttactatggttctttttataggggatattattttttctagattatgtgtaacaaatcattccataaatgagttcataccttgttcaaaaatagcacaatatttttttatgttagatttacattataacagacaaagtgaagcaaaagattttggaattaagaaaagtaaattgagtaacagttccactcaatgcctatcaaatattacctttttcatataagattcagaatctttcaccaccatgtgtccaaatagtgtctttaatttaaaactttaatagactgagttctacaaaggaaaaaaccctttaatataaaagtaaaattaaacctcaatttgctttcatcctttaacaggttcactaccagtaacaggaattagtttccctgtagaaacatcttatatataatgacttatgaaggaaactcactagaaagttataataacagcatcccatttcttccaaggactgtgttttaatgtaaatgttctctgctattattaa

SEQ ID NO: 130999 - DNA, 2291 bp, Homo sapiens
aattgtgtgaaggcctggttcttttactatgattaaaagaaagggaaaaatatggtaagcagaaattaatctggcatttaaatattacaatgaaaacaaaagataggcataaattaacctgcatttaagtattacaatgaaaataaggcttattttttttccttaggttgaatctttttgtttcttatattaacaatttgcacactgttttaaatggaaataaaacaatggtgttttgtgcttctacagattttttagaaaatcttcatcccactcaacatgacattgtttaaaattgttttaaataccttttctttctgcctccttaacaagagcactttttatttacacagttctttgcatctgatgatctcagagccttcgctgatatttcttaccacatagtgattacaaagctgttacactttttgtttctatctctgcagaagcaggaggtaaaaaactaaggagcactgtccaaagaagtacagaaacaggcctggccgtggaaatgaggaactggatgactcgacaggcaagccgagagtctacagatggtagcatgaacagctacagctcagaaggaaagtgagtgaggctgcatgtgatgtgtgtctcctccgtgcctcacctatctcactctatgtgctttcacagagattttccaactctcatgctcttcagaaccactttaattttcactggctgatttcctgtgaagagaactttgctcacctgccactgaacaatgtgacatatctggctttttatatcaagtgaaataggtttggggataaagtgttttgccttaatggcaagttgctaaagtgtgactcttacaatgcaatgcaaataaaatattttgccctagcttgaaataatatataaaagcccaaaaataataagcatgcatgccacaccatgtgaacaatgctagttttaagaatcgccatcctgagaattattgctaaaaaatatggaatgctggcgtatacttagttccatgttgcaacaaacaactataattatttaattatattaaatataacagccaaaaagaaatgccaccaaaaaacttggggagccttttacatagttatgaagtagctttcctttgaatcaactgtctcagatatttttaaagcatttttagcttgtgtagttctgtcaccaacaaattaatagtacttagcaactaaagatctggaagtggggctgtaaaggacattaacaaaggaaaatggggtttactggcctcactgtcatcactgtgtaagtattagatgtttagataacctatgtgtggccagtttacagatgtgaggccgtaggagctgttggcacaacatgaatggtatgtctcaggataatttgtctagcacaacaacataaatacaagagatataactggtttctctacatttgtaagtaggcttatttgggatacttatagaaacaaactaaaacatttgtattaactaaatatttgagagttgaggtcggggggagaaatagattcactattcattaaggaagtctaaaaagagagggaaaatcaactgaaaagtgaatgtgcactgagcactaatcattgcaaagaactatattagatactgttagggatataaaaatgtttacactatagcccctgctccagatgtttatagtcttattggaaaaagaggatgaatacccataaattcattcaacaaatattaccataccttccagtgggccagtcactgtgctgtacgttggggatgtaagtcataggagggagggagtaaatctccatggctaagattatgggctttgcagtcatataggtctggttctctcatctgggtcttttcttttctttctttcctttttattttttttgtttgttttcttttcttttgtttcctttcctttcctttacttctatagaacatacaatatttcaggcatggttctagatgctagagatacagcagtgaacaaagcagaccccatctccccaaaaataaaatactctcatcacatttacactctcatagagaagacaaacaataagaaaaattgttaaaatgtatataaaagaaaaactagtaaaatttatagtagattagatagcacacatgctaaggagaaaaatacagcaaggaagagagatgatcaagacggtggaggtaagatttgccacaggatagacggggaaaggaaatattcgagtgaagatctgaaggaatttagtgagcagagggatatctgaaggaagaacattctagaatgaagattgcttcagaggc

SEQ ID NO: 131000 - DNA, 1054 bp, Homo sapiens
tcagcatctctactgattgacttgtaactttcactctgaacttttctatccttgcagaaatttttaattataatatataatctgttgtataacctggcactggtgattaagacagttgtgtttatatatgtcttagagctagtcaactcactctgctataaaaaaatcatgatttgtacatgcatgaaaatggtttttatgaagtgtctgttggataaattttaagccatagattgtctaattagttgcctcttagctaatttgatcaatatcacatgaaattccactactgttatacccacaccaccaccagtaagtaagtacttttgagtgataatcactatttgtggggatgagtgaatgaaacaatatagcttcaagcatgttaaatagatttaagtattgataaattaaagactgagcaggacatctctcaggactggaagcatttccctttatttaatgcagtgtgtaaacctatataaccagttgatgaaaaaaatgataataaactcagaggttatgtcagcatcccctaaaactccctgaaagacacagttatccactgtttatctaatgattttgacagaatgcagctaggccagtggcatgattgctagctctttcagccaaagattactaaactggtaaatgtcaccgtgcgtcggccatttcatgtccatagtttattgctcattctcctctgtgttttctttcccaagcaccgtatgtaaaagtgtatctattagataacggagtctgcatagccaaaaagaaaacaaaagtggcaagaaaaacgctggaacccctttaccagcagctattatctttcgaagagagtccacaaggaaaagttttacaggtatctacttaattgtttatcccttacctaagaaagtatttttcatggggtcagacattataccccaaatcttttctgttgtattcttttatgttcctcacaaaggaaattctttggaaacttttcaaagcagtggcccgtgctataaagcaatatacgttgtcattttctttaaagtgatttacagacatg

SEQ ID NO: 131001 - DNA, 1050 bp, Homo sapiens
gaataaatacgtgctcctttaaaatactcagtggttatttgtacagcagcgatagcagggaaatgcagctggacttaacacagcaggagcagggttccgtgagagcacgtggagcgagtcccaggcccaggattgtcactgtcatttctgccgcattcgattgggcaaagaagtcacaaggccaggtcagatgcaaaggatggaggaatagacctcaactcttggtggtggaaggtcaaagaagctgtaaagtcatatttcaagggagaggacacaggaagagtaaagaattatggccacgttttttgtagtcagtctaccaccatggcctttacgaaggtcagaggacattcaaaagtaatttctgaccttggtttctttttcattttcaggacgcagggagcatgggtatctggacctcaggcactgatatcttcctaagtctttgggagatttacgtgtctccaagaagccccggatggatggactttatccagcatttgggagtttgctgtttggttgctcttatttcagtgggcctcctgtctgtggccgcctgctggtttctgccatcaatcatagcggccgctgcctcctggattatcacgtgtgttctgctgtgttgctccaagcatgcacgatgttttattcttcttgtctttctctcttgtggcctgcgtgaaggcaggaatgctttgattgcagctggcacagggatcgtcatcttgggacacgtagaaaatatttttcacaactttaaaggtctcctagatggtatgacttgcaacctaagggcaaagagcttttccatacattttccacttttgaaaaaatatattgaggcaattcagtggatttatggccttgccactccactaagtgtatttgatgaccttgtttcttggaaccagaccctggcagtctctcttttcagtcccagccatgtcctggaggcacagctaaatgacagcaaaggggaagtcctgagcgtcttgtaccagatggcaacaaccacagaggtgttgtcctccctgggtcagaagctacttg

SEQ ID NO: 131002 - DNA, 1045 bp, Homo sapiens
ccagttgagcaagataggtaaacttcctgagcctcagtttctctattgaaaaagtaggagtaattaatcatacctctctttcacgggatggttgaaaggacacattgggatggcacatgcaaagccccagctctccctcagtggtagacagattcaaccttgtctctttctcttgccccatcacgactgccactcttttcgttcccatctatccaatacagagccccctgaagggaaatatttaattaggttaatttttgacaaatgaactttctccctttacttcgttttggagaatatctgtgcacgagttaaaatttaaaaaaaaaagaaacacagagcgtccatcatttattaaacaccgactgtttataaaacacagaagcaaaccccttagtttggctgccactgctcctcaaatgccttgcacagggagtggcacaaagaagtgctcagtaaatccttgatgagggaatgaattaaccttgggaacagaagatgacagaggaggaggagaggaataattcatgaataaaaagtaacactatgacaaatcattatttgtgtccagggctcaggactccatttgtcttaagagccatcctagtgtgaatggtgattgtaaaaatataaatggcactggggagtggccttctgagactctgtgggcttaggtgagcttgcataaccagctgcagtagtgagaaagcattcagggctttttcaagcagtggttctttttttgttgttgttgtttttgccttataataggatgcagtcttcacaagaacataggaccttggctttttctttaacaaaacctataaatgtgctcaatagagtcttaatgaaaatatttattaggcccttattaggtgcccagacttgtgctaaggtctgtatagatgccatcatttaattgtctctgcagccctatgagggcaatattattttattatatattattttattaatattattaataaattattatttattattttactactattattaacaaattatttttattattttatattat

SEQ ID NO: 131003 - DNA, 1024 bp, Homo sapiens
aaaatctaataaaagcaacaaagggatttccacattcatttcaaatgtctttattgatgcagaatcctatagctattttattctcccgaacagatctatcaaatagataatgacctgtgctctccatttaaagcagccttacatgaaaatgttctacaaagtttgtccctattttgttgagagttctcactaactttatgaatttgagaactgaacaggaactccttcacttcctcccttatctgaatattaataaatatccattgaatacccatcaattgcatggtactctgctagatgctggtgaaataatagtgaaccagacaggccctgtcctgaagaagctttcagtttcctagaggagacagacaagtagaacagctattataaggcaacgagataaggcacggtgatgggtgtatgctgggcctcctacggaggagcatgtcagatctgggtaaggctcttagtggggtgctattacagctaaataccaaaggatgagtgggaattgacttctgggtaagaaagcaatttaaatatttctttcgacaggattcagtagtcttattgtagactttccattgtcaaccaaagcagagaagagaaataaatattttgaagtatctcttaacctgagaaaaaagagctgtagtttgattgaaccagaaggattttcttcagatgcagctcaccgtcctttctctttgtgctcaaaacaaatcacaattgggtaaactgaatttctactaccctttgttaaatgtgcaaatatactcctaagtgagtatgctgggggcagatgcacctgcaaggagagcataatcgccccaattttattccatcttttaaaaatccctcttgacctagttacctaggagaagaaatctaagcttagtttctctgcacacacagaaggatcataccatagactaggaagtgtgggggaaggaaggtattaaggcagcctctttcagccatgctgattccatttaattccctcaaatctcgaattcatcattgt

SEQ ID NO: 131004 - DNA, 1020 bp, Homo sapiens
tctctggtactgatgtgttgagctgatatttttctcttccaaaacttagttatccttcactatgtttatatctttgtcttaccaaaatgcaacctctctgatgacaggtattacaccttatatttatgtctccctcagtactcagtaatttctcacacatttcttacacacaatgaacatgcaatcaatatatgttttcagataactgattaacattgtcctcatccccctcgcctccaccatgtgaggaattcagcaatccttctacacagataaaggctccatttgtttttcttgtgggtaaattgccttctcattattctgcctccagaaacttagctctcttaaataaatgcctggtaggaggacagaactgagagcaaagtaagaacatttcccttctctggtgagaagaaaagggcacaatcatagcacaggatgatagtggagggctcacgggaagaaaatataacaaaaacgtgaagaaaccacctttaagaaattttggagagggaaagagcattgcaaatatacaaaatgatagagaaaacatagggagaaaaggacttcacaggaaaggaaaaaataaaacaaagctatttattagaagacagccagagaaatgagctgagagcccagcacaaatgctcagcaatacccctcatgggaggggcagcccctgttaccccttccaggaggtgcctcctccacgcagacagctggcctcaagagcacatctggggaggcccttccttgcccagacagcacgcggccccatttactggactaaaggcaggcatagtgaaccaatggaaaattttcttcaggcaacataacctcagcataaaaaaaaatatcaatctatttgcctcccagccaaagagaaatcaagttagacaaaggaaattaggcaataagtttaatgtgactgcagctgcagttgtgaaataaacctaatgtactctgactctccttcccatgtgctctctgggttgcacaggccactttttggggagggca

SEQ ID NO: 131005 - DNA, 1055 bp, Homo sapiens
gggagattgtatacaagttggagcaatatccatttattattttgtaactttacagttaaactagttttagtttaaaaagaaaaaatgcagggtgatttcttattattatatgttagcctgcatggttaaattcgacaacttgtaactctatgaacttagagtttactattttagcagctaaaaatgcatcacatattcatattgttcaataatgtcctttcatttgtttctgattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatatactagatgttaaggttgttaatgtacaaaaaaaaaacccttatactcacctgcgttttcatttgtttgacatttgtctattattggatttcattatcatatgaacttgtcagtgggaaacaaactgtctaaaaatttttctcttacgtttaacatacaatcatgtgaaatttaggcagagttcgataaattactggcaaaaacaaaactcttttataaagattttctaatgttgactttaatactctaacatggtacaaaccaaatggtaaaatcccaagtcatttcttttttcatctctatttagcaacagaattaagtggatgaagatattctactatgcattaaatcttgaactttataaaacatgtacaaaaattgtacaagataagttccacctggtaatgtctttccctaatacagggttgcgcttgcattggaccctagggatttgcactaaaattatatcaaggtctcagatgagcttagtgcacaagcactatcactttaaatactattatttgctaccacagcaactatatatttccatagcttttggctgggggcgggggacatttttattacaacttgaaattgctttgctggtttcatatttatttgttgtatttaaaaaatacattgttgtaagagtgatttt

SEQ ID NO: 131006 - DNA, 2109 bp, Homo sapiens
gcagccataaaaaggagcgagatcatgtcctttgctggaagctggatggatggatgaagctggaagccattatcctcagcaaaataacacaggaacagaaaaccaaacactgcatgttctcacttataagtgggacctgaacaatgagaacacatggacacaggccccagatttattgtggcctttctagggagggtggggtgggagggagagcattagggaaaagacctaatgcatactggacttaatacctaggtgatggattgatgggtgcagcaaaccaccatggcacatgtttactcatgtaacaaacctgcacatcctgcacatgtaccctggaacttaaaattaaaatattaaaaaaccaacctgttttttaaaacttctagcacttgggctttatgaacatttattataaaaatatcacttgctgttttatgtcttttaaagattataatttttctccttctctttccatctatttctactcacatcttcacagggaaatctgaggaaccaaattgtgcttgtgatcagtttcgttgtggtaatggaaagtgtataccagaagcctggaaatgtaataacatggatgaatgtggagatagttccgatgaagagatctgtgccaaagaagcaaatcctccaactgctgctgcttttcaaccctgtgcttacaaccagttccagtgtttatcccgttttaccaaagtttacacttgcctccccgaatctttaaaatgtgatgggaacattgactgccttgacctaggagatgagatagactgtgatgtgccaacatgtgggcaatggctaaaatatttttatggtacttttaattctcccaattatccagacttttatcctcctggaagcaattgcacctggttaatagacactggtgatcaccgtaaagtcattttacgcttcactgactttaaacttgatggtactggttatggtgattatgtcaaaatatatgatggattagaggagaatccacacaagcttttgcgtgtgttgacagcttttgattctcatgcacctcttacagttgtttcttcttctggacagataagggtacatttttgtgctgataaagtgaatgctgcaaggggatttaatgctacttaccaagtagatgggttctgtttgccatgggaaataccctgtggaggtaactgggggtgttatactgagcagcagcgttgtgatgggtattggcattgcccaaatggaagggatgaaaccaattgtaccatgtgccagaaggaagaatttccatgttcccgaaatggtgtctgttatcctcgttctgatcgctgcaactaccagaatcattgcccaaatggctcagatgaaaaaaactgctttttttgccaaccaggaaatttccattgtaaaaacaatcgttgtgtgtttgaaagttgggtgtgtgattctcaagatgactgtggtgatggcagcgatgaagaaaattgcccagtaatcgtgcctacaagagtcatcactgctgccgtcatagggagcctcatctgtggcctgttactcgtcatagcattgggatgtacttgtaagctttattctctgagaatgtttgaaagaaggtcagtatcaagacagaactattgggcctcaataaaagcaggcccaagtgtttgaaacaagttctttgatgattagcaatgtatttttgttttatattagtttagaaaatggataaagattgttgatgatgtataaaattagcgtgaaaaacccgagactcagaaggccagacacattacaaactaaatatttagagttatgagaaaaagcccatctatttaccagctcctgttttcagattaatctgttttataggaatattgtaagctgcagctctcagttttagtgttttaacctgtatttttctaaatacaaattcaaaaattccagttattctatatgctatgttcaaagcatacaggtaaatagaaaaatgaataaggcataatatcacaagcagtttacagttaggaggaaggaattggggcatggaataagatgacaaaagtataatactataaagagctatgaaacaaaatggtataaagtcaaaaatacgta

SEQ ID NO: 131007 - DNA, 1093 bp, Homo sapiens
tcattatccacccgcctcggcctcccaaagtgctgggattacatgcgtgagtcaccacacttggccggagacttaagttttatctgttttatcaatattataataataagccacctcaaatctataatgtaaaatgagtaacagtaatataaatatgataaactaggaaaaatgaaattacaggttatagtaggtactggagctgaagtattaatgataagttgggactgggaagccatttataaagcactgaaataatgaaaaaatggaagacccagaggatttcctttggaaggttggggcagatgtgtaagagataaaacaggccttggttccctaagaagtggtgaaggcaggctcaatttctgactgaaatttccggttttaatctctgtgaggcctaacttatttcctgtccttgaaaattcttgaaaacgcctgtagtattcttcaatttctttttacttcagtacctattccatcaaacaaatgctgcctgagatgatgtagattcagaatataggatattctgaagacggatttgggaaacacacaggtctgatcatgttgaatttgaggttagaatgtccagtgggcatttgactatgcaaagcctctgggttaaaaattttaaactcatgaccatagttgaaattgtaaaagtggatgaaatcttccattgagagtgagaagagcagagggctttggaattaaccatgaaaccagtatcaaggactggctggctggctggccaaggacagaggatctagtgctagaaaattaacacagaatagagttagaaggagaattagaggaggtgatgtccacaaagtctgggtagtacagttccaagtctgggtagtcagtgtcaggtgctccagaaagatcaagtaccttgggaatgagtgtccattggatttagcggtgaggtcactgatggccttttcctgctagcatggtttctgtggagataaggtcagaattgaaagtctatttcagtgggtcagagaaaaaatgcaaaggaagaaaatgaaaaatttatcaatgtatcccattgagctatcagaaatatagtgggaagaggtgcatgatt

SEQ ID NO: 131008 - DNA, 1037 bp, Homo sapiens
gtgcttcttaaactttaatgtgcatatagatcactaagtgtgcatataaattcagattccataatctggaatgagcctgagtctctgcatttctagcacactcccaaggtggccagtactgctagtctactcgtgagtagcaaggatttaggcagtttatactgacctttggcaaaccttcttaggtgttttattgaatcagtttcatgttttgtttctgctgcctgtttttataatttttgtgtggtaaagaaatgggtacagtctttctggtcatttcaattctgtatgtgtgacatttaacaataaatgagaaaaagaaattgtgccttttttggcatcagtgcagagtacttaaaatgaatataatcatttatttgtatacttaatatggccttcccacctatctcatcatttccactgtttcattcttaattgagggaaatataatgtatgttttcattttgaagggtataactgtagttgaaccaaaaatattgttttatcactgttattttttctttagtaacaataatatactttacacagttacaaaaatcaacacctgttcaatgctatgtgccaggcactatatcaagtgcttaatgggcatgatttcattttaatcatcaggacatccctcattcatctttcagctatttgtgcgcctcctctgtatcaggaactgtgcctacagtggggagccaaataaacacaaattctgttctcctacagcttagtgcattggggtggggggtgcaatacaatattcaagcaattatagaagtgtgatacttgtaaacaaaaagttgttaattacaatatttgctattttctccactctcaaccatgaaagaaaattctgcttttgccttctaagctttttctgactagcttccttccccacctgactccgaggagaattctttgtctgttcggtttctgagctgttgtgatgccagatccaactaatgggtaaagagagaaacctttagaactaatgatgtataaaatacaaaattttaagacaaatatct

SEQ ID NO: 131009 - DNA, 1746 bp, Homo sapiens
tgtctattaaagctgtatgtaaacatgtcctgtggcccaggaattctgcctctagatatgaactcaacaggtatataatgtgtgacaaaagacatgtacaagaatattcatagcatccttattggttataatcccagactagaaacaaccctatggccatcagcaatagaatagatgaataaattatggtatattagcataagataattctgtttagcagcagtttccaaactttcgggtcgcaggactccacagttattgaggaatccaaagaatggtttttgtataggagctatatatgtttttaagaatattaggaattaaaattgagtaattattaaaacattaattcgtttaaaatgacaataagaaacctattacatattaccgtaaataacatgttaaataaaaatatgtaagatgacaactatattttccaacagaaacaaaaattttttgagaatagtggcattgtcttagtttttgcaattaccatagggtcagatttatatgtaaaacatatttagtataatgccagacaatacttgttgaataaatgaattcatctatctataaatggagtaaattacatttatgtgattcctaatgttgaatcatttttgcattcattcatagggcataccaccttgctaatgatatattttaatctgctagaatacatttactgataatttttatactttgcatttatatttatgacatcagtccatagtcagtcttagctttcttctgccctctacctctttttttccttcctgtaacctaacctccctcttcttctgcttgattttcatatctgttaatccattcttttagatgcacttacgatcttttttttgttgagttcagtgtttagaagtagtataaaagattctagtgttccagttattattattttgccttttaagattagaaaaagagaagtaagtgattgtttatgaactatataggtactgtaacaggaaagcaaaaattaaaaattttgtactaataaatgccgaggggagaaatgttttcattcctagtatgtttagactttatttcactaaccaagataatacagatgagcctgtaagaagtagatcccttcttacgcatcagctataggattaagtaagccagtaagagacctcagtggagatagatcagttccattagaagtggaactcacatctgaaggcaggagctgtgtgggaggtaaaatggagatgctaaatgaggactgagctcaagtcagggggtaggactcctgtattctgtcagtagggtacatccggtttgtgtggatgacactttaagaccaaactaatttgctcaaaaagtagcagacataaagttaaccaaaatatggctccagtgctatctaaactatgacctagtagtgtactaacatgattacttgtatgtaaaagtatttgcccaggtacaaaggatgggagattaaggagaacctactactatcggtgctgctggagtggatcactgcacaggggctaggagccatatgaaaaatacaatcgagtattaagaaattgcataaattacatttgtatacgattcaacttaacattattttttctactacgtaagaataagaatctgagtgtttgatttgattgctttgtgtgggtgggttagagagaattagaatacatgatttatctctggtctttattttattaattcttttattccctgatctaagtagggggctagctacgataa

SEQ ID NO: 131010 - DNA, 1097 bp, Homo sapiens
aattcatttttaaactggttttcagcttattacagtcaagagtctttactgttcacagtagtattctagatgttgtggtagcctaaaataatctttttactttgcatatatgtaatggatgaatcttttcccatgaattttatggaatgttcagtagcacttaataactggtttaagggtagacaagaaattccaattttagaaaggttgtagaagtaactggaacatgagggaaaaatctaaaccagataccaattacttcttacaaagtcaagtttgattacataaaatgtgttgaataaaattgaattaattgcttaacataaacccttccttgagttcagaatctaaattatatccatatccttgggagaatatgaaggtgggcagcacattccacaaaattctaggtggttatcagggcagaaagtattaaacaagcactgttaactgtattctagatagagtatggaggagatttgaatgatgtatggtaaatgatttataaggttcctagaaagtaaaatttcttttgaagaacataaaagggattttagcctgaaaagtgagcagcagttaaagaaaatgttgagatttacttttgtaattagaaaatttaaagcttattaaaatattaagggaacaagagggcctttttgtgtttctgatatgagatgttgttccttttttttttccccactttaccagtgataccacaatttaaggggtgaaagttcagtaaaaatatatatgaaatataagtgagaattatatagatttaagtaaacatagaatatttttattttagatattaatcctgttcttactgcaagtctttataagaagaggaaggttgttctaaatttaggaattggaagttgatgatctctaatttctaaggttacctttcttttctgtttttcttcttttctccttatcactccctgctttttgagagagttaagtaatagatgtacattatttattcccattttctaaaatttaggattagatcctgcaaatacaaattaccaatgtatctattcaaatacatgttatcagagtctcttctttttaagtatatataaatatattat

SEQ ID NO: 131011 - DNA, 1048 bp, Homo sapiens
gaacagatactagctgtaatttatgaaactgtcctctatacagtaaaaagtgtgtgtgtgttttaaaaggcttcaaaaataattagctctgttaatgaaactgaatattcacaatcactgttaacaaagaaaagcaggttgattggccaatatttagggaactccaatattaattcttcacagagtgactcttaaatgaaatgactctaaggtgtgcttcagatttttgaaacatttcacatacataaaaaaattttttgttgtttattttggtgctactttccagatgacgattttatgggctctgatatgtgactgttgtacttccaaattaacttttctgaatgccagagtcttacctgaaactctaaattgtaatctagaatataatgttttctagaagtagttgttcaaggacctgtaattatctttcaggggctactgtatcttaaccgcattcaatgtgcctaagagttaggagagagtaaaggttgacctctgccacctttgaaagtttgaagggataaaaatatcagtggtgacaaccacaagctttgctacgcattgtcctaggcttactgtaagaggaaaaagtgctttgtcatttttcacatagggatgtctcgcttttacaaatctatgggagtttccaaaacctctgtctcctagtcaatagaagctgttagtcttgctcacctcctaaaccacaatttggtaattctgacagttccgttgctttatcctttccacttctgtttgtctcccagattagtgtttcctaacttttactcaaacccacccttaaaatacacattgcttcgggtactatgtacatagagaaaaaagttaatgaaatcgtactcttaactacctgtgcactcagatgttttctatttattcctcctctttctcacccttcccttcttcatttgctggtctggactcattaaataaattttggatccactaataaattgcagtccttagcttgaaaaacactacccaagatgaagccttaaaatatagtttagaggccaggcgtggtgac

SEQ ID NO: 131012 - DNA, 1038 bp, Homo sapiens
aataatctctaaaattcttttatttttcacaaaatttgcaaaattttaaaaatatgaatagagtgaagaattaattacaaaatttagagttagaagcaaacattttttctttattttctgttaatatggaactttaaacttttaatttctgtattaattactcccttggaatattgaacaatggtatactcttgaagaaaaactatttgcttcactgtggtatgtcctgaaattattgggagcctgcagtaaattgaggaatagaagattaaaaatagtgaattgacgagtcttcaagttcagttgagggccacatttctcttattctatacagaaaaaatagctaaaaatcatgtatttcaaagtactttaaaataatgatgaaataaaaattgtaaataaaaaatacactcaattttgtccattttccctttgcatgctacattaagattacctagtttggaagagtggctttaaagcttaacacacaattcgattaaaagatctgattatttataattcactgacaaaatctgtcatagattaattgtagcatatttggtattcaagaaaagttttaaatttattttttattacttacaatagcataaaaggcctttttttcattttctagtagaagcttgtttaatttcccatagctaatgtctcctaacagtaaatgccatggactggtaagccttcatgctccttgtgtgtgctgagaagttcaaaggcatttgtgtgtgtgtgttttttctttttaataaaaccctgtgaattcagtgcgaatcatttggaatgatgtgtttctcactgtatacaaattattttcatggtgtgcattttcatccatgtccaatatgtcagtgtaatactttgtgatgttatatagcccatacttacatgattaaagtatgcatttatttggataaattctgtgaagaaattttatgctgtttttaaatgcttttcaaaatatagctcagtgaatgtattattgggggatggatgtatattgacaacattacctattaatgg

SEQ ID NO: 131013 - DNA, 1064 bp, Homo sapiens
tgcccgaaagagttcatctctcacccctatcaaatgttttgccttctgagtgattttaagatgcttatttttatacatattattatatgcagacatagttttaaattggccctgggcccaatgtgttgctctttttcgtaccttattaaggatttttttatccttgaaagtcttccaagctatctcaagtgttctcgtgggcagtagcagcagcagcagcaacagcagcagaaggaaatgaaggagtacatggagagaccaaagcttagagtgtcagtggggtttgaaaggatgcccctgaataaaatagaaaggttttaattcataaatgccagcataaataccccctgataattatgacagagtggaaagaaaattaaatatgttgaatttttgtcagataattttgaaagtggacataaggttaggaaacaaataacacacggagttgagggaaattataatccgaaaacaaatgaaatatttgtttctctcatttgaaggaacctagagcctaggaacattaatgcaacttgagaaaggttgtttttaaccgtggagtctcttagcattttcagcctcagtggaatattataggaccataaggtcagttttatttaattcattctcatagattctgaacaacctaggtagtgctgaagattttattgtattttgtaatttacattctgagtttggacagaggtgctacaaggtgtatgctactgtaagtaaattcatctgatcagtggcattatacaatgactttatgcaaatggagaactaattttttgggaaaaaagttaatctcttgtggtatgtcttgccatcaagaattctattcctaaagacccaaagaagtaaaggaaagaatcagaggaaaatgaacccaaagtgcatccagtccctggctcccatgtggccagctgatgttccagccatcaactgttgaaaagctacaagtggttttcatgatgataaagttagtggtcagcaccaaaaatagatccagagcaaggcctagtagaataaattactgaagatgatcaagttagaactacctc

SEQ ID NO: 131014 - DNA, 1175 bp, Homo sapiens
tgtgcaatacatattacttctggaaaaggaaggaaaactttcattgagagccttcctatgtgctaaggactctgttaggcactttataagcatttaacttaattttcttacattatttacctgcattatccttttatgtaggacagggataattagttccattttggagacattgttttgggccacactgcaattgacagccaatatttggaatgggttaaggggttttttttcatagctccattttgtcagtgaaagggcttctgctgcaaaatgacaggatccaacgatgaataagatgagatcacgtaggtggagatggctacaaatagctctggcacattagcactcagtaaatgctagtcagttttgaatcatgggtccaattctcacatggctgtcttacagtctaaggaaaccagatgtagccataggtacaatgcagaatgaagtgtcaggagaacagcacagatagatttaaagaaggatccatgcagattaaagtttggcctttagttctcttatttgagaaagtatattattggaactttaaacaattttgaatgatgtaacaccccccaccccgccccccaaaacccttaggtgtcagatagaaaaacgtattgaaggcactttttatatacttttcagaaagtattcaatctaagcgtgattattcttttaacattaaaaattcaatttactgattgcaaattaaaagcctatatgaaacataaaacttccagtcattgatgtcaataaaaaccttatttttttcatagcttgtgagatttagcttagggttggtatagtcttacaaagttgctttacttttactctatggagttaataagatatatccataaaccttaatgtgaaaaataaatgcatattcagtatgaaatgtgtgaaaactcagacaaagccccagttcagtgtactctgttcctcctgacaccaagaggttatgtttcaaataggactactaaaggttttaacatctagtagtatgaagcaggtacagaaaagagtgaatgacatgccaagccagcagtgacacacacaaccccaaggtggcatgtgacatacctttacttcatttacagacatggcatatgtcagagtgcttggccctaccgcacagttggtttgagcaatttccattccattatgtt

SEQ ID NO: 131015 - DNA, 1021 bp, Homo sapiens
cccaaaatgctgggattacaggcatgagccaccgtgcccagcctaaagttgttctttattattcattgactcttacttcaattttctcataaaaccccttgtcccagcttgacaaaactgtggcttcttgattctaataatttcagcgtcttctgtgccattttgtatcactttctattttttaatggcaggaaaccagactaaagcatagagttatgtaggttggtctgtggttttcttctcatacactttagttccttttctgatggttaaaaataatgagcacaacttgtcgcaggcataatgtctcccacaaggcttcaatcaaggggacagacaggtcttggtgtcatctgaaggctcagctagtggaggatctgcttacatgctcactcaaatgactcttgattcagtgcttggcctagtgggcctctacttaaggccactcacaatatggcagctggcatccctctgagcaagcagatgagagcataggacagggagcccaagacaaaagccacagtgctttggtaacttaatcatgggagtggcatcctatcacttttgctgaattctagggaagggaattgtgcagagcttgaaaccagaaggctgggatgactgggggccaactcagaggctgtctgccacagaaggtaatttgcataagtagttaacctgacctgtggatagggaaggactttcaaataccaagagccatgggagcaatcacaaaagaaaattcagtgaacttgaatacagacaacaaaactgtatgctatacagcatcataaccaaaatcaaagattaataagtaaaagacatttgtgaaaatgaggtatattttattattattcattaaaatatttatggtttctcacatctgtgatcagtggcttcctgattaatttatttagatattaattttgcaataaagacaaattaaaatatacaaaacgtgatttgtacaaaaatttggtgggaattggggatcaaaagtagtttgctgagtgtttcttct

SEQ ID NO: 131016 - DNA, 1070 bp, Homo sapiens
attgtcattaaagaaacaattttttctttagtattccacgtgtcattatatgccacagagtgtatggttaatagaaatattcaacagaaggtttacttatgatttaataaataagaacgcacagaataataacaaacttcatcctgatttaggatcagattgttaatgccataatgagcattgtaaatatcaatggaaactataaaaatgtaattatgcctgtggagttatgaaggtacctctcttttatcagtttgctagtatattcaattgcattcaatatacagcattattctaaaagcattataaagaaacttgagctccaacttaagccactctagtgaaaagtcacttcatagtggaatctgctttattcccacatattccagtgatcaaagcactgctcttaccaagatagtattaatattaatatccaggtgaagtggccatggaatctaacactttcacaatgttaggttcactaggtaaattattttaaaaattctatcattttacaattggtcaacatgaattatgtagattttcagatgaatcacatctgcagaatggaagcaaattactgagaaacttttaaatgctgtatatattaagaatactctgaattgtttgatgataaaagatattcagttcactggagtaactggagtaaaactggagaaactggagtaaaacaatataaaataaggtaagagaatatcagattgtagtaactgattagctaaaatagtctgtacttttgcttgtttctactgatttccttcctttcaactttaagataactgtgtgtgcactagcaaaagatacttggagaactatcaagaagatgcaaaatgaaaatggtaggctgcccattcctttagatgctgtcaaagcaactgaaagaagatgtcatgcttctcctttcaaagctctcagtagctaaggagaaacaaaaataacaatcaaaagattgagtatacttttatcctctatcacttgagtggtatgtaggatttgtgacaaatagtagcaatacttcgtaatgataacattattaccaaagaactcta

SEQ ID NO: 131017 - DNA, 1067 bp, Homo sapiens
tctcttatcatatttgagatcccacataccacattctactcgaagacatttgttagcagaagttctctggaatttcactctcatgctgttcttacaggatattttgtagaactgtgctccaagaaaactctaatttaatgaaatcttcctggaatctccattcataaatctattctgtgcctaattatatagtgtagtggttctcgttataggatgttgctaatgtctttcccacttgtccttttcacatattttctaatttaggagtattcttaatatcattgagcttcagtttcaaaagtaggtatagcatataatttttttcaagcaatgcaactttgataatgttttaagaagttgagttttgttatttcccaaacaataaacacaaataagataggttcttttaataggagtttggaagttttctaagttacttgctgaaatctccttatatatagaatcacatatacacacatgcacactttgcaactctcacttaaaggacatcccaatttaattcagtggccattttactccatttttcaatagaatcacaagattttaattgaagcaagtgacatggctcgctgtgtttggtacttaacattaactggtcatggggaatattcaggtgttatctgtgaaaacctatttttttttttttcagttggactttcactcttataccccaggctggagtgcagtggtgcgatctcggctcactgcaacctccgcctcccaggttcaagcattctcctgcctcagcctcccaagtagctgggattacaggtgcccaccaccaaacctggctaatgttttttgtaattttagtagagacggggtttcaccatgttggccaggctggtctcgaactcctgacctcaggcgatccaccaacctcagtctcccaaagtactgggattacacgcccagcctgagaacctgtttttatatcacatcaataatgttgaccctacaggatcacatggaatggaatgattttgtttatgtagtttaaaatgacactctattttctggaaaaaaaaaaaagagaaagaaagaaa

SEQ ID NO: 131018 - DNA, 1044 bp, Homo sapiens
attattagagttggatttctgttttcacatttcagtgttttgttaagtgcagtcaccaaacacatttgatgaaatcagaattactcatgcatgctgagaatcactcaaaaccaaagaaaagaaaggtgcttaagatatttttgcaggttggagacattagagaaataaaatattatgagcagaaaataggtaaatgtactattatagaaatatatagcgtatatttttacatatttaagtcatctctacattggacttagttaatttttcattttttcttctcttttctaagtgtagatgatcccactttagaaatgagaaaaaagagtgcttttgtaaagtagatggaaatgaaaacaaagcagtaacctcaaaatgtgattttcttgctctctgcagaatctttgtcttacttttcatgtttaatgttgaggcctagattatatttttcccactttctttccataactatgaatcttgtcagtaattagggctcatctctaacagtgcaatattaatatagcatccctgctgtgaacataacagtaggcacacatggatctaccttattttgagagtctctgctgaacacagtgagaagattagggattcaccaggtctacccctttgggccctgccgtgcaccatcctggtgttctcaatggggtcactgtaggaataggtctagctaaggtcgtatcctgggcagtgaggcggagaaattgcctaccaaatcgagtaagtcttttaagaatccttcacttacccttatatgatcgtggacatccttcccccttaatccctttcctctgtcacctgcgtaataaagtgtgactctcattcaacatgggtatgtagcataaaatttaagaattttcatttctattaactttgaaactgaggattatgaccagaagagagctttatttctgagcactcatgtataggctcacttccttccactttatttgctaccaaagttattaaaaattagagagctaattatttacgagataatattttttcaccgaggatatgcgtaaa

SEQ ID NO: 131019 - DNA, 1001 bp, Homo sapiens
gttttaaaattcagagcaaagactttccctgcttgaaggaggagaaagcaggcaggggtaaagaggaaggaaaacagaagaatgtaacttcagatactttgtaaagggttacctcagttttctatgtatgatagtctcaaccattcaaacctgttgttgttttcctcctcagcacacataattccccttaaaatttagaagcagtatatgtgtgttggtgcaaatatctgttcaaagagttttattataagaagactttaaaatatctgtgatgcaggttatgaatccattcaaaaataagatttttgcatccttcatttaataaagcaaggtggtaaaaagtaaaggaatggaaactgccttattttcaccagaaaatttagccctagtcacttggtgagtttatgttatacttcaggaacccaggcttctgttcttaccctgtttcagaggggaaagttacatctttatgctttgttatcttgacatgggcacgtgagttgaatgcagtgccatttagttgagcattggaggatagtctgtaaattacgacgaagttgtttagtcagttaacataaatctttggggattataaaccttggtgtagcaacttaacatttaaggtagaatagaattaaataaataaagcccacattctcttttcttctggctgacttcaaggaatgcactgagcgccatctgctggttgttactttttcaaaactattttcttaccaaaccactgtcatttgaaattgactctaggtatatataccaacatataaaggcagctttatgaagagaaggaaagggcatctatgtactataaatagcccttatatcacatgacagtgttttattttaaactgtcatataataattcaaaatttgccttaggatagaaatctagtaacctttcagataaggaaagggttgaatttccatattttagaatagaccattatgaaagttttagatgtagaagtaataagcacagtatt

SEQ ID NO: 131020 - DNA, 1008 bp, Homo sapiens
tttattacctgaatttttcaaagccaagatcgaatctacctttctttaaatgcctctttctggagttaatcatttctcacctgcttcttctgaacctgattcacaactatatcatattctcttagattgctttttaattttcatattgagtctctctgttacttgtgaagtcatggatgtcccagtgacttactcaactatttattacttctataacatctgatgcagttcctaaagcatggaaggtgacaagtgatgtgtgctgaatataattagagagagtaagacccatcaacacttttctaaatactgtgtatactgactagtcccattttatgaaatgcacatatattgtagtaaaatttcacttgggtgcttctgataacccacaaaagttcaactcctccagctttaaggagtcttaacccaccatcctctatcccaggatataaaacaccactaccacccttcctgttgctttgtaataatcaaggaactacattccagttagacacaactatcctaagtttctcagttgagctcttggaatctatgagcaaattattgggcactcatgcttatatattcccagggggttcaaaaccccaatcagtcagctgactgtctgagaatcactgcttaagggttggcatttggaaagttcaacacttttcagaacttgtgctcacaccaaatacatacatattaaaggtgtctaaggtggagtgggaaaaaagagagagcagtctattgaagaatagtaagatgatagagaaagaaatattcatatatattttacagcaaatccttttaattatctaatgtttaatattttaatgccagaagatattattgaaaagcttataaatatgcatacactggagatgagagatcaaaattttttactgataaaatatactttcaaatttgtaaactacctgccctattactgtatagagctttctctttgaagtaaaagaagctattttcaccttcttctttgtatgt

SEQ ID NO: 131021 - DNA, 1049 bp, Homo sapiens
ggctggcgcccgggagagccggctggcctctgccccctgtgcctggcgcctctccgagccacttagccaatttgaaagcgggtggccattgggatgctcgagcggggacgacgggcagagcaggagggcagaactagctccagcgggggcccagagggcggacttgggaagaaggaaagaccgcgcggcgagggaggagaccgggcggcgagggaggagaccgggcggggaggctgggtttggggcgcgggagcccggccagggacagccgcagaaggaaagtgggggtgtcgccgggggatagagtgggagcagcgtgagagcagtgttgggggcgcagagtggagggcaagcgtgtcttgaacagaacggcaggaggatgggtggaaagtggggcgcgtggaaagcggatttggacgagagcaaaggacgccggtggaagggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttgg

SEQ ID NO: 131022 - DNA, 1001 bp, Homo sapiens
ggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgatatgtttgcctgtattgttttgtttgggggtcacggaagagggaaagtcggccaaattgattagggtatcatataaaagcagagattaggtccgggtagatcttttgagtgtgtgcaggaaaaggcttcattatagaatgctaaatttaatgtgagatgagagaatcttttactcccgatctcctgcatttgaaatacaaaggattgtacccttgggctggttcctggtccttaagtggaagcctaactggacactttttttctggaggattgttccctaaatcctgggaagctttagaaaatagtcaatggaatttttgttgccctaagataaagtcattacaaagaaaaaaaaaaaagaagaagaagaagaaagtaaaggtggtgaaatggcttgaggaggcagaatgagaaatagagatgtcagtcaaagtggaagaagagaaatcactttctctcactttagggatagatcttgttgataggcttagagcagtgattctccactgggggcagttttaccccctagggg

SEQ ID NO: 131023 - DNA, 1032 bp, Homo sapiens
gaagtgagatttttacctctttgccagcatgtttttaaatttccaatcagcagttacattggtgggtgtataacagagaaagcataaagtcatgtgaatgtttcagatacagtttttaattatctgaaatatgaaatgaacaactaagaagaaaaaattaccattctggcatggtaaaaatattctgtaattttaagaaatacctagagagaaatcattttaacatagcctttaaggcatagctgttgattatatactgtattaagagttttgtgtttgagtatcatgcacacattatgtttgttcctaaatattatgggtaaggttttctttggtattgcagtttttaaattatttttgctgtctaatgggactgaaaataaaaggtttttagtagcttaattagaaactatgcacttttaaaaagttttccatcaactgcctcttctgactgaagcacagagatttgcaaaaacagtaatagatacattatagataactacatagaaaagctctgaactaatcatttagattactttgtggaagggaatggagtaaggctgaaatttcactggaacttactaatagtagtaagtccaaataaggtaaatcttaaaacaaaacagaacaaaactcaaagttatgatgttgtaacttatcagagttccttcactgacttcaatagaagtgtattctattcagattaagcagaaaggaatccattggatggttatggaggagttcatggaattgaaggaaattctgaagagcaggaccttggacaggataatatcccagtgctggaatggatcagctctagctattttccatcattgtgtcactgtcctcaagactcagcatttagaaaggacagagagagagagagagagacagagtttgggggaagaataggccattttgaccaatagtcctaaagcataatctataatctgttactactggaagaggggaataaatgataatgtgcctgctgggcaggcacattagactgatgtccattcaggatgcaga

SEQ ID NO: 131024 - DNA, 1040 bp, Homo sapiens
aacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatat

SEQ ID NO: 131025 - DNA, 1021 bp, Homo sapiens
atgaaggatctgcctccatgatcacctcccaccaggccccacctccagcactggggattacaattcaacatgagatttgggcagggacaaacagccaaaccatatcacagggtaactcaagcaaacccttacttgttcttgaaaacttaactcatgtgccacttttatgcggcctttcatatcttttaaccattctacatgtttttcctttgtgttttcataacaatctgtgtattttaccattatcatagcattattataaatcaagaatagttgacttacctttacctgcctcctcctaaactggaagcaagtagaaggaagactgtgtcttataacttcagtacctaataggatgtatagaatattgtagatatttaattaaatccttacaagctaagtgatgtgatcttaatttcaaggaacaaaaggataattgtgtacactgctgggcataatggttagcacttaactttggggtaactaccaaggcaaagccttcattaggctaatgacagtccaaggtaaatgatatcagttgcaacctcaaatataaggataagaggttttaggatttaaatgaggattacacattggacttaaccatctctattaaaagagagcaactggcatgagtgatagtgcttcaaaaataaaggacattatagtatatattgtgtatatatacctacatatacactgtatatatgtctatcatatatatgtgatgtatacatattataatgtatacatataataacctcattgtcacgttatacaacatgttatgcacgactcattatatgcataactcattagataatgttaccataagatttgaggtgctgggatctagtaatttttttctcttatttgctttagtatcagctggagttcagaagtggtatttggcaaaacctctgagaatctaaagagttgattatagtttacaagctgaccagttaccatccagtgcatctaggtttcttaacaaatcacaatttgtgaagctacggtgttt

SEQ ID NO: 131026 - DNA, 1050 bp, Homo sapiens
gaagtgtgttcacctttgtcgtgattggctgtcatgttttcttttttaaggcaaatagagctatttaagctgatttgtctatagctgattgatttaatttcactgaatcatgctgtgaggggcaaaaacataacgcttgcatttttatgtttagggttaggatttccaggaaattgggatgacctaaattttgcttaagtgtctatgggtggttgaccatgaggtatccaaacagtagcccccattttcatttatttatttttagcaataggaatacaggaaactataccaaatttaggcaactatttactaaaggaaaaccaaaaaagggtatgagcccattactttgttcagtaaggtctggttttaaatatcgatcttattaatgctttttgcataaagtgtaaccttaatgtgtatttttccttgcttcatctccgaggtgactttctagttaggacaccattggatcaaggtgctcaaaaacaggggggcccctctcccattacacagcacagtgcttctgggtatgtcctgtttctggcagcttgaggatctgactgacatagcaggatgcttcagaatatctttttgtaggaaaactctctctcattctctctctacttcatctgttctaactaaattccaaaaaaaaaaaacaaaaaggagtgggagagtttgtattgttcttctgaaaataaaaacttagaaaatagctttttttggtattcagccacaataatgtgcattaatattccaatcttccttctgctcatgaaaaaggacacagaggaaagactaacaaagaaaataaacctgtaaagaatagtattgaatgtgagaagataaaattaatatattcctaatgaccatgacaggaaataatgatagcattaaactgtagtgtcttttccataagttttagatatactgggcatatgtgatgcttattatacacgtaggcatctcaagcagaatttaaccttgagaataattgttaacaaaattgattattaaaaaaaatcaatggctttgttatttgagtgtaaa

SEQ ID NO: 131027 - DNA, 1063 bp, Homo sapiens
gtgtattgtgttgaaataaaattcacacactacacggtaaaggaattagaactagaatcctggtcgttcaacttgaaattttacaatcttttcataattcctgctaatagtgtgacctcctaaactgtaaaggaaattttgtaggttaaaaaaaagatgtatttatcttctgtaagtggatagcaggacctttaggaaaagaataaaagtaatagaagaccaaagaggaagagactcttgggaagaattttttatttcacagaaatctttctcccccaatagaacaatgaattgcttgtcctaatattgtttccttacctcttaacatattgccatataacatattctgctaacagtataaagacttggctgtctttactttgctattattctttctgaatctacaaaatttttctttaaaaataatctgcatgtgttctccttcatttatttccacacttttccttcggaagacttgctagtcattggagaaaatatggtgtaatggttaagggcccaagagcgcaaatgagatttcctagtttttttatccccaactctattaatctttatcaaataacttctctgtgcctagatttctcaactgtagagtgtgtataataatagcatctatgacctagggttgctgtgaaggttatgattactgcatgagaacacacattgtgtacatgctggttactctccagcttgctcagtacatgtgattctttaccactcttgtttttagtacaagtcagtccttgagtcaccctgaaatttgccagtcacatttatttacttgatttatatttttcactcagatctgaatgctttaggaatatacccataaagagaaaaacttaaaatatattttacatttacatttttatgcaaatatgcatagattattttgattttaattgctctttattaaaagaagagtgccttttaaaaattaagtttactataaggtaaaatcctcattcaaggtgaaagcatttgtatttgaggatctgaagaagaatacatttaggtgatgttatctaagtgcaatgtatttttg

SEQ ID NO: 131028 - DNA, 1030 bp, Homo sapiens
tcactaggatgctgactgtctgtgcatttctctcacttcactaactcctgagtttagcatcattttcaggcaccacatggcagcaaattggcccctgtcagtctcaggcttatgcggctcatagctaacaatccagtgtttattatttggccacaagggctatatttggccattcttagccatgagaacacccctggataagtctttgtccagaagaatgggaaactgatatggattaagtgctcaactgagataggaaaggtgaaatggcaggaacagagaatgggagactttaaaaccagagatgcaagatgaacagcagcaataccaaattccagtgtgggttagtttcatttgtttcacaataaagggaaagattatgatgacatttttatcatttgtttgtttttatccctgtccagtaaaatcctcttttagattttaaaatatcctacattaaaagttaaaaataaatttaataagcaaaggcggtcctgctgtattctgggaagtgtctgtaaggctaccgtgctggaagctggttgtttggggtatgtgaaacttcaatgtcagtctgcctgctttctgagattcagatattgagatggtgacaattttgtttcagagcaaagaataaagaataaaaggcaagaaagtaataagaaaaaagaaaacccttgagcaggaatagtaacataacaagatcaccaccatcctttcagaccaacacatttaatgagtctcagagatacatcaagagcatatttcttattccagagtcaatagttagcaactgaaataacctagtggcattaatgctcctgcagggccatttccctttttcatttctgctgtcagaattttcgacctcatcatccctagcctggattaccactttggccctctgcttatcacacctgctttgagggggtcaggagctcaacttggggtcaggctcaccatcatttttttctgagttggagtctctgttgcccaggctggagtgcagtggtgcgatctctgctcaccg

SEQ ID NO: 131029 - DNA, 1035 bp, Homo sapiens
agcttatagaaaatgtgacactagcataaactaagaaatatagagagaaggaaggaaagcctgtaaatgcttgacattttatgagatatttcatttactgtgtcacattagactgatgatctaattcaacttccttgtttcacgaatagagaataaacttgagattcttcaaatggccagacgaggatcacacaacttactgacaccatcctggggtagaacccaagtttctaagccatcaattttatgttgtccccataggaaactctcattatgaaacaacttctcagatgcctattgatctgggtttaaaaaatacttaaacattgtcagaatgtgttatatgtagtcttaagtatctcagagtttcaaacataaatgttcttgaggtcatatcttttccttcatgatatgaagaaaaaaataaaatatttttcctaacaaagaaagtggaagtataaagtctattggaaatcacctttctcttatgttgatgtataaacagaattccatatcttgtctggttataagcactatcaggacaatttttatttcaatagttaaaattgtacataataaagaattataatagctacttaaaacactaaaagttaatgtggctttttataggtttaggagaacaaatactgaactcttttgtgggaaaactcagagcattcattgttccggttatatctgaagttatttacaagtataattcatgaacttctattttatctgttaaacaaaattataggaggccattgttttggactgagctcctgttctgggccccaacaaaccagaccaaaccaaaatggagtcactcatgctaaatgccaaataatcaaacggaaactttaaaggagcatatgcagtcccaagcagaccagtttttcctcaaaataggagattctattctatccgaatcagattaataaggaagtccagtctgctttgccccttacaaaaaaaagtaatctagggctgggcgtggtggcttatacctgtaatcccagcactttgggaggccgg

SEQ ID NO: 131030 - DNA, 1076 bp, Homo sapiens
atatatgcttttttttttggtaaactgaaccctcgataaaaatgaggcaatacagcttggaaacttttgaagttaactgttgtggtgtcagaatttggagttcctttgcctttacagatgtaagtctatatgccgtaacaattttaccaaggacaggatagacagcctcttttggaatgtaaacagacaagttaggatgtggatgaaacttcatagctgcttacttcactggcaggccaatattattattctggcagtcagggtccagctaaaattagaattcattaaaatcatggttcttgctttattccttgatagccactcatatgcgcttgtatgcacacaacaattttcagagtgtgctttatttttgtgcttttttaaaaatatgatggcctctatgttaaatggttttttataggtaaatattatattttattaatccttgtatcattaatactaatagtaatagggcacgagaaatattttgtttgcttatgaatgacttaaggaagctgaagtttgatatttaaaattataaatataaaatgtaaaattgtcagtaaacaatggactgattccatctctcctttgccccatgttttccgctttgcagtaagtaaaaaaaccacaaaactttgggggtcaaggtcaccaagtctcaaacgtggtggcagacgctgctagttttctgccagtatccacttccccaccttccttaccgacaggcactttggtttacggttaggacactagatgcccggaataatggctgcattttccaattgtctttagagtaagagtggccaagtatctaaactcaggccaataaaatgtaggcagaaatgtcatgtgtaaatgttaggaagcatccttcttttcttcgtcctcctttctgctggcaggaatgcagacatattcgctggagctcagcaacctcttggaccacgaaggcaaacacatgattgagaagggtggactacaagaaagaatacacctccttccctggtgtccatggagttgccatatatgccttggccttctcaggtcgagatttatttgtatgaaagaaaaat

SEQ ID NO: 131031 - DNA, 1031 bp, Homo sapiens
tattctgtaagtgcatgcttggaaatgagtgaaaaaatgcaaagcaggtaattcaatggtaaataaatgttatccttctaaaagaaagctttaaattgtgaggctatcttatagaattcatctatgtggaatttgtaagaattctttccatgttacagcttcagattttatagaaatgattcttggatatttttatcagcactatcctcgattctagctagtgttctgcattagatttccatgcagggagctattaatttgttttaccagtgtcacccccaccatgcagctgtgaggtgtttggcatcctcattctcccacttagcatttgggttgcccaagtgctggcagcaaaggagacaagaaagtaaatctaaagcatgcaaaacgagtcactgatttatgtcactgatacctagtttagacatcgttaaccttctattttttttataataacctttgtaattcttctatattcctaacatcttctaatttttattttggggattattgttttataaatattttaacaggaatgcacagtaactcatcattacattaatttagttaagctgttatagtccctcatcgggctctctgttttgaaatccagaaacaaagacatgaaaatattgactgatatgggaaaattaactgggttgaaagattactaatttaaaataagacatgtaacatttaagtgtatgccatgcttgatttagcctgactagtgcattctctaactgttgtggaaaactacatgggaatctaaatcagaagtttggctgataaccatataatcataacaaggagagctacatgcttccagtgttcaaaggaatcaggataggatacacttggcaggatacacctgtcaatagaggatccacctgctaaacacagaggtcagcctcgcagggcagcttcttcgtgtctaggagttggattagcactgccaatgtttgccccgatgattctgagttccacttctgccagactctgtctgcttggctgtcttgtcaatgttacca

SEQ ID NO: 131032 - DNA, 1086 bp, Homo sapiens
aatctgtgaacagtgtagtctgcctactatgacatcgtattagttgaccatatccacgtgttgattttaaaatgtaactctgaggttaatgtgggaagtgcaggatgcctgttgtgactctcgtagaaaacctaggaattttaaaagcataggttagtatagttacaggcatatttacaaatacctaagcaattctcccagcttttaaataccctgtataagaaagttatctttttatacattaaagaaacttcttgctctaatagttatgtgtatgatacttgaaaaaatatataaataatttagccatttcatgtaaaatctaagaaatatatttaatctaggaaacttccaagtttccaggaaactacagtctcagttggaaaaaaggaatagtggaacttgattgtttcatgaatcttcctatttagtaaataatgatcagagagagacaatgagtaagttgatgctcgttgaaatagaaacaaagggatgcgcagaatctgttgcagaaaactacgaataagtgacaggttccaggctaatctgagggaaagaattgtttctggtagcatggataagtaattggagacaaaatactggtcagcatatgtacagtaacactaaaatagtgggaacttagtgtgtagtagggcctggagattagcaaggaattggtttagtagtggagggtctcagtatgttgatagagatcctagtgaaggctcaactgattttgcaagatgacatctttttgacccaaattatttttcactgtgatgcctgcacacactttaattttggtccccaaatctgttaaagactggacagcatcttgtggaggtgatagtaattcttctagagccatgtatgggagaaagaagtcactggatgaaaggcagaatccaagtagccactcaaaaactagtgagcatctataacatgccatgtcctgtgctaagcacagggaaacagtattggttaaaagtaatgactgctctttttggagctcatttataagccagaagactgataagtgatcaaatagctctgatttaatgtgataagcgctttaaaagataaaag

SEQ ID NO: 131033 - DNA, 1054 bp, Homo sapiens
attattacctgacattgacgggggatttccctaaaattgtagagaattttgtagaacgaagctgtgaaatcataaaagacagggttacaaagcctgagttcatgatcaaggactagtgaagacaaagaatcttgttacaaaatgagaaaaataaaaataatattggcctaagacttcaaaatgagaaaaataaagatagttattggcctaacattactttcttcctttagtttgaaaatgatgtccttcctgactttttgttattaaaatggacattcttttgtgaaatgaaggtgataataaatgatcattgatgtcactaattgataaaatcagaagtggttagccctaaattggggttccacctctgatttccacatgtgtgctttcatagatctaagaatgtgggaactactgatctaattcagctaattactcaaaccatgtatcccgtcaacagaaatgctaacaagtggtaatccagccttccctgaaaacccttcctgtgggttctcagccagatgggctacccattatgcttttggactcttctaattaatacaagtatcccctacattggatgtaagtcttctatactaattgctactttttaattttacccagaactgtatatgctatgtctaatgtaacattttcctaattgtgttccacagaacattaattctatggaactctatggaataattaatatctattaatagatattaccacaaaaaggggggagaactacagtcaaattattttggaaaacaatagttcaaactataggttatttcagtacttcagaaatgcatttttgggataatacacacacttttcttttttttgagacagggtttccccctctcgctcaggctagagtacagtggcatgatcatagctcactctaacctgaattcctgagcccaagcgatctttccgtctcagtctccccggtagatgggactacagcatgcaccaccacacttgcctaatttaaaaaaaaaaaatttatagagatgaggtctcactttgttgcccaggctgatcccaa

SEQ ID NO: 131034 - DNA, 1718 bp, Homo sapiens
tttgttatgcatgaaagaagcaaaattgttcattatgtggggagtctgtgaggcagtcactgcacattggctcacttgatatccaccctgctcccattctaaaatgtcttcctgcactctaaaggctggaaactagaaagccacatttttaagagtcctttactgctagacttctacctgtgctctaggttctgccaagcagattcagacgtctaagccttggaatgtgtgaaaatgaggtacgggcatggcagcaaagacatgtgatgggtacttttgtgcatgctggtctggtctttggcattatagctgttgagcagtgggcagcagcagcagcagcaaggtttcctctagaacactcttagggtatggttggaagcttctgtaactgtctactatcccgtaataaaattcttgctacttaagctagctagattacattctctgcaaacaagatccctagtggatgcagagggcttcaagcctataaagggatattggttcaggagggtctctgacctttggtgcccatccagtgctggaaaattgaactagaaggctcattttaagtttaaaatttttctgatttttaagacagaagactctgaatagggtagagaggagatccttcatgcatttgcttaagcaagtttttctatagaaattatctcctccctcctgagttagccatatgacaaaaagcattgcatttctgggagaaaatgtgcctcttgtactgccttgaagaataactaaaccaaaataattaaggagagcccaaatgaacattgcctgttatgtgaatccaatcaattctggaaaagcaataatggaatggggagttctctgatctctcttgtctttgtttttcttctcctgccctcctccaacccctaagtcaaggggaaaatgggaagggcactggaccttgaaggtggatatggtgatgtgggaagcctccctggaagggaacagtcattgagaagggcaggatgttttggaaacaggagtctgcaagtttctctggtgtaaagggaagtgtggagaagcaggggaaaataagcatggggacaggagctaagaaagagctaaggagatagtcttccatcatgtggataggctgatgattttttagcagacttttaaaaaaggcttttttaagaagattaatatgaaatcagtaagttagatgattggaggtgggaatgaaacagcaggagaaatagtgatgaagctgcttcagtaagccagcaatggcaaataaacacctgaaataaaaaactggaaacagaaaggacaagagttagcaaagatgcactggcctaacttaagaaattgttatgtaagctgggtacaaaaaaagagtttttaaaaaatgagagtgagcattagtgccatgcctcttacatataaataagaatacagacatgttaaactatagaacttgaagattaattatccttgaagcataattccaaatacaatgttggaaaaagattgcaaatatcagggaatgcaggtttgcacagaccagtcattctttttagttgtttgttagtggaaaaattatttatttcacaattgaaataactagcaccaaatatctaaaagctggtgggtttaccacagaaactctctctctctccatctagacacaattatgttttccaggttgcactaggagaaacctcatgctacgttctcatgggtctgaaaaa

SEQ ID NO: 131035 - DNA, 1169 bp, Homo sapiens
tacataattaagttacttataagacacactctttttaatacattttgatggttagttctactcacacttattgcttacatagtcataaatttttgcctctttgtctgcattccaatattattttgaacttatataatttatttattatagtaagccttcttcctttttccttttaactagattgtgtgtctctcaaagacatgtttatgcgtttgatgcatagcatggcatcttggctcatagtatattttcaaatatttattccatggagtttaagtattcctttcttagaactatcatgcttgggcttttgctcattccacaagtcttgagaatatcctaagtattttgccaggtaaacagaacagagtccctctcttagaaagcttacagccaaaggatcagaaaatgacaatgtagtctgtaagtgttattggtgtaggtaaacttgaggttagagaatggctaattagaggaggtgaccttttatctgagttgtaatgcaattaaaaaggaaaagtgtaaagatgagaaaacaggagctatagttataacaacatctacacagtcatgagtgtaagagagaatcatgggatcagatcacggctaattgtgtgactgaggggagtggtgagtaataaatctggtttaacacaaaaaatcagttacaaacagatttctatattgtcattttaaagctacaatttaaaattaattggttgctaaattcttgacaaaggggtcaattgctgtggctatccattggtatttctttgaaaaaataaaaggttgtctggtttaaaaataatattattttatttcattattttagaccttataagcacatttagaatctgtatggaattagagttctaatatatatgtatacatatacataatatataaaaataatagtactttcttttaaaatttgaattttcaatgagataatgcaagcaaagtgaataccatagtgcacagcaaatgtaagaattcaatttgtattattggtatgttttgtggagtgttctgtctgtattcatgggaaagatccagtgaggtatgaagcatatttggcctggtgagaatgcataaatctggccaatgctcccttgaaagctcgtcattctggtctaatattttttaaatatttgccacttggtccaagg

SEQ ID NO: 131036 - DNA, 1398 bp, Homo sapiens
ctactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctca

SEQ ID NO: 131037 - DNA, 1051 bp, Homo sapiens
tatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctaca

SEQ ID NO: 131038 - DNA, 1316 bp, Homo sapiens
tcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgag

SEQ ID NO: 131039 - DNA, 1064 bp, Homo sapiens
gcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagt

SEQ ID NO: 131040 - DNA, 1050 bp, Homo sapiens
caattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgct

SEQ ID NO: 131041 - DNA, 1122 bp, Homo sapiens
tatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatg

SEQ ID NO: 131042 - DNA, 1298 bp, Homo sapiens
tttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtg

SEQ ID NO: 131043 - DNA, 1029 bp, Homo sapiens
tatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaatt

SEQ ID NO: 131044 - DNA, 1993 bp, Homo sapiens
aaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctggg

SEQ ID NO: 131045 - DNA, 1001 bp, Homo sapiens
cccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagag

SEQ ID NO: 131046 - DNA, 1033 bp, Homo sapiens
tggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactctt

SEQ ID NO: 131047 - DNA, 1028 bp, Homo sapiens
gttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactc

SEQ ID NO: 131048 - DNA, 1118 bp, Homo sapiens
tttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaa

SEQ ID NO: 131049 - DNA, 1073 bp, Homo sapiens
tgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttcc

SEQ ID NO: 131050 - DNA, 1062 bp, Homo sapiens
tccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttat

SEQ ID NO: 131051 - DNA, 1025 bp, Homo sapiens
tgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattga

SEQ ID NO: 131052 - DNA, 1066 bp, Homo sapiens
aggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccatt

SEQ ID NO: 131053 - DNA, 1058 bp, Homo sapiens
caattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatat

SEQ ID NO: 131054 - DNA, 4009 bp, Homo sapiens
ttattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggct

SEQ ID NO: 131055 - DNA, 1001 bp, Homo sapiens
ttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctgg

SEQ ID NO: 131056 - DNA, 2105 bp, Homo sapiens
aatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttat

SEQ ID NO: 131057 - DNA, 1016 bp, Homo sapiens
catattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatt

SEQ ID NO: 131058 - DNA, 1615 bp, Homo sapiens
ccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaac

SEQ ID NO: 131059 - DNA, 1071 bp, Homo sapiens
atatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgat

SEQ ID NO: 131060 - DNA, 1027 bp, Homo sapiens
tttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaa

SEQ ID NO: 131061 - DNA, 1004 bp, Homo sapiens
ttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacat

SEQ ID NO: 131062 - DNA, 1104 bp, Homo sapiens
ttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctct

SEQ ID NO: 131063 - DNA, 2113 bp, Homo sapiens
cactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggc

SEQ ID NO: 131064 - DNA, 1056 bp, Homo sapiens
gctagtatcacaagacacctcttacgatgatatctgtctcacaaggtgcttgggaagatgtgcctatcacacagcaggcgtttttatctaaggaaagtagctttctcactttacagccaggccttattcagaagagtgtcaatgtcttagaagctgtctgagaagaggccttttactccatccttacactcaaacaaattgaactttgaataatctatgtcagtgcctgcataacttaatattattcagaattgaatatgaggagactcttgaaaccttcatctattaatacatattctactgatactataagtaacctaagttgcacactataattttattgtatttcaaacagaagaaagtgtatgtggaatataacttataaatactataaaaacaagaacagaaaatacaagaaaacatcttttattcttatgctatttgtctttaacatttggcgtaggtttcacttgtaatagaagtgtgcatcttacatgaaatcctacttagaaatattggtcattaacttatagctttataaatacggtatggaaacaaaatacgcatactttcttaagataccagaaccttcagtttgaaagagactcatacatgaaaacaaatataattcttatagcagtctaatacctattattttgaggtatcatatttagacattaatttttacatttaacaccaaagtgctatactatcaatgcattttagtaatttcattgaatccagtaagaattgcaatctcacattccattccatttgtttttaagatcacataggcacattaatgtccaatgattttctccttgccatcatcattgtatattttttactttggcagaactaatattgcagttttatgacttaaacatttcataaagttttctttgttacagtatgaggaacattaaactgtctcaaatctgtttttaattcaccaatgattctatgggatttttctaatactgaacattccacttcatagattttctgtatttctccattgttggagaaatacatatcattgcattgatgttaatg

SEQ ID NO: 131065 - DNA, 1005 bp, Homo sapiens
ctggaatgttctaatgactatctacttttgtgatgtcactggttagatcagttagagttgacgtatggatttgcatatcatgctttcaactcccagccaccttgaaattgaaattaatttttttctggttacctgagaatttatgcaacccataattacctgtagcccagaggctagaaaatgtggaaagtttaactaaatatggctaccctcttaaaggaaaacaacagacatttacaggaggcatttaaataggttgaaatgttgtctgagaaaaacttgagaattaagattttttaaaaacaacaaaaaaactatatttacttagaagcattcagaatgtcaaaaaaacagctacaatttcttctgcaattacagagtagtatttactactactctgttaacagattagttaacagaacaatttcatgtaattatttcagtgcatctgagacaaatggggatgagaaaacccccatccctgtatacgattaatcagtgctgtgtaccaagaacctactttaaatttccatgacaatgtacagctcccatactgtaccaggcaaggttagtgtctactgaaaccaccaccaggacagagctatctaaagatacatttggtgatgtgctaattacacaaaataaagacactgtgcagtttgaaaataaaccttagacagcaccacattttaatcttttttctttaaaaggagtgagttgtatacaggaggattaaatgatttatagacaagaaaaacaactgttagaaccaactcattcattatgatcttcatcatcttcatcttccttcttctcatccttttcatcttcctcctcttcttactttatcttgcttttttgcagccttgatgactaccttttatgctgcatcaggctttcctttagctccatgtacagcaatatatttttcatatttttccttcagctttgcagccttcttttcataagagtgcatgtcatctgcagcagtgtcattccacaact

SEQ ID NO: 131066 - DNA, 1042 bp, Homo sapiens
gacaattggaagtcagcaccctcacctttctgcccatctgtatatctttaaacattgtaccgacttgtattttcttgtgaaagagataaacttttttcttttaaggctaccccaagcattcttaggccttagctcttcttttccaagaggatcttatttacctgttatgacctgtttattatcttttcctccttttctctaccagctctttctgcatgtcgttattactccagcgcctaatcttcatatttccacctggttattccacatgtatttcaaattcaaaatatctaaaatgacatctaattctctgctcaaatgggctcttcagcctactatgccctattttagaaggtggtattacctccctactcactttagccacaacctagaagtcacccgaaactcctccgagattatccttatttcccatatacatttggtcaccaattccactggattctaccaccttcacaacttgttggcttcttcctctcttaacccagctctactctttcctctctttgcctaccttgactacttcagtggtctcttaagtgatcttttctctaagaccaactctaggagaataggtatttattatgcaaaattataatctttaacttcttctgggtattaccttgaaacaaccaattacgcacctatatttatcatgttgccaagatcttaagcattaactgtattttggagatagtcttttaaaaaaaacatacattgcatttattctattatggtagtcacttgactgtaaattttcaggtaacttgttaatttcttgttaatgaagtaaacaaaagtggaggtagatgcacatgccaatgtataatatggggttgtcttttgtcattcttaatcccctctccattaaatataccccatacatacacaaggaacagcttacctttgtgtgtacaatatcttaggaatgtcagaactgaacttaagatttaatatctggctatatggaagtttctctgcttgacaatgaaaattagatgaatgcacttttgacaacctagga

SEQ ID NO: 131067 - DNA, 1089 bp, Homo sapiens
caaacaagaaaaatattaaaagtttataaatgttagacttattttttagagcgcttttaggttcacagcgaaattgagtggaaggtacagagatttttagaaaggggtttcttaatggccagtcatactcccctcattgccaagtccagcatcggtacagttctctgggacttgttcctatggtgatatcttatcacctctttcctttggctagtgacactgcactggttttacctcctattttctgtccattctcttctttggttccctcactgagaatgtagactagtgtttcttcacctttattcatttccttggggaattttacccgtccctgtttctcgaactgtcatttctacataaagtcctttaattctaggctcaatttttcttttcttctttttttttctttcagcttcagattatcctacactcagatctcccaattactgccaatatggatagatattccatgcatactcaaacctgacaattcgctttcttttctgtgccccctcccaaatgtgttcctctgcttatattctttttttatccatggagttctgggtgccaaggctgggagcctcgctatagtctttgacttttctgttgcctcgtatcagtttgttcttgcctaaactatatcggattagtgagtttatatccatctcattctttccattcccaaagatatttcctagctcaggctctcatagactcctcatcctccagcatctacttcaatccacttatgatgctccatcccttacagtgctgccacattccatttttctccaccacagatctgatcatattacttctctgctaataaaccctaaacctcccaggcctccatattgactgccgaataaacaccagccttttctatagcagtcagcgttccccaccatctgaccacagcctgctttcaaccttctaccaccttgaaagcacacttggcttaagctatcccagataacttcatttctgggcatgccatgtgttttcaagctcttgcgctgttgagcatgtgtgtggtgcccacctaaaatgccactgcttctgtgaagccttcctggaattttctgc

SEQ ID NO: 131068 - DNA, 1065 bp, Homo sapiens
tttgatagtcactaatggggcctggttgcaataattttaaaaaattaattaggcacaaacacaatacaatactgacaatgaatatcttttagaggggagacacatgccaacattttgaaaagctgattaataactcttatttttctctccatgtagcatattaagatttgtctccctgactcccccttcaaaatagtcatgattggctattgttaacccctactatctgtcttggtcttgaaaccacttatgattgatttatatgttaagtggagttctttgattactttcattttttggaatggttgtaagccacatttcagactggattactgaaaggtggatagacaaatcataactttattgtggtctcctggaatttctggagcatggcatgtaatgacttaatcttatatctccctcattctatttttataccttgtggtattttaaccagggatttatgaaaacttcttgatataattctcaatgcagcaaggtttccaaatgtataattcatgtttctggtggtccgatggcagggggcgtgctatgactagtgtttctttccgtagccttttccgtactgaatcctcagcttctccttcctctaataactccttgtttcacaaaattagatatagtttcttccataaaaaggaagggtttgtcacaaatattgtggcatgtttctggtaactgaggccagagaaagcaaacattttctcttaaaccttatagagataaattaatttgtgtttgtgttcttaaaaatttaatgaaaagattcgaattttttttttacaaatactttctaaatagtttacttctcctgatattctttcaaaatacaaaatgacacatggaacatactaacctacagttaaatgaaaaagtttcaaaacacattttgtacacttgcttactttaagttccaaagtatttcagaaaagctgatgtgatgtttaactttgcaacataaacatgttctgttcttttctcttttttgattggctgctttctcttccaacataacggcataattttttaaggcagggtcttacc

SEQ ID NO: 131069 - DNA, 1049 bp, Homo sapiens
aaaaaaaaaactatcaaagaaagatgaaataataaaactattatataaagggtgacttacattttggaaacaacatattacgtataaattttgaagaattggaataaaattgattcattttatcttgctgtcagttttcttgcatgtgcaagtttgtgtttttttaactttcttttttggaataattatattcagaggaatttgcaaaaatagtacagagaagtccctgtaggctgaaccctgtttccctcaattttttcactttgtcttactatggtacagtatcaaaaccaggatgttgacattggtacaatgtgtgtacaaatagctccctaccattttatcacgtgtagatttgtgtaaccatcactgcagccaagatagagaactatcatcatgatctccctcatgctacctttttgtagccatacctactcccaaccaactctaaccctaggaaccactaatctgttcctcatcgctatattttgtcattatgagaatgttatataaatggaattacataatacacaacctttgagattagcttttttcattcatcacaatgctcttgagagccatccaagttgagagatagatatatatatatatatgatcagtagttaattccttttttattgccaaatagtattccatggtattgatgtgccacgtggtttaactggtattgatgtgccatgtggtttaaccatgtacctattgaaggatattttagttgtttccagtttggtactattacaaataaaactgttgttccttaatttcttaaaagtggctcctcagtcactcactgtatagttacggagactaggcatataagttgaattttataagtgtcaaatgttaaatacagacatactgtttactggatactggaggtatttaagagctacagagccctcactgggtcccttttttacatagaagtggcttgatttttcactttggttgaactgacagccagtcagataacagaaacttgttgctgctctcaaggaggaggttcaaagataaaaaggtacatactg

SEQ ID NO: 131070 - DNA, 2008 bp, Homo sapiens
acttttaatcatctctgggttacttttaaaaatgtaaatgctatgtaaataggtgttatactgtattggtttttcatttgtattatttttgtattcttttttattgtttgtttgctttttcccaaatattttctatctatggtttgttgaatctgaggatgtggaacctgtggatatggagggctgacttatatagagggaacatcataaaacctttttctcccttagatcattacttcttgagcacctggcaaatgtaaagtactgttctagaagctgaaggatttccgtaaatgcagaatatgttaccctaccctcaaggattttacagtccagttggtgaatggaataggtcgtgcatagtacaagtcaataggcacaagcacatgaacaaatcagacagtaggggtcatggtatataagagaagggtgatccagaaataccaaaaagtatctatgcagagtgtgagtcaacactgtgtacataaaactaagtttttaggcccagttaattaacattgctgtttttactttttcattagcatgttggcagataaattgaacatgactccagaagaagctgaaaggtggattgtaaatttgattagaaatgcaagactggatgccaagattgattctaaattagtgagtattatgttagctatgctacatactatcagttcctgattatacttttgggaattcttaactaggacattttattacctcctttaataatttattttgttttaatgtaaaacagttctttgaaggcaacagaagcctcctattttttttcttccttggtaaatattgtcatctctatacagtgcattaaaatatgcgcaaaggtatgtcatgctttttacttacctgagaaactcagtcattaacattataggatcaatttccctgtgtttccttttagggtcatgtggttatgggtaacaatgcagtctcaccctatcagcaagtgattgaaaagaccaaaagcctttcctttagaagccagatgttggccatgaatattgagaagaaacttaatcagaatagcaggtcagaggtaagaaccacacatcttctattctgtctggggtttagcaaccatgtaattgttacatgaagtttcaaagtgtattgatgagttgtagctgattttgtttttctctttaaagatatgaacatttttaagaaattactaaacagaaaattttttcttagatgtattatatgcattaaacatagaaactgaaaaagaaattgtgttcctagtttattataactatttttcttttgctttgactcttcctgtgtgacttcattaactcatttcctcagggttttcaacacatcattttgatactggcagatgataacttacatgtgtagccctctttcaagtgttcgaaatgtgtattctttctaaatctaaagaaataattctgtaaaaatgttgatcttattatatgtattagtgctgatcttatacaaatttcattatctttcatctgatattcatatcaaaaattaatctcccattttgatagagatcctgcatgttagagattgaagaaacttgaatggccttataattttggaatcctaaactgtgttgtttagacattatgattatgtgtaactggagggtaggaagtcattaggaagcagttgtgggatatgcagagaccccatttgattgaaattttaggaacaaatttgtgtccgcagaataatcctttagttcaaatgagaaggatgcattagaattcaagttgcatattttagccaagtttagaataactgagcctagaaagtaactttcatatgatgtttttttctgtatgctttaggattaatttgtatcatttattgttccagtattaatgatactgttattgctatatattttaattggccaaaagctataccagataataattttggtgtttgttttgtcctgagtgggacatctgacatctagtaattgcaggagttaagatcttagaat

SEQ ID NO: 131071 - DNA, 1543 bp, Homo sapiens
agatacagaacatttctatcacaaggatccttcaagctgctcttttatagtggtaccctcttccctgccaccctgtccttaatttctggcaactactcatttgttctccattcctatatttttattactttgagaatatgcaaaacattttctaaaagttagtgttcagcttcctaaacggcaaatatgctatgtatcatgattatggtataattaattactagcaacctaactagtagtacagctctccaaagaaaacattacagatgttaatgagtgcctcttttggccaaacacggggtagaaagtagtgagtacactttcaaagaacttaaaatccagaggaagaagcggatattaaataagtggacaaataaatataaagttacaaattattgaaaatatttgtaattttgggaaatttcaaaatttcatatttgaagttacacattattaaaaataggtccatatcattctctctagtcactctgcattggggaacaatgagaagaaaattaggtagggtcagtgaatcctgataactctccaaatgaaatatctttaagccccaaaatagacttttttccactgaatactaactatggcatattattccattcactagtttatgctggcttatttttgcctttaattagtttaaagctatctgatgttctgtcttttgagggggaagggaaaggatatatctcagcttctttttctcccaccaaaggacacatttcaaatgctgaaaatagtattataaaacccataattgtttattaaataactctatttgtaatttggaacattctctgttaatagatttcctgactaaatgcctgtaagcacatgtgatagtcagctttataaaaatgcatattaagaatgttttatatgtttttatacaaccttattgatatgtaggataagttacaaatctgtttaccataaagtttgcaacatctgtcaaaaaagattactgtgttggggtttaatttagtatagctgaatcattttatcagctatggtatgtgtctgaaatttaaaagctgttctaaaataattcttggacgagttttcaattgtagatgaaaacaaattatggaagtaatattttggatgtgtatgataaacatgttggagcatacattagtataatttcccaatgggggttacttaagttttgaagttattctactttgcttattttattaagttatattttagttcttaatatttttcttaaagttcttattaccacataacaatttacatttagaatgtaaatgtatggagacaaacagtttcaaaggccattatcattgcatttctgcattatcaataaggttcagttatttataagattataaagagataattttcagttttcacataaggatttagcatttctcaattttctcctcttttctttgtcctgtttcctcccaatcatacagttaaacatagtttacacttaacactgattctttaattagttgtcttaaactaattagaaaagacttggagtacttttctttgg

SEQ ID NO: 131072 - DNA, 1939 bp, Homo sapiens
ggtcatttgggtgctttttggtccagaactgacttagctactaccgctgttgtgggccttttgaaagctgacccttttttttgcatctttagcacctaacatactaactttgtagcacctaatatgctttgtacagtatagtgtgagtatacaatataaatatttgttaagtaaatttcttctgttattagtgaacttggcatttttgtccatgataatgcttgtctgctttggtgtttgcttccgaggtactatcaataagatttgttgtagctcttttcctttaactctgcagccatgtattcattattttctttcttgggatttggtttattatcttttaagaggaacatagattaagtatgtgttctccttactgaagggagatgtgcagctcaaagaagttaatagagtgggaatgtttctatatacctttatgtgacactacctaagaatttttcagacttttctccgtgtagatttttattacttccttgatctctgtagttttctgctagacaaaaatctacaaagcattttcagactaaagtcctagtggctttccagagtctaaaaatatttttttttctagtagtagcattttctttcacttcagttcttcaatttttttttcaatgttttactaagatgattaagagtacatagatcaataatgtatgtttttctttttctttctttttttggggggagacacagtcctgcactgttgcctaggcttgggtatagtggtgcgatctctgctcactgcaacctctgcctctcgcgttcaagagattctcgtgcctcagcctcccaagtagctgagattacaggcatgtgccaccacgcccagctaatttttgtgcttttagtagagatggggtttcaccatgttggccaggcttgtcttgaactcctggcctcaagtgatctccctgccttgttctcccaaagtgctgggattacaggcgtgagccacttgcgcccagcgttttttcaagtactatggtagaattttcaatctgaaagaaatcttagggatcttctgatccaacaacacagttacttttcaggtgaaggacttctcagtagaattttctgtagtgatagaaatgttttatatctgaaaatgtgtttctatgtgttcagtacagtatacttcatagatggctcacatttcaagatcttgaagtatggtttccaaatctctgtgtgacagtgggacttattttcaaatgtaatatcatatatatgaatatatgtatttatatatgtgtataagcagatcaaagcagagcccattcaccgtgcctatcttacagttctgttcagcttctctcctgactactaagacacctctttggaacacagttttacaaaacactgactcagaacaactgcattgttttgtagccaggaaatttaaagctcaaggacattaagctaggtcttgatagagcctgtactaaaggtatctgacattcattgtactgtacctcactgtaagttcttttatattgtgaacaatttatatttttagaaatgtcaggtttagattaatttgtcatttagtttatcagttgagccagaggataaagatgaaaaccctaagtcactttaactctgtgtttcagaatctttgtagagtttgttttataaactccctatagccaccctaaaccattgaatcagatttattgagtaggctatgctatgatttgcagcagggctgctgtgctgtatcttgagggtggttattccgaagcacagccagaatccaaaaccactgcattaggtaaccagttttttaggcgtgtaattacagcctgctaaagtaatggagtgaaaaatcagtaatttaatacctttattatataatgaattaagaagataagcttcttcgtgtttctaaggatgctttagtgggttagaaagacaa

SEQ ID NO: 131073 - DNA, 1048 bp, Homo sapiens
tattggcgtatattcattatgctaagtgtctaggttttgatgttaaaagacctagagggtacttggttgctgttcttgaaattaaaatattctctcttaattacaccatctgtggaatagtagccaccttttgcattcttttccttctaatttctaagtctacttaatattgtagaaatactccgagcttgtagtccatttataattattttaaatagttggaagagataacattatctgcagagcatttatgtagaataatggatagtaccaaactttgttgtcagaaggctactttattaaagttatcagaaacattgcagtttttaggtctttatcttgtggtattcgtttactacttatttaaatcattaaagatttgaacacagtgttctagaaagtgctgtggtataaaactcatgattgtagaatggaaaaataaagcagataaagtatttgattcacgtttcaggcaattgcttgtcagcatcattaatttttgttgtatttgtacatataggtgcttgtgaatgacttcttcttggtggcttgtcttgaggatttcattgaaaatgcccgtctcttcatatttgagactttctgtcgcatccaccagtgtatcagcattaagtaagaacaccgtgatttgatttggattttctactttaaaattcctggaaatttccatttattgtgaatttacacttaatagaattccagttaattggatttttatttatttttgctttcagaagaacaatgaaacaatttgataaaattatttaaaaacctaacttttgctacaggctcagatagttttagcttgagtggcataatttttcaaaatactaagttgaaggcaatatatgattatcagttaccttattgaagagtaaatactcttgtacctttacgtaaggagaaaagtgtagtaaacatttctaaaatggttttcaacaacagtacaaaggagatacccattaaattggaaattctgttgaaagaccactacatttggtaatcctttccatttagtttgtatgattta

SEQ ID NO: 131074 - DNA, 1001 bp, Homo sapiens
gctgattttctcattagtatgagtgctttgcacataggttttcacacatttttttctaatgggtgaatgaaagtcatcgcttagtagccttttggaacagactgacagcatgtcaatgaaccttgcaaaatcctgttactcaaaaataataataggataattagcctcttgattgagtcttccatctcaccccatattaaagaaatagtggctagcattctcctcatttggattcctgaaactggattctgtttttaaatttccttggaggagattttcttataatactcattcttaagtgtttgcagtcttaggctagtgaaatagtacaatctaatgacctgctcgagagttttctttatctcaccctgggtaagttattaaataacttttatattttttcttagatatcttaatgcaattcagacaatgtgtccacacattcttcgctatttgactacagcagtcataacaaacaaggatgttcgaaaacgtcggcaggttctaaaagatctagttaaagttattcaacaggtaaaactaaaatatatattgatttttttttttaaatacctaagctttaggtctaacctctttttctaaggtaagacttagttcttaaggtacaaacgtttttaaaaataggtggaaggaatacttgaagtttagaaaagagaagaccctcaaatgggcttttgttttccttaagtccaagatacacaagttggatgtggtaggaatgattattactgtctgctagatgaacacttaatatatacattatgtgtatgtgtttctcttattgcaaagagtgaagaaaatctggaacctggaggtgggggtcattacctgtgtaattctacatgggtgaactttatatacaataccgtttcaatagaccccaagttgggcaaaaggtttcaggcagccatgctgattgatatttagtgagcttgtcagcaaaacccgtagattagaaatataacttaaatatttattta

SEQ ID NO: 131075 - DNA, 1126 bp, Homo sapiens
tttataaattagagcgtcttcagtagacattattgaatctgtctctaagaacagggtaataatttggaatgtcgagggatcatgtagagagaaggcatagggggtcggacattgatcataatgacctccgtgcatgccttagaaggggctcatttttaattacagttttgaagttagtgatgtttgtcctcctgcctctttcttatatattaatattttttatgtatatatttttaaatcctttagtctgtgagttctccacttcagtctcttcagcagagaacatggctcattcactggtctctgtttgttttcttcaatcaccccaaaggtcgcgataatattattgacctcttcctttatcagccacagtaagttatttcactgtgtaattttggctttgtttagataaaattacatggagttgtttaaacttaaaatatacttttttctatcatttgaatttgttgtcacctgtttttttttttcttcatgtagtagatttgcttgttactgaaaagtatgcatgtgactcttaagtaaactatttgacagagtgtaccctaagccttttaaagtgctatttaaagtgtggtccctgggccagcagcatagaaatcatatagaatctcaggactcaccctagaactaaattagaatctgcattttaataagatcccaggtaactcatgtaaacatcaaagctttagaaatgaggctctagggcatactacttgaaaggaatacgtgcatctttttatatcatctttgctctgtcaactagcttttgtttaatattttggtgatgagaaattcactgcttatgaactagaccattcttttgtaagctagaaattatttgtaaaatttactcttccagtggaactcaaatacctctgaaacttctgcccattatttcttgtttgtttggaatgacagaaaacaagactgcttcatggaaactctttagatgttttaagataattttttactcctctctgcttccttcaggctaaatatctctagttttattaagtaacacagtttttcagaccctttagtattttgattgcctttttagataatttctattcatattcttacaatctagatgttcataattgaa

SEQ ID NO: 131076 - DNA, 1050 bp, Homo sapiens
aatttggggcaagttacactctatatgtattagttcccattttgaaatggggataaaaaaatatagggtttttgttaggattacaggagaacactaacttgtattgctcagtacataatcctttgataactattaattgttaatcagtgggcctgcttttttcctgtctccctctctccgtactgacttccatttgtgtcataatttggaaatattttttggttctgtacataatttctcattacattgtaaatgagactcacgtgtcttgattttccacatcttcatcctagtgattttagtgacaaattacatgtaaatctaacttggtttctgaagttttaggtgcctgaaatttgattagttatgtataaattatctgaagtgggttatagtaagatgatgctgctgtttcctagttataaaagttattttttattttcttatctagactgattattgaagacctgagtatttttagcaaaggttttttgaaacaaaccagtgtgatccaataaggacttagataattacagttttttgtagaaagctataggtcttttagtaggctagagggatacatgggtataaaacatacattatgttcatttttcaagagtattcacaatataattaattatgatttcttaaacaggttccagcaacagatagaaatgctttaagttcactctggggaaagctggcctctgaaatcttaatgcagaattgggatgcagccatggaagaccttacacggttaaaagagaccatagataataatgtgagttcgactttttcacagttattctctgaaatatctgtgtatccttcacactttctgatgaggaaaatcactatgcattttgggaattaaaaaaaaaaattcatattagcttttgttgaccttacaaaaatcatagtggattagtggcttgactagtttgaatctccttgaatgaaattgtcagacttcttttggctcttagagaaaaaacgtagccttcatttctgttttacagctactgtgccctttttttctatgccagtcaa

SEQ ID NO: 131077 - DNA, 1472 bp, Homo sapiens
caaatcttgtgctggaactcaaatgatattttgattaagtgattgaatactgtgatacaaacactaagttaatatgttttacatcaagaacagtcaacatagagttactggaaattctaaaaagttacattcaattcgttttaaaatttttgtcctgtctgagccacaaaacatttgtgttaggcgagagtttgttgcttcctgttggcatattggcaggctaacagtgccaagcttaaaagaatagatatctttttcttttgatttagatagccactaccacaagatctgtgtatttgtttgaagttttgttaatagcaaatctaaaaatcttgtttggatttgggatgagaaatgtcagtgttttactttttagttaattaattttattttttgcagtggcctttttttatttctaaatacttttctggtggttgattattcttttaaatctgtggttagggaaacataagctatgaaagagctattgtaactatgatctgagattagaatttgactctccaaatgacctattgtaggtcagtgttgtataaattaaagctgtgtgaccctagaatctgcccttaaaaaaaaaaagaaaagactcgtggattttagaatacattgagaattgttcaggtacactctgtttggtgtgaaacttctttgatttatactccaagaaatgtgttaattgaaataaaatgacgaagctggtttggtgggaatttttgaacacttttgctttaacagttattagcactattgattattttgttaaaattttccctcattgtggcctttgatctggctccataatataccccattcccttattcagcagctctttgaaataaaagtgattttagttcctaggactatttgttatacttttggagctgtctctttccctccctcaggatgtaaaatgtatttcctgtttgtatataccacttcatttaaaaatatttttccttgaggctcaagacagtatgagtaatgataatttttagaggcattaggatcttgattgaaattctggctctgttgtatcctgttgtgatgtcactgtaagaattgtgcatttaatattgatcttcaagcatagttttgcatattttaacatctgaaatcagaaagtgtctttactgggtttttggttttagaaacataaaataataatgtatgttaaaattgatggcatttttgactcgatgatatatttttatattcagatatcctttataagaattaaacattttatcctttgtaattagaacaattattttatggattttgataaaccagtttttaaattttcaatgaattttgaaacatttgtgtacttgtgtggctacattaagtcaagataaagaacatttctgtcacctcagaaagaccctttttgttcttttgtggccatactccacccatggtcctgggcatccattgacctgctttctgtccctgta

SEQ ID NO: 131078 - DNA, 1077 bp, Homo sapiens
gcacgaaccctattgtgaactgctcatgcaagggatctaggttgcacgctccttatgcgaatccagctagtgccttgatgatctgaggtggaacagttcatcctgaaaccacctccccgaccccagcccccattagtttacttctttaaataactccagaggtcagttctataaaagtctcccaaaagctgccaccaaaaataaataccataatcagagatacatttgactcataaaatatacattagaagttggtgacttaaacattcatagttttgacctcaaagacttatgaattacaatggggttttaaaactctaaattaaagagaacttaatcttttttttttctttttagtttaggcaggaatatttagatacactctacagatatgcaaaattccagtacgaatgtgggaattactcaggagcagcagaatatctttatttttttagagtgctggtaagtataagtacatgttttttttttttttttttttgtcttttgtaggattcccttggttcttcaaaacatgtatatagatagatttgggtctgttcattaagttttcaacagtcattggcaaaagagaaaaaagtaaagaaaaccctcccactcaaaaacagaaactagaaaccttgtttcagggcctcaaaatttggagggtgatttaacttgtccttgaaatccaaaagtaggaacaattttatgatttttagcattaacagaatcgtatcatgtaatggatttattattataatattatacagcacagtgagtggcacattgtaggtgcttaattaatattgttgagtaaatccattattcctgatttaatactttatcatatatatatatactccttgaacttggctctaaacaactgtggaatcctaacggtatgtgaaatattttatgccttagtagtaacttttttccagttacctctgccttcagctattggaatataaatatcaatggtttcttcattacgtggggtatagatgagtttaaatggtactattaaccatgaagtatcctattaccgtatatttgacaggcttctagatttagtgc

SEQ ID NO: 131079 - DNA, 1259 bp, Homo sapiens
ttgaactcctgacctcaggagatccacctgcctcggcctcccaaagtgctgggattacaggtatcagtcactgcggccggccaggcatgatttattaatcttgtaaatttgtcaaatcgtccttttgaaaaatattaacagattggaggaggggacatttatatataggattagtttcttctagtttgtacatggtacatttatttcagtctctataattagactatattatctattagaaatttgaccacatagagcaaaaaccattctcagtagattaccactaagtagactactgaccttactagaaatagtcagaatcttctggttttattgtctgacaaactgttaaaggccttaccttagttgtggtgaaacacactaattttcagttagggctaaagaaatctgaaagtcaattttaaagtttgtagctctccttgtatacttcttatattcaaaacatgtaatgtcctgcttattttattctggaagtcttttaacatttaagtatttatttaaggtgactttgcgtaggtaataacttagaagttggatatgcttattttgttttctgtggcctttaaaataatgtaatttttgttttttattatttagggatggtaggatgctctttgactacctggcggacaagcatggtgtaagtgttttaaaaatattttaaagttgtcatgttttaataatgctgactaaagactggtttgtacagatgagcttatggcttggcctaagaatataatttccagattaatttattaattataaaatctggttatatttttaaaacttcagtgtttataaattgttgctgacaggaaaatatgtgcttatagctcacctttagatgacagaaattctcaaagcttgtatttattccagagttgtaatagttggcagtaattgttggcattttatattagtgccaatagcaagctaagtattatatattatagggcataggatgccttttcttatggattaacgagtaaggcaaacagaattaaatttgaattagaaatgctttgagcagtagaattaggtagtactttggctgccttgtggaacacaatagcctttgaaattatcaaggtctttataagtccccagattcacaaataaagaaacatcgtaagctttcctaaccgtcactcaatcttatttcccttgtgttaactcaaagcatgaggctttgcatataattaattatttaaggagtccccaactcccaggtcatggac

SEQ ID NO: 131080 - DNA, 1119 bp, Homo sapiens
ggtcttggaactaatgctctggggataccaagggatgactatatgcgggaaaacacacagagatatatacacacatcatgcgcatagacagagctatatattatactaaactacttttatgcttttagaagaagtaattttagatcttcaggtcacatgtaggtgattacaaagggacagcggaaataatccagatgttagactacaacagaaaatttaggatgctgtagtttagtcactcaaagactgggaagtaatgggatcagagcatgaataagatgaatgtacatgtgttcaccagttagaaaaagaggatccttgtagcttaataggtactgagtttgagataaatgaaaggatcatgtgttaaaaacttgtaatcttatacttacagactacctattttcaatgtaaaaacctttttctgacaattcaccctttttaaatttcattgaatatatagtatcgtacttacactttcccggaaataatcagccagaggacagtgattatatacgtgagtggtatgagtagtgcaatacaaagttattcagtgtgatccactgcaaatgttcagtttttgttgaagttcttctatgttggaatttcatgtacatttcataatcagtattgtaatacacctatattaatttttatggggacatatctctgctccattaaatcttcaagcaaaattgtgttcccaaagacacattatagcatatttcttctcatgagaaggataagaaaatgtttttgttttggaaaatgcagtcaggtgcagtagctcatgcctgtaatcccagcactttgggaggccaaggtgggtggatcacttgaggtcaggagtatgagaccagcccggccagcgtggtgaaacctcatctctactaaaaatacaaaaattagctgggcatggtggtgcacgcttgtaatcccagctacttgggaggctgaggcaggaggattgcatgaacccgggaggcggaggtggcagtgagccgagattacaccagtgaactccatccggagtgacagagtgagactccgtctcaaaaaacagtaacaacaaaaatgctcataaggtgggcaactatacacatatatcccctgtccctt

SEQ ID NO: 131081 - DNA, 1022 bp, Homo sapiens
tccttaacattgtagtgctcttctgcatttttaattagctttgagagagaaaagaaccacagtggttgcacaactgaaacagcttcaggcagaaacagaaccaattgtgaagatgtttgaagatccagaaactacaaggcaaatgcagtcaaccaggtaaactcgtcttaattttgaattctaaaaattctcctttctggattaatacaaatgttaattcaaactttatccagtatcccatagtaaaagttcatggtttaaatgagtgctttattcatttttaatttttgtttatccttattttgtaggggccagtataattaataaatgttaatattaacactaagtttttttcctaaaaaaaacttctttagtacttatctatactgattatactacagaaattccatctcctgtttcccccttcctggggacatttggcaatgtctggaaatactttttggttgtcataactggaggggtgctatagggacctagtgagtagaggccagttatgctgttaaacatcctacagtgcataggacaagcactgctgccgctactccccaacaaagaattatccgactgaaaatgtccattaagaaaccctgttccactgtgtggtggctcacacctgtaatctcagcacttggggaggtggaggcaagtgaatccgttgagcctaggagtttgagaccagcctgggcaacatggcgaaaccctctatcttaccaaaaaattaaaaccaataaaaagttagccaggtgtggtggtgtgcgcttgtagtctcagcttacttgctacttgggaggctgaggtcagaggatggcttgagcccgggaggcggaggttgcaatgagtcagtgtcataataccactgcattccaaagtaggtgacataatgagacaccatctcaggaaaaaataaaaaagaaaccctgtgcttgggcaatacctagaaccttagaacacatgggtatctcgttataagagaaacctgagctcactttatccctggctac

SEQ ID NO: 131082 - DNA, 1023 bp, Homo sapiens
ttaccaccatgtactgctttgtatgacatctttcactcagcattgtttgtgagtcatcatgtttttaggatagcagtagtagttcattgatttttcagtgccgaatgttaatctattatgagtatgctgtggtttgttttctcattttaacattgatagacttggctattacaaatagtgctcctgtgtacatttttggaagtgcactttgactatatgcacccatttgttttggatgcctcgaaacaattgctggatcaaaaagtatgtttggctttgggagataaaaatcttacaaagtagttgtattcctgccagaagagaataggttccagttagtctacatccacaccaacactggtattgtcaggattttttaggtttttattgtaatttttagtatgcatttccttatgattaatgacgttgagaaccttttcatgtgtctgttggccatttggttgtcttcttttgcgaagtgcctatcttttagccatttcaattgcaaggtctgtcttgtcttactcatttataggagttctgcatgtaatttggaaggttcgattttgctctcatggctaaataccctttgaccaccttcatctttattttttgtgggcagtgaaatattgtggcattttcttggatttttctttccttgcaaaattaagttcagtacagaaatcttttcttttgctgaagcatttctgtccgtgaatattttgtagaatctttacatattactcagtacacttcatgttgttgtgagtttgtgtatatgtatctatttgctccctgtactataggttaaattatgcttttttggatcctttgcaaagcaaaagcctgatctgacatggttgacttaaaaacttggtgcaggttgtttcagcaatgtggatggagaagcatataggagtttattactgattacctggatgtggagaagtgacagctatatgtgctttacaggaaagatggcgtgggttttatttatacacagccttgcctagaaagggtaag

SEQ ID NO: 131083 - DNA, 2077 bp, Homo sapiens
aaatgtgtaattctggaacttcattttaaagcatatgtcagtcctaaaagttttattggacttgaaagttttggctaaaagaaaattgacattagttataccgtgagtttattgggaaattgatgcattttaataatgcaaagtaatttgcagtgatgaaggaattcgaattttttcagaaaaataagtgagttctgtttctggaagcagactacaatataagtctacttagggaactctagatttggggagtggattttgtgtagcaaaagacaaaaagcaataaaacaaaaacgtcccaaaaaccagcgtccaggtgttgtggctcgttagacaggtataatcctcatattcatatgcaccttttctaaacatagacaactctaaagttgttgacgttaggtaacggctaagatcattttcagtaaatgtccaagaatgtcttgtcatgtaaaactttctcttgatatatttttgctttgattcttctttttacacctgtattttagaccttgagtaaaacattcgcatctgcattgttttcttttctggaaaagtgaggacaaaagatctagtaaaaatgctatattttgaaagcctttaccagctgcttgtagaagtacttctgaactagctgaactttatatatttttgtgttctttataatttcattttttttatggcacacagaaggaaaggaggaatatgtaaatgtgaattagattttcatagggctagacgaaaactatgaactgcaggcagttgagaatcagtgggaaaaactgcccaatacccacctctttggagaaaatgttggtaagatagctgtaatacaccaagaggaagacagatgctggagtatttaattagcaatttctaagtacatttgactcttggacagtacaggggttaggaacgctgagctctcgcagtcaaaaatccgttataagttttgactcccccaaaacttaatatatcctaatgctgacaggaaggcttactgagaacatggacagtcctgtgttgtatgtgttctatactgtattattacaataaagtaagctagagaaaataaaatggtcttaaattataaggaagagaaaatacatttactttttagtaagtggaagtacatcatcatgaaggtcttcattgtcttcatattgagtaggctgaggaggaggagtaaaaggaggggttggtcttgctgtttcaggggtagcagaggtggaagaagtagaggaagtggatgggaagtcaggaaaggcaggcacacttggtgtaacttttattgaaaaaaagttgtgtatacgtggacctgtgtggttcaaacccttgtcgtccaagggttaattgtatagggccatataactgagaaatccaagataaaacccagacatctcaccactaaacaacttacctatcctttagagttgaatgtttttgatataaggtaaaaataaatgtcgaagaggtaggtactggtagagtgctatcaaaattgagattttgttatcttcagtgagcaaagaggactttgaggaggtgaggctttgagtcttgaaggcaaaatggttagaatagagtcagtgatcctgctatgtgaggatacagcagccccccccccccacacccccttagcagtttcaatttctgcagttccagttactcatggtccaaaaatattaaatggaaaattccagaaattagcaattcgtaagttttaaattgttcgcccttctgggtagtaggatgaaatctgtctcgctctcttgcttaaaactgggacatgaatcatccttttgtccaatgtatccacactgtatatgctaacttaattgttctattttgttattgttcatctcttgttcccagtttataaattaaactttatcataggtatgcatgtataggaaaaaaacagtaaatataggattggggctatctgcagtttcaggcagcagccgctggggggtcttggaacatttagctcatggataaggggagactattacattgcaccaagagaaaaacagtttcatatatttgtagtacattggagaatataagcttcatg

SEQ ID NO: 131084 - DNA, 1029 bp, Homo sapiens
attgttgaaacattagaaaagaattattggacaggacaaaagaatgactaagcattaaaaaaaaaatgataaactgaacttcatcagaactaaaaacttcacaaggcaccatttagaaaataaaatattcaagcaagagaatagggagaaatattcacagcacatatatctgacaaagcttttatccagaatatataaagacctcctacaaatcagcagtaaaaaaggtaaaataacgcaattttttaaatgggtaaagactaaagaagatacttcaaaaagaagttatttgaatatctaagcaaacatgacaaggttttcaacctcattagtcatcaaaaaatgtaaattaaagccatattgagacagtattccacacactctagaatgtctgaattaaaaaaaaaaaaattaacaccaccatgattaacaggctccatgcctgccagctgataagatttggttacctttccatggcttcaaatctcatgcctgttaatcgcttgactctgtgactgccagggaactgtcttctcagctcttgaagacaaaactgaaaaaataagggttgagtagtaattacattatttatactaaatgggctacaatggatggcctatatagtcttcaatgtgtcttcttgaataatttcattagtgtcatctaataacatgaagtgaaattaatcagtaacaaataatggattgaaagaagcactatgacattacagtgaaggcaacaatcagttctcagaaactgatcatgctcttaaccaggaaaatgaacagattatgagaaccactaataactctttaagtactaatatcatattattcctccttaaaaactacttctataatgtgtcaggcccctacttaaatgacaacagcgcctggcgttttcttcctaattacagcataagcattctcctggtaagaactaagttttttagtagtcatctcaagttcctagcaaataacataaacactgattaattttgccctgttgaaattttatattaatcagcca

SEQ ID NO: 131085 - DNA, 1038 bp, Homo sapiens
aagagtagagatactgtttctgttcctatatccttaggaagcactgtgctagacattgaaggagaaaacatagccataaaagacctagaactaataaagtctataagtagacttcactaatatgcaacagctaaagttactccacagaagacatcgccgtttctttttccaaagcaacttagtatctcaaaggcgggaaagtctagttttattctcatttactgttgctccctgcattgttgaaaagtgatcacgtgaccttttatttgtcttatgcctctgtgtttctggatatccagtatagaaatgaagttgttcattgaagctttaagcagctgtacttcctattcacatgcattcattattctttcagagaacatttgttatgcttgcagtgtgcatggtagtgagaacaaacacaaggatgaattagccttttctgtgcttctagtgaggtagcatgatgtgatgaacatgctgtagactttgaaactgatttattaaattctctttctttgatgacttgctgcatgggttttgagtctggaaggccttaaaggatgagtgtgacttaaatgatacaaagacattgtatcccaagtgaatgcatgaataagcctttattaaagtacaagcattattaaagtacaaggcctgcttaggaaagaaggaataaggtaattagaatggaagtttcaaaattttttatttgaaagaatggtggaatggcataccttcttcccatcttttttaaagttctgaaatactctattgagaaagtcatacacatgttaaaaattgtggacaatataaaatgatatggtaaaaaaaaaataagtctgttcctctatccctgagctcaggtcctccttctcttagggaagcactttttttttattttgagatggagtcttgctctgtcgccaggctgtggctcactgcaacctccgcctcccgggttcaagtgattctcctgcctcagcctcccgggtagctgggactacaggcacgtgccaccatgcccagctaatttttgta

SEQ ID NO: 131086 - DNA, 1028 bp, Homo sapiens
ttgaataatggagtaaattgtttgtggttcgtggtattcttttagtagcgtgtttttcactatcatacatgggttcttcagaactattgttgcatttcttaatgcctccagattgtttattcagaacatcgattaaggctgcagacaaattatatgaattgatattggctaaaaatcttctaaactttgtgaggtcaaaaaatgtaattattagcatttattaagggatgatataatttgtttattgagctgtgattttgttaatttttaaaaaacatttaagtgaagcatgttcagttaaaagaacaacttatatggtcatccagatttctactttacaactgagaaaaagctgcagctttctacagaacagagtataaatatgaggaaaatggtgaaagggagtgatagaattgaagaaaatgatgatgatgtgataatgaagaaaggaaatgtttatcagatatttactatggaccatcactgagctaaacactttacatatattatcccattaattgtcatcataatcctttcagatattgtctttattctataggcatacaaggtcatagagaagttaagtgacttgcccaagatcttacagttagtaagaaattctggataggtactttgatttcagaaattaaggctctttatcatgaggaaagaagcaatggtagtaaatgggattgagagtaggtagttaatacacgtgacaaccagctgttacccctacagaaattttattatttaaatttagtcagttaacgagactgtacttgctgctgttgaagagtatgtgaagactaataacttgtttttatttttaaaaatctaagtataatttttattttatagaatattatgctaaggaagctatgatagaattttttttttttttttttttttttttttgagacaggatctcgctctgttgcccaggctggattgcagtgaggcaattatagctcactgtaacctctgactcctgggctcaagcgatctcccacctcagcttcctgatt

SEQ ID NO: 131087 - DNA, 1672 bp, Homo sapiens
taataagtttagcttggcctcagttatagtatggtttattgtttatccttctgtatttgaagcaaacataaatagagaggacgtaaatttaataatttatacagtatgctccagtccctgactgtttacttcagccagtactgctttctcctaggcctttgctcatgtgttcttcccactatgcagtttccataaataacttcctgttttgttttttaatgtctacttactctttgtttcagtacacgtatcatatgtgggaccgtctttgctttctgtctttccagttcgtccactctgacacagcatgtgtcagaatctcttccttattttcataacaccctagatatccctgtcattgctcttactgcattaacttttttatttgatacgtttttgtcatgagaatgagcttctgcaaggaattatcatttcttttttatctttatattttcattgtgtagcacaatattggcaaacagtagaagtctggtacatatttgatgaatgcacaataaatggcattgatttttatgtttatcattttaaaaactttagaatacagcttctaattgttttgcttatcatacaatatttatttcaggactgtattattcttgtgaaagactcataggtagattttctcttaaaattgtgaaaaagttgtcagaagacatatttatataatgatattcaaaggccatgccatggtgagattttttttcccctaatctccactgttcctccccctcttaggatacagatcttatgaatgagacagagtaaagggctttaagttggataaagattaagattccctgctggttaataattatcagaatctggatgattatttatttggatgaaacgatgcatacattgtgtgcatcaaaagtaaagcatatgtgattgttagaggaatgtttgaattccccagtgggatgtcatggggtatgtttataaactcccactaagcagtagttctacaatggaatttctctggcattgagataataatttgcacagtcaaattaccttctttacaaaaccccaaggaatcataagggcctaatcctttattaatgtcaacccacaggctgcaagaaagcgtaagattgccattcgaaaagcccaggggaaaaatgtggaggccattcgggagctgaatgagtatctggaacagtgagtattttacaagaggattgtgttttgttattctgataaatcttttttaattaaaatggaatttgcatttgattttcctgtttgttttcatgctgttcatttacagaatatctacacacttacttttttttcttttcctctcaccagatttgttggagaccaagaagcctggcatgaacttgcagaactttacatcaatgaacatgagtaagttattaaacacacaacattttgttgagtgcagttttcatcactgtaagttcagaaagcactgtggtttccaaaggattggtgagagggtgtgaatcatgtcatttgaaatgagaaacagaacaaatcaacaattaaatgaaaaagaacaaatcagtaattcactggtcataataagtgaatagctttaactaggtcatttgtgttttgccaaattgtttatgtttaggaaataagtttttctttcaaatatagatggcattctttggaaataaaa

SEQ ID NO: 131088 - DNA, 1030 bp, Homo sapiens
tattttgaataaactatactgaatattgctgtacaggtcttttggtggaatatatgtgcagttctgtatacctttgagtgaaaatatgggtcatagaatgtatgtatatttaactttagtagttaaaggcaattttccaaattagtttactcccaccagcggtaagagttctaatagccccacatcttcaccaacacatggttctgtcagtctttgtaattacagccattctggtacatgtgtagagtggtacttcatggttttattttgcatgtccctgatgatcagttgccatttggatgtcctctttcgtgaaatgtttttctcattggtttgcatgacttatttctttagttttttgcttatgagcccttttttagttatatgtataagcaaatatgtataacttcttacttttttgctcatatgatcttgatgaatagaagttctgaaatgaaatgtgttcgaatgcctcagtcatttgtttgtgttttttgtgttctgtttaagaaatcttttgctactcacggtcataaagaattctgtgtgtcttcagaatttctattcttttacttttcgtatttaatccacaacccatttggaattgatttatttttaatttttaatttttatttttttaagacagaatctggttggttctgttgcccaggctggagtgcagtggcatgatcatggctcactacaccctcaaccacccaggttgagttatcctcctgcctcagcctcccaactagctggtactgtagacgcatgtcaccgtgctcggctaacttttaaattttttgtagagatgaggtccagctgtattgcacaggctggtctcaaactcctggcctcaagtaatcctcctgtctcagcctcccaatggagtgctaggattataggtgtgagccaccgcatctggcctggaattgatttttatgtatgatgtgaaatagggggtccattgctccccatatggatatccagtgtttctgtccatctttgtgttccatcatgagtcccgtcc

SEQ ID NO: 131089 - DNA, 2413 bp, Homo sapiens
acttgaaaacactagatgttgctaataccaagtattttaatcatatttaaccagggagaaaatgggtaacatatatatatataaaatatatacataatatataattaatatatatacatatatataatatatataggtaacatatatatataaaatatatacataatatataattaatatatatacatatatataatatatatatgtatatatatatacacacacacacacatacacacacaataaactttctcccatctccatcaaggaacacttacttatctagtaaatcttttgttttaaatcagactgataaatgatgggaattgtcagtccagttaacaaactcattttgaaatcagcatgtggtattcaacagtgtttccctccagcggttatgtgtatgatattgaatttaatatgccatgaatttgcttttaaatacacaaatatagggtatattttgtgtatatattgatgtatttattttgttttcatagtaaaatccaatcccaattagttttataatgtaaataaattacaattaataaagtagaaatgcatattttaaaacatgtttacattgttttaatgtgtagcataggtttttacttgacagctctttgcagaaccatatcatttagttaactaataaatctggaaacttaaaaaaaattatgagctactttaaataattttagagagtacttgcaactttaaaatgtttagtgaaataacttgtatttgtattgtacctttgtttgaaattgtaaaaatctgtttagacatcagacaagtggaagtggttcacactgctacactacataaatataagctaaattgcattttaaaattatactttttatttcattattttggtctgaataagatagtttcaaatacatgattttatgggttattatattatgtaaacacttaaactggccaagtgtgcagtgaactctctgtacacttcagctgaaggtaagaccttaaaggaaaatgtccttaatactcaaattttattcttattgaaaaagcaaagaatatatttgatttcctactagtgataaaatagtcaatgttaagtttcattaacagtgtgaagattgtcatttttaacctgccactgaaattgagcctaattgagctttttttttttttttttaattagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaacttgcatatgaagattctaacttcattttgttatactcacagtggatatattgtttaagaactcagtttctagttaactccttactggtgatagcaaagtcacagcatatgtagctgaccgaagcagattattttgactttgtttatattgtcgaattggattttgctgtacattccagtgggctatttgaattgttttatctgctgtaatatccttctgatgaatcttgcttaaaatatgtcattctccaaagttcagcaatatttctttgtaaaatttttgttttgatataggacataattgagatttttacatataaaatgccttaagataaatatgtgttacgacactttaacttttatgcaagttatatttattgaatcctttaatagtaaattacatgaaagaatattaaagaatcataaagagtagggattaaaggggttgtagttatttttaattttgaaaaaaataagaaaattaaaactatccttagaaacaaaaatgttaaaattttcctattctatcattaccttagttagaattttttatttttctcttttcataataaacaaccattatgctaccttcaacagtatttgacatgtttcaacaaaatagaagagacttgaaagttaaatttcatttagacacaaatcagtttttaaaatagcaactgttcaccgcaaatatttatggtatttgtttataataaatatatttaaatttatttttactaaaaatatacagaggcatctacagacttgtcattgctgctttggacaagtggggattgtggaggaattgacaatctagaagtgtttagaaagaaaagta

SEQ ID NO: 131090 - DNA, 1038 bp, Homo sapiens
agtagcttcttgttacttgcatcattatattccaagaacaccaaatgcaactgcagttgtgtgccatacttactctagatataactgactacatttgtagtataataaaattttataataatattaaaacccaaaagttaaaaagagtattatgctttgtcagtttacatggcattttttcaagtggaattttaatatgggaaattaaactatgtagaatgatgttttttgttttctttttagttaaagaaaaactatcatcacctataccattgtgtaagttttattagaacaagtgaaaatctaaatgaactagtttaaaaattgtttcccttcaaattttatgagagaaatagaataaaaagtgaactcataagtatctggtatttcttcttaaaaattttttcagtatacgttttagatttcgttttactacacacttagctcaagcttgtcttctaaattaatctgcatctactacattgacctataatgcttgatgatgttcataaagattatcttcagtcatcctaagagtgcctttttaatattaaggacatagaagcaccctcttagtattggttctaaatatgaggaatgaactctcaaatgctcatatattaaattatattctccataatttgtagatttgcagattatgttcattgtaatttgtgtatttctttttatctgttgaataatggcagtctcagaggcaaagtttagttaaatatctactaacttaatgtaaagcattgtatatactctaactatggtacacaattatattccctggtttctggaagcttataaaatgaatataccagtggtcctggtatgtacaaaacagaaggctgcatggagacaaaaatctgatgcttagatcttgccttcaaggagcttgtaatttagtttgtagataatgcataagaatgaaaattatttccatataatcagactatggctttccagtaggtcagtataaaagtgattttttttttttttttgagatggggtcttaccttttttttttttttt

SEQ ID NO: 131091 - DNA, 1026 bp, Homo sapiens
attgtaatacagtagaaaatttggaaattggaaaggaccagtgaatgtttccttttgagtcaagaatacattttaaaatgactagtagttctagataaatcaggttttccaacttattcataatgtggaagaatagagtatattttcatagatcctgcaacagcagctttggtaagggaagtatgcaactaaaaccaatttcaaattttgtttctgatttccagaatggttttctgtcataactctggaaaaccagcgccatgaatttttaaaattatcattaggcagctctggcataatttatgttaagaggttttggcctgtttatgtaccctggaatttgccaaaattagtaatgtgatattccatatttcacaaacctatagagcaatataaataaggacacatgcctattggggagcactgtttgtttaaattcttgttttgtggcattcatgaaatgcaggggacttccaattcaaattctacaatattaggcagcaagttgtactgtgaaccaaaccagatggtgatcagctctattcctattatcaattcagtgcagcgatggttaccagatcttacttgtgacgttaacatttggaacagattagcagcagttagcctgaaataagaaacctccattttgctaaaaggttcagaacatatcatgttgtaaaatcagaaagactggtaagaaaacttatggaggaaagagttcactgtctaccttggttttcccctgcaggacgtgttatttcccttttatgagtgtctattcaatggaaatttaatgtggggtattgagaggattagggcctattagtctatcaccctcctgaggtgctctgtccctcagcttgtcgaatttatttcactgtagccacgatcagtctaggccttgggacaagagggattgtctgcattttcggaggtttcctttgcaagaagtttatgcacacacatacatacacacagcccttacaagttcagagtttcatccaggctctgaaattcatgaaacat

SEQ ID NO: 131092 - DNA, 1026 bp, Homo sapiens
tctactttgtgaaaaagaactaagcactaatcaataataaggcttacatctaattctcaaaggtgcttatccattttcttgctaaattatccttcttgtaatttggctaaacactaaaacatggaatttttagtttgaatattttgaagtttgaggatgttgggctttccttattgtaaaaaatgttatgtttgaaattattcctgttttcaaaaatggtaattaagtcattaggataaactttctaataaaaaaaaattatgtaaatcattgtaagaccaatgtgaatttaaaccacagtgttggtgccagatattagccagggtcacaggctcttttttaaaatgaagtcaaattagttactgatataagttttatattttgtgattttgccatcatactggttatctgtgctcttgaagtctgctggttctcacaccagcagcaagaggcaaggcatgagacattttaaatatatttccagacatctaaacatctagacaggcctgagtcatgattggctctggtgtgcttccaggtaacatcttgttattgctgtttggggaaaaccaccaatagaattgcagctagacttttggggactgtgcctcgcaggctgtatcacttgctgtaggccaagcaacgagcacttccctcatggtagcaacagtccttaagcccaaagccaaaaaaaaataaaatggaaagagagattcaatacactgatttaatggggactgtagtcatcgtcagaactcacctcccactcacagtggtctagatgtcattcagcaactgtgaactcttgcctcatgcagcacaaactcttctctaagagcagcatgatgagcaaggtgctcactttgcaagacacacactgggtgttcacagtgacagaccgcctcattatggtgacggttcagaaaagggatgggaaatgcagcctcagaaataccttacattttgcaactctgcctggaggtttttccaacctgtgctctaagagttgttgtaacttccatgatt

SEQ ID NO: 131093 - DNA, 1521 bp, Homo sapiens
gttgctaagcagcaagtagcaagcctagaaaccaatgatcctattttaggatttcaggcaacaaatgagagattatttgttcttactaccaaaaacctctttttaataaaagtaaatacagagaattaattattctaacatattggcctctttgtactggaaaagtattcagtggtacctggaggtctggacagttatactgtaacctcttaagttttaatgtgctaaatatatcttgtatgattttttattttttaataacattggaaatatattcaagagattatgattctgtaaagctgtggaatgaagctgcagatttagagaacattggcttctgaaaaaaaaaaagagtgaagatagtactagcaagtatacttattttttaaaacaggctagaatctcatgttttatatgaaagatgtacaattcagtgtttaaaaataaaaatatttattgtgtactctgttcgttgattagttgctacaggctgtacctataagatgtacaggataatagttaaatgttgagtattgtacatatgtatttaagtggattgaataactgagtctacatggaggaggaaatgctagagaacagcaggtctaatattttttaagtttactgagagacctttattattattttcaaattaagtatagctttatgtaacttttagccagttgctctgccacagacatagacaaagagagataagatttcacattatccatcactgcataacaaaccacaccaaaactcagtggtttaaaacaaggacttttattatttttcacgattcagtgagttggctgtctctgctgtacagggcctctcagcctccagtagactagacgaatcttctttccatagtagagaaaacatcttaagagagcaagctccaatatgcaagagcttatcgatcctgtacatctatcatatttactaatgttccattggacaaagcaaatcacatggccaagtctagagtcagaatgaggggactacacaagctgacagcggatggtatgactcattgggggccattgatggaacaatcttaccacacaaggacaaattataatttatccttgtggctctctttatttttctaacaacttcaacaaaataatcctgtttatatgttatagtttcttgccacaaattttgttttttcaaacttacctttccaggtttgttttagtatgtatgtacctggaaatttttattactttttataccatttcaagatatgtatcttatataaacctcaagttggattttatattttaataaggaagttaagaccttcatttaagaggcagaagattaagataagaaatataagatagaaaagctttgttcctaacatatcttttgcctgtctgggcaagtatttgactcaactaaattttaatgaacgaatgaatgacagagaggaggaaaaaagatgaggattgcatacatgttctaaaccctttgtcagattgcagtttcctagagagtattgaggtgctaggt

SEQ ID NO: 131094 - DNA, 1038 bp, Homo sapiens
tttataagtactgtgcatattttatattttctacatttgatgtgatttttgttggtattctgtttcgtattttcaactctgataataacatttctcataaagaagactatccttacaacatgtcttcatttagaaaaagtattgctgtagatgaaattcagtgagtttcaatttgatgattttgtattaaaatgcatttctttaggcatcaatattgcagtaacaattattgatgtgttacaataacaaatgttgacattattgacatattgacattgatactttaattaagcagtacgtttaagtaaatagttttaaacatctgagtgtgaattccagcattgtgatatttctctttagcctagaacaagttactcaaactctccaagcctgttctttcatcccttaaatgaagataataatagccttgcgagttgttaagattagtatttataacatgcctggttataaatgttatgagagtgtgctcataaattctggtagtgtcattgttcttggtaattattacaagttagcattagtaaacttcatgtgtgtattctatggcctaaaaatagtctgcttataaaattggtgctttatatcagcagtccccaacctttttggcaccagggaccagttttgtggaagacagtttttccatgggcctgtgggggcttggtggatggtttcaggatgaaactgttccacctcagatcatcaggtattagttagattctcataaggcagacagcctagatcccttgcatgtgcatttcacaatagtgttcaccctcctgtgagaatctaattccactgctgatctgacaggaggtggagctcaggcagtaatgctcccttgcctgctgctcatctcttgctgtgcggcccagttcctaaaaggccactgactggtaccagtctgcggctcagtgactggggacccctgctttatatcgtgttttaaactatttactaacaattaagaggtggtatatcacgtggtgattaagaacatagactctgggtccaaatttc

SEQ ID NO: 131095 - DNA, 1030 bp, Homo sapiens
aggataatctctccatcccaggaccttaaacttaaccacatctacaaagtcccttttgctatataaggtaacttattcacaggttccaagggatttagatgtggacatctttgggggacgttattcatcctgccacaggtggtatgtaaaaatattaataatctaatataatatgataaataatttgataggaataacatacatgatgctggagttctcagaattcaagcagctcatataaccacgagagtgggggaattctgagagcaactgatggttgaattgagtcttagaggataagtgggaatctatcaggtaaaaaaaatacaaggagtccaaacagaatgctatgtcaaaggtatggcaaagacaagctgtatgaaattgctagtttcacaattaacaacacttgacacagtcgccataatggaaatatgcgtaaggtaagtggctgctgaagtgaagaaacatctaagtcagagtgaggggctcataataaggcacctaccttcattcttatcctcttattttcatgattgatctcccttggtggtcacctttcacttcgtggttcaaggtcctctattcttttctcactgctgtctcttcaagtatggatggaccagagatcattcaattatattaatcctcataatattcaatacattctttaggcacttggctcatgaaagtagatgtattgttgtgaaaatattgtttcaacttgtattttattttagctgttgtttatttttcttctgtgaaagcccttggttaaaaaaaatagagtatcagagttggagtacagggaagagagctgaagcagtgttaggtctgtcaaacataataataaaaggccagttaggtagtggtgactttgaaaataaacctcatctagccactgatcatcgggagtaaggagagaaaagaaatagtctgtggtctctgtgtgctggccttctccccttattttgtagagagcaagcactggctctacgaaaaagccctatttccctggcattgctgggga

SEQ ID NO: 131096 - DNA, 1035 bp, Homo sapiens
ggtaacatattttatgttcttttgaactagggattcactctgtgtgtgtgtgtgtttgtttaaaggaaagaaggagtgaaagagggaggaagggagggagagagggaagaaatgaggataaaggattgctatcattagtattttatgagtgctttatctcctcaagcatcaggtaagtctggaagaggaaaatttcatgttaattgctgcaaatctttgagtgaaaattcctcaaagagatctgtgcatgtttgtttataattacgttttgtgagatgatcactagtaaatatactaaaattcttttagataggttttgtgtgtgtgtatgctttctctaattttttattacatgatgcatttttcttttcccaatagaacctctgtattactggcaacagactgaagatgatttgacagtaaccatacggcttccagaagacagtactaaggaggacattcaaatacagtttttgcctgatcacatcaacattgtactgaaggatcaccagtttttagaaggaaaactctattcatctattgatcatgaaagcagtacatggataattaaagagagtaataggtatttttttttaattttactttaatattctattatctttttttcttttctttttactctttccacagtggttacatcagagattaatacaatagttctgtctgtattgctggttacttttcttaagatatattaaaaatagaattactgtgtcaaagagcatatttctagttgaaattaaagatagtagcatagctatcacttggagaatatggtagtgctttgttttaccagctctggatacaataataatcataggtgaaaatggctattttaaattgcactttttcaaactttttaatagaaataatttttttaactttagtttgctggcttgataatatatttccattctttaaaattttaaatatacaaaaggatgtagagtgagaagtctgcctccaacacaagcctatgggtcacccatcctcccactcctcacaatcagtgtt

SEQ ID NO: 131097 - DNA, 1046 bp, Homo sapiens
aaaacttagtgacttgaaacaataaccacttaccatatcacacagtttctgtggtcagaaatcagggagtagttcaggtgggtggtctggctcatgattttttcatgagtttatagccaaaacgatagccagggctgcagtcatctgaagccttgactaggactaaaggatacattttcgaaatgattaactcatggaatgctgattgttggcaagagccatcatttcctccccatgtgggtctgtccatggggctaccttaagcatattcatagcatggtagctagccaccctcagaatgtgtgatccaagagagagagtgaagtagaagatgtaaagtcttttatgacctagttctagaagtcatatgccatctgtcacatctactgtatatttttgttaaaactgaatcagtaggacagctcacatcaaaggaagaggaattagactccaactcttaaaaaggagagaaaccaccacaccgcagatatttattttgtgtgtgtggatcagtgaagaggaagagattaatgtataatgtttggtctttttaggacactgccttaggaaaaccacgagaggtgtttcgacttcctacagatttgacagcatgtgacaaccgtctttgtgcatctatccatttctcatcttctacctgggttaccttgtcagatggaactggaagattgtatgtcattggaacaggtgaacgtggaaatagcgcttctgaaaaatgggaggtgagggtttgtttaagacttatgcgaagtccagaaagtatatgtaaattacaccctacttattttaaaatgacacttttcaaggatggtttacatgtgatctgttgtttgtttgatatataatgttttggatctctttttaactaaattataacatatatatttttcacaaactgttacattaaccactcctgttttgatctggagtcagtgcagttgtcaagaattgcattcatttttcagcagacatcttatatgcgtagagtacttcattaagcattggcgttgcctcctccttcttgaaga

SEQ ID NO: 131098 - DNA, 1030 bp, Homo sapiens
gtagaggcctgaagaaaaactgaatatagtagttacattcaaggttgatttggggggttggggatgggtatactagaaattgtattgagatctgaagtattaatttatttagaaaatcttcagaagtggtttcttctcaagcaaatgtggagtaggggaaagaaaaccaacttttggagtagggttttatcaggatttgagtcttggccctgtcattttctagcagtggagctccaggcaaattatttaatctttttgaacctctcttctaagtgtagttaataattttaacttcatagagtttggtgataaatacatgacatggcaaaaagtcaaagcacttatttaataaaattcttatacattatactgattcagtaagtattccgttcatcaatgaaattttaatccttctgcagtcagctgtgtaatgttgccttagaatgattttcagtgttagcccttgaacgtagttacattaactctttttgtgaggaaaaagaaaatgattatgtgagagctggacattatagatgtcagttagcatataaagtgttgttatgagggcatgtagtgaaattgtcaatagaggttattcagatataagtaaatgctatattttgggatttagagaaaaagatattttattgcttatagtccatttaaaattaaactgtactttgaaaattagatctaaacaatcagaaacatttagtttgctttcactttaactgtcattaatgcaagtaagagagccactatgtgtttccttttgtgttttaatttaattttgttttcacatttagatactcaagtatcttaatcattctattggatattgtacccatttatctgattgataattagacttctagcaacctccgtcatgtataaccaggtattttaaagaaaatggcttaaaatgctcataattgtgtataaaatgaagaatagtaatttaacaagtttatctctacgttcttcccagtaatggtttattagattaaatgcagtgtggggccatgtagta

SEQ ID NO: 131099 - DNA, 1063 bp, Homo sapiens
gagggcttacatttatacttaatttaatctagttcccaatattcttgggctaatattaccatcttgctcttctcattatgccctgtttgttctttgttccttggtgtctttgttcctacttttttgcaggaggaattaatcacagtttttctttttaaaaaaaatgtccttagaactcgatttaatttcctcttttggctttttatttaaacctgtttgtattattattttttaaatggttgatacagaggttatagtgttttccttgacttaccacagtctgcctctaattaatattattttactttaaaaacaatgtgaaaactttacaacaatataattcctttcacttaccctctcattgtttgagctaattttatcatatgtttttcaccttcatatgctggaaactccacaatacattgttaatatatttgcttcaaacagccaataatctgttaatagcttcctaagtactctattccttctagccctcctgcgcattgcatctacagagtagtctgtctgatttgcgtgtttaatattatcacttgctaaaattcttttaatatttccttcatggcaaaatccatgtttttaatatgtaatttaaaaataggcaatgtgttcatgtaatttaaaaaccaaaaaagttataaaaggtatttagtgaagcctccttgatcccatcttttatctatcctatctccagtatccattatttcccctgcaatgtctttattggttttgtgtgtctttccagatgtggtaggttatttgttgttgttttttgcaagtataaacacaaaatgatgttgcgggaagtcagggaccccaaatggagggaccagctgaagccatggcagaagaacgtagattgtgaagatttcatggacatatattagctccccaaattaatacttttgtaatttcttatgcctgtctttactgcaatctcttaaacataaattgtaaagatttcatggacacttatcacttccccaatcagtacccttgtgatttcctatgcttgtcttttctttaatctcttaatcctgtcagc

SEQ ID NO: 131100 - DNA, 1049 bp, Homo sapiens
ccgtttcttagaagagaaactacattccagtcatagcatttttaattactcagttcctggcacattaagaactctggtagagaacatctctagaagatagtgaggaaaagtggatttactcccacactgctactccttgctttatctgtagctggtagaatatccttactcttgtttttacaacttaacggcattttcgttatgatagagcccagagatctgcattttaaaattcacacccctgctgattctgatgcatgttttcagagatcacactttgagaaatagtgatctacagttaattataataacagacattaaagtataaaataagtttatgctaattgatttattaaattcagaaatatttaccgagtacctgttttgtgttacgtcctgataatatcaaaatgaacaagacaccttccgtaacaaaagaggactattagctagttaggaagaaaattgtaaacagataattgtaaaacaatatgggaaggcagtgatagggatatgtacaaaatacaatggtagtacttgaatatctttcctaaactagtctggggatctgggaaggcgtcttggaggagttaatatctaagttgagctttgaagggtaggttaagagttgactaggatgagagaggataagcttgatttttctttttatttttttccttttcctctttgccaccgtgtttcttccagtcaccccatgtcagtagatggtatcaccatgtttagttagtgcattagaaagtgaagccaaaattcagtgtctcaaaacaagaagcagttattattgctcacaagtctacgggtcagctgagtggttcttctagtcctagttgggctcattgatgcatccttgttcagtaatggatctgctgggaagctctgctcatttggctggacttcctcatatgtttggagggtgggggtagggtctcagactataagcttgtttaagattctttcacatggtctcctcttgacttttctccgtgtggtctcttatcctttagccgactagactagcccaggttggt

SEQ ID NO: 131101 - DNA, 1098 bp, Homo sapiens
gaaaggaacggagtacgaagggcgccgccgcttcccacctgcgtcaagctccagctggtaacaaggcagcggctcaagagagagcttgtaaccctcgaagcggggatccaacagaggtctcttcacccgtagggagcaattagccgccacctccatcgctttccagggccgcagcgtgagaattaataaagcccttgttgaaaggtccgcgcttcacgcctcgcacagagactgggaagcggcgtggttcccatcccagaaaacactgcggtgcgaactgccttctgggaaatgtagtgtccgtgaaaaagttgagactgttgcatgctgggctatgtagttctcctggtacttaacgcgcgcgcgacggcaaggtctgaactctgttacccagaggccctagcaaccaggaggcggcccgcgctggttaaattctcacattataggcagggtggcgagaccccgccccggaaatgcgtgttctagctttctgtgtgcttaggtgcccgagctactgagggtctaagtccgggcagccgaagagtgtggtaggtaacggtcctcagcgcaagggtcatttcgtcgctgggaagggacggccctcgcccgcggtgatggtggtgagctatgcccgtggtcctcagggccgggacccgggcccagcccaggctcctttcgatgtactgtctttcgttagcgtccccgacccgcgctcgcgggcctgtagggctctccgacagggcgtgctaccggagttggcctgaaaccagtcctcgctttgttttctggctcctcctctcccgcctctcccgctgtctccgccctgttctattttccctaagaatgtctgaactgggagggataccctagcgcccttgttttaccagtgagaaaactgaggcctttaagaattaagtgacttgtccaaggtcactatccgtattttaggagccaagacgagatcaagttcaatattccaggagtggtactgactagaccttgtagttattttgaaaatgttagcctccaattacaaaagcaagcatttcctagttctcactcaacttctccttttccctgttcctctcaaaaaagaaa

SEQ ID NO: 131102 - DNA, 1764 bp, Homo sapiens
ttttatttttttactaatagtatttaatctttttttgatgtttagtatgtatgacttctcccaatttttggatgcagtctctgcagaagtgatcggcagttatgttcagttttggagctcctagggtcaaagtacttgagttcaaattttgcctttccactttctatctctgtgcctcagtttcctcatcagtaaaatacagattattttattaatataaatatgtaacaatacgttctgggaattaaatgtgatgtttaaaaaaaagcaaacccacactgcattagcccagtgccaagcacataagtgtttaataaagagtaatgatattattaacacacttgaaatgtatcaccccttcagttaatagaatggtaaacatgttaggatgcctgcctagaggatttagcagaaaatgctttgtaaatgttctatatctgaaagtacatgttgatgtccaggttagcaagatgaacaaagatgcgcagatgagagcagcgattaaccaaaagttgatagaaactggagaaagagaacggtaagtaatagattgtgttaataaattacatttcaccgcctttaatagttagcttgtaagaatctaaacaagaaatgaaacatgtcactggaaagaattacaattgagattataaaagtttctattccgaacatctggaaaaaataatttaggtttgttaagtattgcaggacttggagggaagtggtgatgtagaaagatgagcaagatatggctcttaaagagtaatttgatggagaagaaaaagtacatacctgaattacaactggagacataatgttacctgggttttaacagggagacaatgttgtggaaccagcttcatttaccaagctctcaaccttggagcagcaagtgctgtttccactctctaaaacattcttccttctcttcctttttagctaattctagctcaactatcaggtctaatttatatattgtctcttcaaggaatgtttttaagtcccaaataccttgttccatcatagcatttaatcaacattgtgttctaacaatctacttggctagtttgtatcctccagtataatctaagttctttaacaccaaaaacaacattgtatacccagcatctaatgctttgtttggttcataattggccacgtaaatatttgcagaatcaacaggtttagaagtacaaagaaggggctgaggaatcaagaaaggctcccagaggcagggttataaagtgagtaagacaaatatgtataaggaagaggcaaatatgtataaggaagagggggaatctttcaactcaacccgggcattcaggtgatcatgtaagatctcacacaataagaaaaagaggtgcatctgttgctgactttatttttggatgatgggagtcatttaaagttttaagaaaggaaatgactagatcacatttacactttaggaatcttactctgttggtgtggagcttggacttgaaggggacaagatagatggcagaaaaatgaggtagaagattatatagggttgaaaatggaaaactccaaaaattggaaggagaccttagaattttaataaaatgtagaaacagcaaccctcaaaatgaggaaggaggcatcgataactgccttgggtagctttagaggatagtactgctggtaaggagtacggattgtatgttgttttttttttttgttgtttgtttttgattcatgcagcttcaagttactgagtttctatcatatgccatgccctgt

SEQ ID NO: 131103 - DNA, 1533 bp, Homo sapiens
cttgtaatggtttcctcttggtggcatatgtagacctaattcccaaatttttagaaattttctgtttctgttaagcgtgagcacttaagattttctctggcatcagaatatggaatctcatgtctttcagcaactttattgtttcttatgttttaacttaaatggaacactttagggttggcagacttatagaaattatctctttcctgtctttaacagtgaatatttgaaaaattcatctatgaaagctcttagaatgcacttaaaaaaaaagtagaagggaagcttattaaattgctgggtattgttgatgataccatttgatggattatacatgtcactaaggggagcctcctttctgtctcagcttttgatataatggaactctggatatttttaatgaatccccattgtaatggtttctacaaataaaaataaactatatgttaactgtaagaaggcaatgtgacaaattagtaaaagcatagactttaaggtcatatagattttcatcactgaaagaatagagctggatttcaactcagggctggatgacttatttaagcctcagttgcttcacctgtgaagtgggaaaatgcctagcccattagatcatcgtgaatattaaatgttgtaaagcacctaatagagatctagtaaatgttaattaaaacagttagttataagtttttggcattttacagatgttagatttgaatattacagtctaaatttattgtaagtgtcacaattatttagttgctggttatttagctgagacttacgaacaacttttatcttttagatctaaagaatacttgatgtgtttgtaaggttgaactaaattttcagtgtcctttttttaaaaaaaccagtctacactctaaaaacatgatcttaacccttcctctatgaaaatctttcttacagataatgattttaaatgatatgatttgttttttgcttttgcataagaggtaattaaagaaaaaggactagaacacgttactgttgatgacttggtggctgaaatcactccaaaaggcagaggtaaggaatacagagtttgttaaaggaaacatgctgcagacatgatttttttaaaatctcttgctggttcagattttctttctgtttttaaggaaaagcactacctgtgttgcctcttgtaaagagttaaaattgcctacctgcctcctagcatagtctgggagtaacaaatgagatactaggtttcagtgttcttgtactctagaacagtgcaccaatgcaagttgatacagttgttcaagcaaataatttttaaaatacgggattctgcagtgtcaaatactacatgaagctaggatttataaactttatcagatatggcatgactccacttaaatatttaataattcaaagtcttattccaacccctgagtcattgcccctttatctcattaaaaattaatgaaggtctgtcttaaatgtctacttaagaatttggtagctccatgacttcatgttcagagtaattcatatttaagactc

SEQ ID NO: 131104 - DNA, 1067 bp, Homo sapiens
aaacaactgtatagtagaaagatcagcccttttctggaagaacatttcctcagtttttatcttttggccttgcttatggtgatttttcattcagcataaattgttactatgttttaatcaaatttatccatctgttatagcctctgtatttaaaaatggtcttctttactcctaaagaattttctcacgttttcttctcatcaacatgcagtgcatttaggcattggatagttcatttaaaatgatgaattgcaagaagacacttttctttgtcagataactttaccttttttttaattgaacatgagggttatttatgaaattcttatgttgtttaccctgagcaaaatgtcagatcttaaattctcatgtattaattggtaccttcttactcttatttttttatttttgtttttcagccctggtacctgacagtgtaaagaaggagctcctacaaagaataagaacattccttgctcagcatgccagcctttaagattgaattagattgtgttgttgtggttttatttctgaaagtaaaacttgccataaattagaaaacaatttcccaaaataaaatccttttttgtatgatggtatacagttttcagtaatgatgtatacattgtattgatttttttccctaaatgtgttattttaataaatatctcatgaatgagtttgaagtttgcttggattttgaaatgaatgggactttgtctttattactaattcaccaaatttgttgagcgcaaaagcaattaatgtagtttaagtatttagtatgtacagttctctgtgttaacagctgagaagtaagcaaccttttctgactgcatatggtgtattcctcttttgagtccccataatattttataaattgtaatgccccatcttgtactacagttgtcttattcgtattgtttataaactttgagggttaggactgggtcttactcatctttatgtgccttccttatgcttcaaagaatttaccatctaatggaagagaacatttgcaagttggctccataccaagctccttccacatactctactcatctgaa

SEQ ID NO: 131105 - DNA, 1033 bp, Homo sapiens
tctttttttttttttttttttttttttttttttaacagtcactgttcttttcatcctgtcaattagtaggccacttccaggttaggcattcagtaaatctttcagcttatatggagagacagcctccatatgtacaaaactacttgagtattgctaaggtaacattttagagccctgtctttgtaccttaatagcctacaagccccttctgaccctagaaatagaaaagactagtgtgcgttttgcctttccttagaagaaattggcaatgatgcctttacagagcaatcaagatcagatactatgagagttaagtatgtttttctggctttctgattttgttttgttcttattttttatgtgtttgtttggaactttcgtattgaggtatagcatacaaacagtacatacagtcaagtatgtggtgttactactcagattgagatattagatcttagctctctaatgcttcagtataccctatcagagatgaccatttttttttactatataatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgaggcaggcagatcacttgaggccaggagttcgagaccagcctagccaacatggcgaaaccccgtctctagtaaaaatacaaaaattagcgggtgtggtggcatgtgccagtagtctcagatttgggggtggctgaggcacgagaataacttgaacccaggagacagaggttgcagtgagccaagattgtactgctacactccagcctgggtgacacagcaagactctatctcaattaaaaaaaaaaaaaaaaaaaagtatgttatagtacagggatggtgtatttatccaggatgattttactccttatgtttctaaatgttattgcttatcttatgctcatgtaaggtaattaaaaaactaattaaca

SEQ ID NO: 131106 - DNA, 1050 bp, Homo sapiens
ctgggttgtttcatgaacattttgaatactatgttttgagacttcatcttatttaaatcctgtggagaagcttggtattttttatcagatgatcaatctggataggcttgggtgaaaatgtccagcccttctgtgagttgtagttttaatgtcagttcagttttcagagcatttgctttcgttttactttgttttttgttttttgatggacataatagaataaaatagaacagaatatatcagaatgtcttgtattttttgaacttttgatcaagttttgatctgtgatatgaaatgtatgttttcccgtgggttaaaaaagtttgaaaaccagtgttttagaaagcccatttttctaataaatcatcaatgatgtgttcattaagttgcccctttgtggctgataatgttgatcaattaaatttagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaagtatgttaagatttatgcttttggagattaaactactttttagattcctatagttaaaattaggtgatacaattcacatttattagaaagcctatttctttttttttttttaatactttaagttttagggtacatgtgcacaacatgcaggttagttacatatgtatacatgtgccatgttggtgtgctgcacccatcaactcgtcatttaacattaggtatgtccctaatgctatccctcccctctcccccaaccccacaacaggccccagtgtatgatgttccccttcctatgtccatgtgttctcattgttcagttcccacctatgagtgacaacatgcagtgtttggttttttgtccttgcgatagtttgctgagaatgatggtttccatcttcatccatgtccctatggaggacatgaactcatccttttttatggctgcatagtattctatggtgtat

SEQ ID NO: 131107 - DNA, 1078 bp, Homo sapiens
gatacaatgttatttaaaaatataaacatcagagagattaccattaaaatgagagattaaccctaatggtagattattttaaagtgagttatgaattgttttcttcatagagtgtattttcattcaaagtatgacttaattttaaacggtttgacttaaatgaaactttttaaaggaaaaatttatgaaacaagtagacagctgaggttctcaaccttgggagcatatcagaatcagctttggaggttttttaaaagcacaaatgtccagacccctccctacctaagctttaagcatgctttgattgattgattatattatctgttgttgtgtaacaactccaaattcagtgacttaaaataattacaaatattaatgtaacacagtttctgtggattgggaatccaggtgactaaactgggtggttctaactcagaatttctcatgagtttgcagacaagtcattgggttggggctacaatcatctgaaggcttgattgtggtcgaaggattcatttcaaagacagctcacttctacacctgacaaattaatgctatttgtttgcacaaagcctcagttccttgctgtgcacctctccaaggagctgcttgaatttctttatgatgtaactcctgattttcccagtaagttataagacggtgagagcacttgctcatgggtgagggtgacaccacaatgcctttttgtgatgtggttttataagtgatacactgtcacttccatgttatttcattagaagccactaaatccagcccacatgcaagcctccacctcttgaaggaaggaatgtcaaagaatttgtggacatatttttaaattacatctgtctgtcaatctatgtattttatttgtttgtttaaactgcacagttgcttctgaggtccctcttcccaggggacccatgtatatgtatgtttttaattcattgagtaaaaacactgtttttactaaagccaggccctgtggcattaaagggtctttgcctcagaaaaatgcattctagtaggggagacatgatattaaatgaatgatcacacacgtcaatataattacaaa

SEQ ID NO: 131108 - DNA, 1237 bp, Homo sapiens
ggagcgtgtgttctgttcagctgtgttcatcatgcactttaaaaactggctgtttgtaactactataataacaggagattatcaagctcaatatcaagcttttctgaatggtatccccagaaaaagatgtggttcaatggaagtattgttttacaaaatggagataatctaaataagaagtgtcagaagatgtgagttcttatccctgtacttaatcctatgacttcgggcaagtcacttagcctttatgcctcattttacttatttgtaaaatagagataatatttcttctatttcacaagtcacgttctaaggactaagagaaatcctgtttttgaaaatatttggaattttcaaattagtgagaaaattttaagactttcaacattttatttggtgataataaaaaggcactgctatttctttctagaatttatttgccattttacctgtttggtattttctaaaagtaaaagtatgtttcttttcagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattatttt

SEQ ID NO: 131109 - DNA, 1034 bp, Homo sapiens
ttttttaagtacaaatgtacattactgtgcactttccttgttttgttgtttctcagtattctgaaagagttagggcagcttctgaaagtgctgtaagttataggagaatctggttctttgtgtctgattcattttctatgtgggtggtgtactgccttaaccttgtcactgacagaaaagttcagatttcattctcatactgtaaagagaaaagaagtttgtccttgaagttctctctgactgaagtatttgcctttagacaatgattgtctacactcttccatcaacactctggtacttgttcgtgtcagttctcctttgaattgaaattgtaatttcctttgttcatctgggctatttttaaactatggcagatcttatctgaaaggcaaaagttatgctccagattaatcctgtccagatttgatagtgatcattatactgttcagtgcaactgaagcaatcaaatgaagaaagaacacttcttttctaacttatttggccaaaatgaatgttcagataacataattttagtttttatatagacccatagtattttggaaagcagcatctgaaaatagttaatgaatcatcatgggagcttgagaattgttgatttaaaaaaggatgtgagcagtccttaagtcaatctcctaccccaaagcaaaacttatctatagtgtgctaatggtctatcagttttgatcagagccctttcatggctggaagatccccaccttgttagacagcccattatttttggacagctgaaattaaaagttctctatttttttaaaattaatgcctgtccttttaaaatctacttaaagatacactggcttccttttgaagtgatacagaaaaaagtatatttctcctcatcatagtccttcgaatacttgaagacgtctatttggtcttcttttagtgttttctctcctctttgagataaacatctttaggccatccaggaattttttttttctgtttccttttttcttttgtttttaaaaaaacattatgatgcttatacc

SEQ ID NO: 131110 - DNA, 1033 bp, Homo sapiens
taatattaagaaagaaattattatgttaaagggaagttgctgggtttttttgttttgttttattgtgacagagtctcgctctgtcacccaggctggagtgcagtggcgcgatctcggctcactgcaagctctggctctcgggttcacggcattctcctgcctcagcctcctaagtagctgggactacaggcgtctgccaccacacccggcttttttttttttttttttttttttttttgtatttttagtagagatggagtttcaccgcgttagccagggtgatggtctcgatctcctgacctcatgatctgcctaccttggcctcctaaagtgggattacaggcatgagccaccgtgcccggcctgtttttttgtttgtttgtttttttggtttttttttaaataagttggtgccactattgttcacactgttggaaagagaaaaagataacttatataccattcaattttgttcttttaaagtgcaaaattttgtgggttttagtacattcacagaattctacaaccatcacataatcagtttttgaacattttcatcactccctaaaagaaattgtgtaaccattaccaatttctccccagagtcactcctttttgccttagaaattctcaatttacagttaaattcccaagcaaatgtaatgtttttctctctgttattctttattttctcaatttggtagataatgcaagtgacagcagcaattttaatcccctattctttggcacagtatagctagtttttagctacaactaaaatagtttataattaatctattttttgatagcattaaaaatgacatgaaaaatcttataacttcccttcaaaaagacctctaagtatctctgaagtggtgatatgtatatctaattgtaagggtgattttatttaattaacattaaaaattaggacttataataaatgtaatttactgttacacacttacatatatcactatataatactaatttttactgcaagaacactgatggacaactgaaatgtacctat

SEQ ID NO: 131111 - DNA, 1065 bp, Homo sapiens
taacgaaaggttaaatattaaatccaggaacaaaagacccctagacttccccactgcatgtggactgaacaaaacctctggtactcagtgtcgaagaaactcccttctttaaactggtaacctttatttcctttagttgctgggaagtggagtccgggtcaccaatggaggtcattgggggtgaagaatcaagcagccagtgactgagtggtcaatcaaaggaaggcctccacaggtgcaaaatatgaggtagatgatgacaaaagtcatccagtgaactagcactcacctctgctgcaggcttgggtgatccagaatttccaaagagcagtgtcctaaggaagcagtggagttgaaagtacatggtgcagaaagggaacggtgccagagaacttgtcttggaaattgcttttgagtaaccggactcagtttcctattaacagatcctgaagagggctatagtagacattatgagggagctttagctcttccactcccactccctggcactcctctatgccactactggtcagaagagctggaaaagaatgaggagctgaccttttgttctcctgcctaaaggaggattttttcttttcaccagtctattttcatatactggggttctgttcttcttttgagggtcccttgtcttaaagcctttatatcctcactgtctttggaaaattctggaatattaaaactatgaccactcccctgccataaatatctgaaaaaaaaaaaaaaaaaaaatagtgagataagaaaaaaggtagtcttggaggataacttgttgcctttcctctctgttgtatagtacagggtggaagtatactgggaaaatcttttcagagaccttaacacttggatttgagtcctagcccttgctatttatgcgctatgtaatcgtggggctgatcatatcatcacattaattcttttttcttttttttttttgagacagagtcttactctgtcacctaggctggagtgcagtggcactatctcggctcactgcaacctccatcttccaggttcaagctattctcctgcctcagcctcctg

SEQ ID NO: 131112 - DNA, 3057 bp, Homo sapiens
cttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatataaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacacataacggcgttggtatggtttatatggattcactttcatccttctagcaataggaaatacagatcattgtaatatatatatatatatatatatatatatatatatatatatatatatatatatatacaggctctgctgaattgaaatggtgaaatcaaatcaccattctaaaaaattattacttatattgataaagcctggactctctcaacttgttgtgctttgattttttttcttaaacaaacactctctcactgatatattttgtgtaaaaagatatatactactttctccagagagataacataaaaatgtgtttatttcaaaaacattcagttgagtatcaaatattgagtgtcgagtattgggtaatgattatgttacgatgtgtaaaaactcctgcttatgaagtttaactttgaattcggtatactcatgtgaacatgatgcaattcctaatcaatcatctcaaaaagtttaaattaatatatcaaatatcttatttgtttggttaaaatcaaattaatcagggcaagttccctgaaagatgactttgaaagagaaatgaggcagaacagatccagataggaaaggacgttggcaagactcacctgcatgtttttaaccagaaggaaaaatacaaaaagacagaacataaagtatataaataattgattgcttcagaagatttgcttggagagtttaaaataattagtatctcccctcattatacaatcttcatttctcatttttgggagcccaaattaaggaacaaatccttctaattattatttttttttcttttttccctttttctttccatgttttgaaaatagcagagagtctttgaggggctttcataatggcaatgcccttgctttgcagctggaggcaatgttctctagataagagtgtaataataacatttaatgtgatatacttccttaagtagaacttgattcttgtgtcaaggaccacccttcagataaagaatacacatgatctcacccaggactgtcagaaccccattagaggaggaatatgtagccatcagctatttacccttgtttgcggggagagaagtgagtgagtcatcattgtcactctgctctcacctctgggtcttccatctctgtgtggacggagcaggggtccagaaaaggaacatacaaggacacaaaggaataggcaagtagcctccatggatacagccagctgggtagagactttgggaactggagagctcattccacacgtataaaggtagtctttcttcagccctaagcatttgtgaagggagaatgcttaacttccgtttgccagattttcagtttttaataaaaactggacaaagggaattttattgtatgaaatctccctaagttttaaatgttagttacttacttttttgttttaatactgcaagc

SEQ ID NO: 131113 - DNA, 1009 bp, Homo sapiens
aatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaatttttttttt

SEQ ID NO: 131114 - DNA, 2453 bp, Homo sapiens
tggagagagatctctttctcttcctcttctcataaggccacagccccattggattagggccccacccttaacaacctcatttaactttaatttcctactaaggaccctgtctccagacacagtcacactgtggtttagggcttcaacatataaacttattctgtctgtagcaatgtgtaatttttccactgttaacaatatgtatctcctgtgttactcttatatgctggcattttagtgcacaactcaaaaattgaaaaaaaatttcagaaaaatcacatctcttcaagtgactttctacaccgtttcatcactaaatgatgcaatctcaaaatctgttgcatctggaaaggttattttcaagtagattaaagttttcagtcccccctgcaaagatggacatgatttaattaggctaaaatagtgcactttggttacttcctctgatcctgcttagggcaaaaggaggagatttagtaaatctacagcagaaagcctatccctgctttgaacttaagcatggtttatatttgtgaggaatttttaatgcattttaatgtattttttaatgttttccttttatgtattgtatgtgttctctgcagactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtg

SEQ ID NO: 131115 - DNA, 1035 bp, Homo sapiens
acatggtagtgctgaaaatgattccattcatttacgtgagtgtatgtatgtatatatgtttgtatgtacatgtatatacataaccaacgtatgccatttctacacattttgcaaattgctcattagctcagacaagcagggactgttcctttcctctcctctcctgggcctaaacatggcccagaatttattaattttcttttgcatttcacaaaagtgaaactgttttcaatctaagttctagtttctgtaacaatggctgtccttcatatttcatgaataaaggtatgcttaaagcataatgcttgtatgtgtacacacacacacacacacacactccaaagtggcagtagcatctcttctgctagaggtcaattcaattaagctatcactaattaaatgcccactatatgcaaagcactgataatataaagattaaaggaaaaagtaggtccttcttcaagagcctcctttcccctgtgtgacttgcacatgaaaataattggaatccagcagtctgtctcctatacctatacagagaaagtaggactattttgtgatttaagacaattcaagatatgaaaagccgaggcaaaactaacattcgaatgctccaacagttaagtttgtaccttgtcacaaagttcctcttatgatgaagagtagttttgatacatttggggtaaatttgtaaatgtgaaatagcaaagggtaagtcacaactaagcatttttgtttgcttttcattttttgtatgtgttttaaatttcagctacactatgaatcctttttcaaaatatctttaagagcttggtaatttttttcttttcctttaaaaaatctatattacttcacaatagggagaaatgacatttctttaacacagatcactttaaaaaataattgtgggtaatttcttgctataatttatttacgtcttttgccgagattgtgtgaccaattcagtgtgttcatctagaggaaaaataatgccaacagaaaaagaatataaacataaggcaggggaaaataaag

SEQ ID NO: 131116 - DNA, 1049 bp, Homo sapiens
aattcttcgtttaatcctactgctgggtccttgaagtgtcattgatttactgattctgccattatatttttatatttattttatttacagaaaaaattatctaagtcagatataactccttatcttgggagagaagtatgacttccatttttttcaagttgacattttaaaagataagagcattagcctctgaattttttaaatatattaaactagaggaccttgaagctactttttttgaaaagctaaggaatatatgtgtatatgcctatacatattataaatgtatgtttgtgtgtgtattaactataaatgcatgcatatatatttataaagtagccaatgttagtcaaattccaaatggaataaaatttatggatataaatgtgcagctaccacccaaaatttgctcaaaattagcaaagtttctatgtctgggtctgtataaacccaagtgagtcaactttatttataatctaggaatcaaatatctatttttatattttgtgcgtgtaatctatgtggctacactatatgaaagaagaaagctacctgcagctagaaataagtaataaaacatgcatgagggaatgtgatctacaatgtgttcctttatgttctagaaaggaccctgatttccttcctcaaatttcaacttagtttgtgtgtgagaaatatgtatctttaaaatggaggaagtcaccaccagagttatgtaatgtaatccttaaagatcttttagaatgcagtcaaaaggagagaataggaaagaaagagaggagagatgtattcatatatttttaaatgtgtcattgatgtaataaactctttaaaagacagtttcttatataagggagttttagggtcaccattaatacattttctcatgttgtaaaaataaatatgaggcgctttgtataagttttgtgcatatgcacattaacatagatattgagttatacacttgtatataagtgccaaaagtgtattcagttttcaatatctttaaaatctaatgtctattgaattattcaatctcttctgaaatt

SEQ ID NO: 131117 - DNA, 1061 bp, Homo sapiens
ctatttagctacttcatataaaagatggcaaaaacttccttcttgttcgtgtagacattcagcctttctagaagacaaggatgacacttttgtcaattatttattttttgacgtatgtgccaatgggaacaattattagcctattaaatactttttgatatttgacccaggatagtaaatacatgcattcagaaaagaatccaatgctacctttgtcatcattgtgacaactgaagagctctagtggcctttcaagtacagataaactttcaggaggattctcctatgagctggccacaagggcttttattgtgaaccttccagcatatcctgtatgctcattgtgaactaaggaaatggcagtgatggcatctcaaatagtggaccatggcacccgtcatgggggtatccctgctttttgtgcccattaaaggtttgccaagttcttctaaacagactcttcagcagtatagtgaccattatactacttcctcatagtgtggcttttgtaaaaaactaaaagaaaatgtcctggattgattttgtcaaaacagttacatgagaagtgtagataatgatggactctttcaaggattattcaaaccaaagtaaatactagatggcacggatggactactcaaatgtggtcagcagtactatccaatgctctacttataaaagactcctcttttggacagataacttgtagaagactgaaaagaaatatgtatacgtctgtatctatgaaatgtattgactttttttttattttttactgctttacttctggtaccattcctttattttgtcttaagaatctacactccttcatttttagttcatctagttcaggtgaagctgattttgccctagattcaaagccaaattgtgtgccttacattcttgttactcaaactgggagcttactagacatgccagatctgagatcctatcccagatcaataaataaaaatctgcattttgacaagatcccagggtaatttgtaacacagatgagagtttgagaaacttagccaagtgcagtggtacacgcccatagt

SEQ ID NO: 131118 - DNA, 1055 bp, Homo sapiens
gtcccagggatagaacaggtgagtagactccacactggtttatagaaaaatgcatgactgaagccagcaaggtcctcgtcatctatgatcctcaggtgctttattttcgcagcctagcaaaaggaataaatctaatgcttgctttactgtgaatttacaattttccttagaatttcagtgtatagtgactggaacttaggcagtctgtaaatgataaatggaaaaagaatgaaacaaagcagaaaaggggaatggaacaagggagggagagggagaaggaaggcaggaggggcagggagagggagggaggcagaaaatgtaaatctcaaagccgatgaggttactatagaccatctggagaaagatgaattattctttaaatcctagatctagaagagatattagagatcatttgttgtttatgctctctgatttccccctccctgtatctaaatatataaagaaagaaggaggaaactaggttactgaacaccaaccatgtgactggcagaggtagaggcattctatgtgcttcatattcatgacccttcatcatgattgaccagttgctcttcttttattttcctctgaagcagaacctagaaaatgactttattagagcacctatcaggtctttgcttatgtggcttccctgataattgctgagcaacttgagaccttgggtcatgtcttttaccattgtgtgcctagttatgccttttacaggtagagcatccaacatggtgctgggcccagggcagatactcaatgaatggcatttaaaatgaatgaaagaatacatgaattacaggtaaatatcacagggttgtctcatttagtgtgccatggccttgatgcttatgcagtcctgtgcctataaaactatatggtactaggtttacatgctttagggagtaagtgaaccttgcagtttcctatttttttaaatttgactcttgtgtatgtgttgatggtattgacttgctttcatttaaatgtagaaaaaaaatgccatgttttggtattttagccttaataacctcataaaacacata

SEQ ID NO: 131119 - DNA, 1033 bp, Homo sapiens
aaccacttcatggagatagaagtttgatggttggatatatcaaaaattgttaccagatgttgttcagaggccttaacagtttaaagatcatgaggtttttttttagcaaagcaaaaatattctaattgaagttgtcagcaggagtgagactaatatgcctgtatttgattaaataatagtttatttaacattcagtgtggcccaaaattggccaaaagtcggaaaacattttagccagcagacttcaaaagaaaaacgcaacaaaatgacagtactatctaggtaactttcaggcattgtggtttgataatgtcagttttcatcctgcttcccattcttcatgtcttactgtatatactctgcaaatgcctttgaatctttattctgtaatgtattttgtattttataaaaagaaaggagagcaacacaaacttattataagacttattgctgaaaccttggcaaggaaacaccaggacattttccattatagaaatgtaaacatctatatttttaggagttagatattttacagaggctgctgtcctttcactgggacatgaggatattagctgtatcaaaaagaagaatgtaagacccacatggtcctgttacaacttacaggcaccttttcctgatgacatgagaggagcacataactacttccttcccattcagtgtacagctgtgtgctgctctcagatgaaatgcaagaattccctttgaagaacagggaggcttgtctcagccagtcggtcttcctattggcgtgagcctctctctccttacattttctacttctcaggcatgcacctagccattaactcccgaatgatgtggcaataccttggttcttccagaataagtttttcagacttttcttggacttggtgtacgtaaaaatttaagaaatcgcccacatagatgactaggaaataaatgcattttaaaaaatgaattttcatcattgtgaccaattcccaagctagcgtttgctttccgtagtacacagaggtctggatttttaaactaa

SEQ ID NO: 131120 - DNA, 1020 bp, Homo sapiens
cttgctacccagatatggacctctgttcgccagcaagaagaaagtatgtatgtacattatatatgtattagtgcagccccctatttattgccatagacagaattagagaattttccaaagtagtatcaacctcactgcagtttccaattttaggtgacaattcatgcttacctttcttccatattcctgcaagcaaaaatagaaaattaaatgtattttttccttcagaaaatcagtgggtaaaagtgtttgttgtggcccacactgtgtcatgtacttagagaagttggctgtttctataataccagcgaatctatatatgacattcaaagtccattctccaaggactcctaaatatctacatgcactacatcatgtagactaaataatgaactttacaacaataatttttactcagttttacccagaaaagctaaagtatcagggatccaacattcttaagctttgtgaaccatggtgagaaacccctgtatttgtgaagaagttttgtaataataaaaaactataaagttatgctggtgcttcaaagggaataacatcaaaaacttgtggagaaaagccagaggctaccatcccacctccaacctgcacacacacacacacacacacacacactctctctctctctctctctctctctctctctcactctcaattgggagacctatcatggtagaataaagtctggttcaccaaaaaagagggataatgaggccatttttcattattttcccagtggattctaaaatagttacctcataaaataaatagtttaagtttccacattactttttgcctttaatctgtgcctgcgatgcaaataaatgagtggagatttttatactcccaaaggtttatgtagaggcaaatatattacaaaatgaacacctaaactaagcatgatttcttactaaaacagcatcttacagaatgctgtggttgacggaagggagacactttaggaaaaggaatctacaaaaagatttaattttatactca

SEQ ID NO: 131121 - DNA, 2008 bp, Homo sapiens
agtgatcaggaaaaagaaagatatctgtgattgcatatacaaatggacctagaatagagaagttcttaatagttaagttgtaacttaaaattatttcagctaaagtaactgaaatattttcctttctttataacagaggaaattagtcatattgtaataattgtgactaatataatcaaataatgaccttttcaaatattataataggttagatccttcttttaaatcaacaaatattatttttaaaaaggaaattcattagaaagtagaatatatgtggttccaagtgtttttcctacagcaaaggggtctgtattgacagttacgttgaatcaggattgcttgacattattaacaattaatatttaaaactcactttcaaaagatgatcgacgaagttttatatttggcctctaagaaggagtttcaggagacattatgattttgtcaagggcaaactaataacatcaaatatccaggagtcagagttttgttatagttgtttaatggtgatggtccgaaaaataaagttgtctagtagaattagtatgcttatactttttaagttattttagaaaatggtcagttcctatagaacatacttgaaatgagtgaccagcctctcaaagttgtgataaagtgagagatgaatgcatttcaagtgcattgtctatctcggaattagagacacctatttgaggatggagtttgggaacccttctgtggcctgcgtttttgaccaaaggcctaaagcatgaaagaatagccggaaagagagctcttttccatatgttgtccatttggctgtcagcactcgttctgacagaaaagaacagagtcttgagtgactgctagtctctcttaaagtatggtaatgaggctaattaggagagatgagagctgaactacatttgtgaaggcaattatccatatagcttttgtgccatgctgtatctttgtaagattcctcttctcgaattttgtcatttctcaaacatcacaagaataatgaaaatgtctaaaacaatacgagcaatgtggtcagtagaaaagaataaattactaatgaaattctgtgaacctgatgtctgtttgcagtcttcctgaacaaagatttggaggatggctaagataatactcacaagtgttgttgttgttgtttagtttacaaaaatgaaaattatttgcactttattatattgaatctatatatcttctttggtatgtgaacaggattttgcatggtccttttatgttagtcatcatggcaagtcagtaatttagtataattgaaaggaaaagacatcagaggcttactaagcaagcataaaatgtattctcttttatgtgatttagaaagttgagacattttcatttctattttcaaaggtttaatgcactttaactttcacaacagttatgaaagtaaaagaatggacctagatctctgtacagtgatttcatagtaggtgacactgaacataagttttgggtttttttaagtatttaatcacaaaagttaacagttaaaatacttgtattttttaatctgctgaattatttttgaatggtattgctgacatttcatattatatatatataaaaatatgacattctaaaagcatcaaactctttctaaagtgtaactgaagttttttcctccaaaaagaaactaggctgatttaattcaataggaataccaactggatttggttggtaattgtttgtactcacatttacatctggacataatgttttattgtttttaagtctattataacttttatatcttatatcttttgctcaaaagctcattagcctataagcttctaaaacacataaaggagataatttttatttttgttttgtaggattaaagaaaaaatcaaattaagtgacacataggtggaaaatctgtctgaattgcttaacagtgttcttacatatgaaattttattacttttaaatacattcagtagcaaatttgagcaactccgctttgtctctt

SEQ ID NO: 131122 - DNA, 1046 bp, Homo sapiens
atacatcataacaaaatggtgaggtgaaaacaaacgaacgataccccaccaggctgatttttctgcaaagggtatcttgtgccagggttgaacagaacgtcattgaagcaccagcataaagacatgttaacccaatttttcctgtaatgtatacatgattgattggcaatttttggaccacaggctgtggttaggattacatcaatcaggaagcagtaactcttgagggacttcccttaaatgatctagtgtttattggcgaaaggggttgcattttttgcagtctgtttctttcatgtgttcatcagttccattcctgtttgaaatttggtatcagtgcatgagataagtcacttttcttccttttatatccccttctgtcatttaaaatgcaagatgatgaacctagcacaatgtctggtacgtagaaaatactcattgaaaaaaaaaagagagaatgaatgttgaatgaatgaggaatgagtagtgaataagaatacatttgtgtgtatatagccacatttggattttccgatattcagaagtggtaggaacacagcatgccacacatttagctatagggcgccattcttttaagtagagcactgcacatctaatatagcaatcaacatgaatatacaggttttaccttctttgcattattatattatgtcacgtcatctttgtaaataacattaaaagtaaagatgtgaagaagaataggcaaggggaagaatttgccgaatgctaggagtccttgttcactctaaccacccttttgtacacttttggggtaacaggaaaaattttatctgtaatatgtgtaatatgtcatcagaattctgatggctctctttgttgttctgtgggttttcgtaatggtctcaaacatatataacttgttatgttcccaaaaggatgcattatggatctatgaaatttttgtaaggtgtgaacactaaaacgctgtcccaaggctctgctgttaatttgtttttattgaggaagaggcaagaatgaggcacatgtgtgtggaaccacttttc

SEQ ID NO: 131123 - DNA, 1430 bp, Homo sapiens
gaccaaatgtatacaccacaacaaaattttatctgtgtcaacagcaatttgtacattttatatactctaattcatccaaatcaattgcctgattacagtttgggtactttagaagtggatagtcttataactggtgctgcagtagatgcatgactctttgaaggtgtttcggaaaccatgttcattttcatgagtttctctagtagttattgctgatagatttaagtggctttcccaggatgtcaagacaacaatgtgtttcacattttgagcttgttttcatctttatctgagacatgtgatgaactgtctgaaggcaggtggagaacaggtacactgagatatctacacatacatatgcaaacacacacatactcacatgtacacactcgtgcaaatgcatacacttctgttagcacattgagacatggattcactattgtggacagaattttgtttgcatgattgtgtacatatgtttgtcagtaaacgctcagctgactctatccaactttaggtttaaaaatattggagatgggctgggcgcggtggctcacacctgtaatcccagcactttgggaggccgaggagggcagatcacaaggtcagaagttcaagaccagcccggccaagatggtgaaaccccgtctctactaaaaatacaaaaggtagctggatgtggtggtgggcatctgtaatcccagctactctggaggctgaggcagagaattgcttgaacccaggaggcggaggttgcagtgagccgagatcgcgccactgtactccatcctgggcaacagagtgagaacccatctcaaaaaaaaaaaaattgaaagtggaggacaagcaaaattattttattactatactgtttcacaaatgctcactgagcttttttgattttgctctgtttgatattagcctaggttagttaaaaatctgtttccacattgatatatctagagcgttattaatggtgatgcgacattttatatgtcaggctcttgaaatgatttaggtaaaagagacattcgttttctcagtttcaactaaaatgataaattcttatgttacatctgtgctcgaggaaacaccactaatgtcatctcatttatataaatacttgtcaggtgactgcctaattttacaggcatctgagtcttatccaagcatcccaaggctgcggtacttggaagttcctttgtatttcagttaatggcatcaaacaagcctttgccccgctctacaacaaagcagtttgaacgttatcacatcaaagagaaagatgccattgtctgcaaactgtcttatatctgtcagaataaatcaattatgggacagaattaatttgacataccatttctttcaaacaagagacccccccatttccttctcagaaatgtaaatatataatacataatatatttttt

SEQ ID NO: 131124 - DNA, 1515 bp, Homo sapiens
tcaaatatctacctacttgtgtgggtatgtatgtatgtatgtatgtatgtatgtatgtatgtatctgtctatctatctatctatctatctatctatctatctatctatctatctatccttgtctatttatctttccatctgtcatctatctacccttaaaacatacaaagcagttagcacagtgcctggtacacagagagttcttaataaataacatttgtatgatgactattattacctacaattcccagatttttcattatattgtatgacatgcagaggtgattctgccagactacttgttaaccttatcactgtcatgtttgtgagactgtgaaaccttgcgtgaagctctcaggcaaaactgttagtgactatgctattgtggggccttgtaaatacttctgtagctatagttacttggccatattttaattatttgtaacatagttgagcttgaactgtgagataaattcattctaatatgaggcattgtttcttattcatgagtatgcccaaagattagaatatagtatgtgatcaatacatggttggctgttgcttgaatgaatgcatgctacaaaggttttggcaaggaggaaagtttggttagtcgtccaaactacttcttagacgtttgattaaagaaaagcagttctgagtcttaattgaatcgcatggtcttggttataaggcttcactctaagaaaaaaacagttaagtttctagatcatgtcagtgactgcttttatgatttcacttcagatctgatgccactgtaatctagttgcaaaattttgccctaaaattattttattatttttgtaagtataattttcaatacatttattatctgaaaataaaaataaaatatttatctattattcaggggttttataaatcccaagattatataggaaaaaaaccctgattttttgttttaactccagagaaacttgatgttaggattcaaatatcaatcttaatctgatatatgggcttttcattaaactttaaataagctatcagatttttaatgtggggtgtgtgtgtgtgtgtgacttgatgtactgggtaaactaaaatactaacatttcagaaaaagaaaactttttcagtctgcaatctgggtaataaattttactgagcaggtgattgtgttacaggatggattatttgaaactcatttattaatatactgaacatttattgaacactatgtgtaagtcactattttggcacttgagatatatcagtaacaaaaaagagagagattcctccctaagcaatgtctttctggtaacttaatagtaagcctgaaaacaattaatctttaatgagcagttaatattgtccttgacaagaattcactagtgtgttatcgaagtatattattatatatgtattacatacataatttcatattacatatgtatcattttaaacaatgttattatgtgttgggccaaccttttggacaattttcctttactccactggtctacaaaaaagact

SEQ ID NO: 131125 - DNA, 1064 bp, Homo sapiens
tctttttccaggtgcatgcctttgatttcttgagatgatgaaaaaaaaaaaaaaaagagagagagagagagagaaaagaaaaacaacaaaaacctctttattttgtaaagttttgtttgtggacctagaattgaataaaagccaacatttgtcctgcactcatgtgtcggatgtcctctaagcatcttacattcatgaatttgcttaatttgcaccattcaatgaggtagataccattgtcatctccattttatacattagaaagctaatatatgggggaggttaactggattgcccagggtcacaaaacagcaagagtggatccaagtaactactgcattagactgcccttcgctacactataaattctcagtctgttggtttaagctatcgtatgaagatgactagtcacaatgatttttctgccccagtaactgatagattgtctgcaaagatctcttcaccatctttcctgggcactggagttgcttgggagctatcttgttccttgagagccagttgttatcacccagggtattgttgagactttgagagtaagatcatatttcctcagaataccttcattatgaatttcattcatttctggccataagccttgctctgttgacacaagaatgatatacgttaaattttggttagtagctacctgttggaaagtagaaagatgaaaggtgttgaagataggtaaacaggaagcttccactcattggttctgggtttggtttgtttgtacttgtgttgtttgttctttttttaaggttggaatttgttagattttactttcgttatattatttttatttgtcttcaaaataattcccaattttaaaaatttaaggaaagtaaaatagaactggatgtataggcaatcaaagacagcctttaatcttagcttgaaacaaaaatagtctgatttttactcctagatgaggtttttagaaattagtttctcaatgtagaactcagaaagaaaacttcataatatgtttcaacttaaaaggcctttagaaaccaactaaattgaagaaatctgaggcacagaaa

SEQ ID NO: 131126 - DNA, 2126 bp, Homo sapiens
gcttcctttaaagagcatcctccattcacacctcagtaccactgatttctttccaacacagtgttcctggagcatttttaaatcattgagtgggttttgccataaagcttacatttgccacttgccttccacaggccagagctgcttttttaagcaggaaaggaaaaggacactgccacttcatatgacagaatcaagtaacttgtaaattggaatgcattttttttttggttcgcaatttccccaaattttaaataaatcagtgtgctccttccctttacataaatgatttttgtgagaaacaagaagctgttctaagaataacattcaaaatttctttaagaaaattcaaaccttgcttccaaaacaggcctatggtgagatcgtaccaaccattacaggataagattacaaagagaaaattatttttattccattctgaggggatgtctattaaagtagcgcataatttccagagcagttctcttgagattaactttttttttttaatggcaaaatgaagcaatgtaacataatgcaaatcacactaccattacaaaaaggaaattaaagttgggagaatctgtcaaaatattatgaaagttgaggagttaaagtttattgctttatttttagaatttgcaaaggtgttccactgcagaaatgcctctgggcatttgtaaaatgggagggacatgaaaagagcagtccctactcaaatggctgtgtgttaattgagctctttgccccgccccccttctcttttatcctgctccctccttaccctgaaatccctagtatttctagatccacagccagtttgtgtcttaatgggctttgtgatttcagaagtttccttcgacataagctcttcggcatactaattgtttctcatggagaaactatactgtgtttcattccaagcccttcttcactttactgtagagtttgcattaaagtttcagaaatacaatcaagctctctctacatttagggaaaggaaataaagcacttgcctcaattacatttgtcaacaatttccttttctgaatatgctatgacagagtttatgatattatagaattatgtttcccctttaacctttcagtcaaactgttgataccagtttctttaaaaaatatataattagtgctatcatccagttttttgtttgcttcgcctatggcatcagagaggaatgagttaatccatttgaaaaaattgttttaagttaagctgaagtttttttagccaccactttccttctctcccatgttgattactgaagccggattataattgatacattaaatgtaaaatattgaggcgataatatatagaacgtttatggttttagcagttggaggtttctggattgaatttgaatgcacaagcagagtttgagctaccgtgaccttgttactacctgcatttgtacaggaatccttcatgatctagattgacaagcagtgaatctctactttcaagttcaataagcctctcttttattgttttttaaaatacatatttaattttaaattttcctatagataacagagactccaattaattttacaagttattgctgctttctgagattataatagatgtgagctgttataagctaaaatgagccctcatatttaagtggattttgtaaatgagagcccagcatttctgtcatattcagttcttatggataaaatgaaagatcatacttttgcacagaaattaggtctgctctaggataatagtgcagtgattcagttccttctcaagtgttcagacttaataatattacctaggacagtatatgtatcttttcaatggatagaccaatgggtgtatttaagagaattttataggtcaatgaacgtacataagagaatacaacagacttacttattttttatataaatttaaggcctgggaacttcaagtacttaaaattcaaagctctgtccctagtgttttggaatttctctttactacctaaaatgttgcctttgatgtttcctgttggccaaggcagagagtgaaatgtaatataaagctttatatgaaaaattgtaataatatgtttaaggacacatttttgatgctagaactatgtggaattgatttct

SEQ ID NO: 131127 - DNA, 1634 bp, Homo sapiens
gacatggaaatattcatgctgatttcagtaatagccttttatgaaattaattgagagatttacttttccagacactttcaaacaagctggactgtagtcaatgggtagcattgatatggcatagtggttggttttaaaaaaacaaaccaggctgggcacggtggctcacccttgtaatcccagcactttgggaggctaaagtgggcagatcacctgagttcaggagttcaagaccagcctggccaacatggtgaaaccccgtctctactaaaaatacaaaaattagccaggtttggtggcggaagcctgatttagggtatctggtggaagctacttgggagcttccagctacttgggaggctgaggcaggagaatcacttgaacccgggaggtggaagttgcagtgagctgggatcacgccactgcactcgagcctgggtgacagagccagactccatctcaaaaaaaacaaaaacaaaaaaacctgactgtagcccattgaatattctttgagaagaagcaattatatgattgtggctcattcattgtggcattatggcaaagccatagctcaaaaaaaaattccttatttacccatttactaaagataacaccaggttctgtcttcttagcaccagttaatgatgttctagttaatttgtaacttgcacagtatctgttcatgctattgctgccaaacatattgcagatcaaggagcctgttatgcaactgtgaataagaatcttaggccacttcacactgtttcatcttgtcaattgggagttttgtttggttcagcatgtgtgtgtgtatgtttttgtttttgtttttgttttgagacagggtcttactctgtcacccagactggaatgcagtgacaagataatggcttactgcagcctcaacctcccaggctcaagcaatcctctggttgagcctacgaagtagctggtaccacaggtgtgtaccaccatgcctggatatttttaaattagttttgtagagacaggggtttatctatgttgcccagactggtctcaaactcctggcctcatatgatctcttgtcctcagttccccaaagtgtggggattacaggagtgagccaccatgcctggccttaaattctgatggcttttaggcaaacaagtaatgtactatgtatatccctttttcaaaatgtattatgagttctgtagcttataattgcttcctgtgtgcatatatgctttgtggaggattggagaaaacatcagtataacaagcagttcacttgtttctcgaaatgctgtgctggtgaattagtcactctgttctactcttcaggttttttgtgtgtgtgtctgccattgaggagtataaaacttttttcaaagtcgtttacatttggctttggcaagggttttaattgttcattggagagtatctgtaacctgaaaattcttgagacacggtaaccacagagttaatatgtgactcacaaaaggctggaaactgcctactttttccatcctgtccctctcatcagttttgcttccactttattctgggagttaatttttatcaaccttcacacagaagtactatttgtttgttcatatatgcaagggaaattatttttattcctaaagcat

SEQ ID NO: 131128 - DNA, 1050 bp, Homo sapiens
cttaaacaaatagaaagtatattttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaagaaagtatattttctgaacacctctttttggtaaagcatgttgtatatttgataatttacaatttagtttgctgttttcttttgttctttgttgcttactttctgtgcttcaagtttattgaacttcaagtttattgagctagaacttatcacagatggtaaatgtggaaaatgtgatggatgtagaactcctcccacataggagtgaaatgggagactacttttgttttgtaattgatagtatgaagccttacatggactatcttcaatatgcattcattacatgatacattcctggtattaaattgtaatcgtcgagatagcactgctaaacgagatagcactgctaaagtttatgtctgtggtttactatttagtataattattcttagcttaataagctttctgtactattaaatgaaataatggaatctcagattaacatttctttaaaaaaattgtattcagcatattaccatacatttactgagactgaactgctttcttttcaattttcgtgaaacttaaatggcttccgtttttctgtgcagtaaattaaaggtgcttacacagttatgatagtttccaagaagaatttcaaattggcatcaactaattgcagtagcaagtgatccaggttttacaaggaaggaaaatgtgaaagaagcatgtctgagtataattttgttcctgataacaaatatatata

SEQ ID NO: 131129 - DNA, 1059 bp, Homo sapiens
tgttggagtttctaatcagctgtgaagaaatcatgggataatagtttagaaattcctacaagatgctgtggtagaaggtaaagatacaggagcacttctagacacttgagagcctctaccagttgtgaaggaaccctgctagtccagagctaatggtgcatgtatccttaaatattacaataggacattggtactactggcacacctataattgttttatgctgaaaaaatacatttcttatgctcttgtcactttctgtctatgacatatttgtttattataaatgtattattcttccaagtgtcatgttctctcatattatattactttttttctaattccatatctagaagtgataacacacaggtatttctgtgtcacatttctcacttaattcattcaaatgtttcaaatttttttattcccacttttttaaatgataggatgtggatgaagaggatactgtgccaaccaacctcgtgttattaactgtgtttctgtaatgaaggctataaaattgaagtgtaatttatgatatgatttttagataatggctataattattgttgtttttgagaaatgcagacatacgaaggagatagagaataagtaattatatatgagtgttaagtgcattttcagaattggagggcgatattctttattccttgttaagcctttggaaatcaaaagcatggttgtatcagttgtggctctgaatatttttatggttctgtcttttgcttgatcatgttggtccttttgagattcaaacatttataaaaattcataattttgtgcaaatattgaggacctaaaattgcaaagtctatataaaccaagagctgcttgctggttaggcagaaaccaaatttcctcctagctctgccttgcattttcaatcagaattacttgtttgttacaatatgattttcttcaaaaatagatgctctgaggcaaaaggcgagccacaggctatatgttgaatagaaggttgattagttggccgaacttcaggagtgggagcctgaagccatgcttcctagggaaataactcc

SEQ ID NO: 131130 - DNA, 1367 bp, Homo sapiens
tgtaaaaaaaaattaatttacttacttataactgtaagactttgtacagccaaaattgacctatatgtttagttaggattcagtgaaatccatttgcatatgtaggttaaatttcaccttatacatcaccaaactgcagcaagctaggactttaaacaactaaacatacacatattaattcttatttgaaatgatttgtttttgccctcattgaatgaatggttagttgctattaaaagatattattcaaagagcaaagctaatgacctgattttaaagaatggttcaccaaaatagatcaacttgcagtcctgactgagtccccagtttatactcaatctgggatcacttcccccaacatccacgttatctcaaggattcttttcctcctctgtacttccttagcattttgcaagggacaggtggaagccatgtcctattctgccctgtattctgttcatttgtaccattatactgtcttcctaaacttaccgaaattttccaagaactgttttccttcactacattcttcactgtgcctttgcattaccttatctcacagggtactcagtagaaatcttcataatcgaaggctgaagccaaaagtttggtatttgagttataccaagatattttagaaaaactcagaggggggaaaaacagatgactgtctcagcagatatacttatccaggtttccactgtgttcctgaaagcagttctaaacatagtcaatctctgtttctcaaatagttatcctctttatttgagatgagcagacaggagcttcttcaaacactgaaagtagttgctcagatttcagaatgaatagaattctcataatagtttttatgccctagttttttgatgatctggtacagttagatgaggctctctagtgtttgaatcatgaaacaatatcacttcacttccatcatattctaagcccttgtgatagttaaggacaagtaaaaaatataattactctgtatgggttttgttgcagaagagtgggggggggttgatttttatagtaaagtgagggatctataagccaagttataacctctgtttgttagcactacaaaagttttgagacagtttgaaatttaaactcaatgcatttgatgaatagtacttggctagtttgcgtttgcttcttaatttcattaatttttggtggcaaccagcctttacaacagctatttataaacctgaaatatctgatctgtaaacgggcaaacaagtcaaatctgtgtatatcttatttgccaaaccgttacatttttctgcatatttcatcacttttacttgaaaatgggcttgtagaaagataaacagcatatttacaggaaagaaaaggcaaat

SEQ ID NO: 131131 - DNA, 1047 bp, Homo sapiens
ggagaattcatttccttgcatccatagaactgaggtccccattttccttgtagctgttggccggagaccactgtcaagcccctatgggcagttcccatgtggccctcatagatgtgtgctttctttcaggccaggtgatgcacgtctctctgacttcctcttctgagaccagccaaacaaaactcagggcttgtgtgtgtatatcaagcccaattggataacctcctgttgtaaggtcaactatttgggacctaaatttcatctgtcaaagcccttcagaacaggtcctagatcagtgttattgaataactgagagaaagtgtatgtacaggaggacccaggaatcttggaggtcatcttacagttctgcctactacaaggagctgcagtatccataactgcaaaaagaaatgtagttttagagctaatgcctcaggacaactgattctccaagactggtggtggaagaacattgtgttcttcattcaagaactacttctggaaaatttcctgaagtgcatcaagcactattgtagcagtttttaaatgttcagtcaatgagataaaattggaaaattagtatggcatcttacccctactgtcagattttgaaaatagcattgtaggacatcacattaattggtgtgatttccaggaaaaaagtcatttttgaagctcttttagatgaagctgaccttctcagaaagaatacttttataataacattgctaaacagataacaaaccctaaatatcaaagcaagaaactaaagaagtgaaaggaagcaggacaaaggacaactgactttgtgtccttatttgcctcttgaaggatgtgttagagaagtcttcagcatctaagtactatagctattacttctatcatggggacatgatatttgacttgcctctctcagataaaatttggaaatatgaaatattaaagatttaaacttttttgaatctttaatattagattctgaaattgaatatatattagtcatattatgatattgtgtttacctgtattttgtctaacagatttttt

SEQ ID NO: 131132 - DNA, 1073 bp, Homo sapiens
ctgccaaaagccactctttgctttgaaattcaaacataatgtggcctcagagcattataattcatgatcttttgatacaaataaatgaaaacaaaatgtacactctttaattaatgtttaaaaatccaactctttattagtaaaccaagaaatatgtgattgctgaaccaaattctgccagacaatggtatgctataaaatttttaactgggaaagatttcatactgcacgaaaaattctgtggtttttttctgcaaagcagagtaaaaaaagaaaacagtaacaacactatttttccttaaaagcttgttgttttttaagattgggattcagtcccagtctttgttttggtttggtataatgggagtaactggacaatgtggctacacaaaaatgaaataagacaatatgttcccatatgcagtgataaagcaagctgacattttattggtgtctcatatagtgtatgtttctaagtgaaagtgtatataccatgtaattcacttgagatcaggtatgtattccattttgcataagaatgggggcaggatgtggaggatgagaaggccaaattaagtcatatagattatttttcagtagacaaaaaggtgttattataatggagtgggagtttaaaagtcataagagctatactacttattagacaaaatttttttaaaatagaagtaactgcagcctgctaaaatgttacatactttttatgagaacgttttgaaagtattgaactatattaatacataacctcatttataatgtcactgtttatatgagctgattattttaactctaaattatccaagtgtctattttatccttatatatctgttttctgccttttagtatgaattctccaatattatcttgagtgagaagggaaaatgtggtctctaaaagattctagagaagctctttgaaaaatgtctggtttgttttttttgttttttggtttttgtttttgacggaatctcactctgttgcgaggctggagtgcagtggtgcgatctcagctcactgcaacctccacctcctggattcaagtaattctcctgcct

SEQ ID NO: 131133 - DNA, 1594 bp, Homo sapiens
tcataaaaatttatattaactcgtttgtatttggattcattcaaatacagattgaatgaatctgaacctgtcattggtttggttaacttattatctagatacttatcattgtgtaatgattccagtggccttgttgctaacaggttctcagcaacaggcggttgagggtgggcagcagtatcaggcttgcttgcttgcttgctttctctctctctctttctttctttcattcttcctttctttctttcttctttctttcttcctttctttctttcctttctttcctttcttttctaccaggtctcgctcatggctcactgcatcctggaaatcctgggcttaagtaatctcaaacaatcctccctcttctcttcgacctcctgagtagtggggactacaggcatacgccagcacactccactaagtttaccatgattccttctggtagcactgatgggaagactctcaggtttaagccaaagctaaaaagacaaaaaagcaagccaattacacttcaggatggaatgggtaatgatctaatgcgctaacaccctgtacatattgccacttctctttccattggaatatcttggaatttaaatcccatgtaaataaatgcaaaaactcccttatttggagttttatctggcaacatcagctacctgtgatattctgaaagaggaaaagacaaagacaaaggtctcctcaaacgtaatagtgaataacaaagctacaaaagagggaaattggaatcgtctttaacaaagtctaattattacaaggtaaagggtttagatgtctcctttgtttgtctcccagttagcacctcagaaggggagtagagaattgttaccataaactgacatcctgagtacaaaattgaagaattttctgaaaaatcacaattcagaatatatgtccctcccagtattttgttgttgatgttgtttggtccttcatcccgtgtgtttcgataattgtagaaatagaatattataaatgcagagaatcttttgagttgtgtattcaaagagctgtcatctctcctggatttaatctgaataaaggagtgatcgctttcaaatttataaaataataaaccagcctccaaaattctgggaaaacatttttctagtccttgatattaacttaaaggtaagattcttaagaagataatcactgtttcaaatttcaagagatgaattctgtggtctaagacaatcgaattctttgggctgatacacctgtgaatgttagcaataacaataacagacaaaaggaatgacagcagaaaggtagacgattactgagacacaatataaaagatcgaaatgtattggttattgtactaagtttatagctgcttctagtgtaattatgaatttataatatagaattccaaattattagaacattattcattagccctattaagaaaaagttatttttgcaagcatgcaaaattacatgtattacatgcatatgtgtgtatatagtagattgtgtatggattttaaggtgtggattataattttcaaagaactttaatacatataatggcataattaactatatatctttatccccttataat

SEQ ID NO: 131134 - DNA, 1870 bp, Homo sapiens
accctttttgaagatgtctaataattcaagcatcaccctgctcaattgaactaaaaatttggattgtgtagaatttcatttgaacagtagaattttgtttgaacagtatgataagctcattaaaatctatcacttgtgtgtaacctgatcctctggttaattccatgtgttttcctatggccttttagttctgcaaaagactgggcttgtaaagactttgatttcatttttttttttaacagatgatagcaaaagatatttagtacctagaaaggtaaactaatcctattttcatgtgcagtcaccctctagtgtaaataagtagttttcagtcttcaaatggaaaacattccaatgtcaaattctttaggaataggaataggaaaaaggattctgatgcagtgagtggctaatttatatatgatataaatttatatataatttaaatatatatatatatatttttttcctcctttctgccataatttggcttctccttttctgacataagatctatcagactatagtacaggtttcagcacagaagtaaataacagcatgtttccttgggagcaattgaacaacagaatgaaacagtgcttactgttttttgaaagttgtgtcagattgtcatggtaatacagagttgcatcatgttgtcatagtaaccagaattataaaacgaatttaaagaggatgaagagataccttgtgattcctttagctttaaagattttgttctaccgctacttctgtttattttgcttcctttttgcaaaatgtgtcacactgctatttttttaaaagtagccatggtacatcctctgcatggctagagggaatgatggaaatctttacttcttcccaaatgaagagttgaagcatcaaagtttaagtcatcccattctctttgagccaggtaaaattcagggtcaggagcacatcagatacactgctgtgtcaaaacatgccaactctgagcagggaggaagttccactccgagtgggatgaaaaggtatttcacctttcttaatgatgattcatagcttttctttcaagcgaaaaacatcctaatcttactttgaaggaaaagcagtattaagctttgggagccgattcatcgaactgtatcagaattggggtaatattgttttttctctttaattagaatgatttaggtcattataattcatcaagaggttaaaatgtgacccttgaggtgaaaaactaatttcaaggctaaaccatttctattattccatgagagagaaagagagaaaaaaataggcttacaagtaagttgagactttcgttgctggagcgcatccaataactaattctacaaataataatgactgaagaaaaataaatttgtcaactttgaagtcttgctaaaatcaattgttttaaatattctttctcttagctcctaccctcttggcgtaagcaatttgctttcgttctttttgttgctacattgcctcctctcgacttgctttttaacaaacgctttaagagccatgcaagttgcagcaagtttcaggcattaatagtggccaggtagtataatactatttttaatgaatgcctgttttctattctttactgtgctttctttggaaagaggcccacgaaacaaagtattaagaaaacacaccgctgccctggaatgtgtgtattagctgcagattatttcctattagcagattagctgcaaggctattggctcagaaaggtctttgagagtattttgttttgtaactgattcaagccatgggagaaaattgccaccatgattggaaagaagaattagctactgttgccatggacactggagttcacagtcccattgttaaatctagggcttca

SEQ ID NO: 131135 - DNA, 1050 bp, Homo sapiens
ttttgtagagatgggggttttgtcatgtttgcccagctggtctcaaactcctgggctcaagtgatccaccagcttggcctcccaaagtgctgggatgacaggcgtgagccaccacacccagcctataatttcttttgtaactttattggtatggtaaggcagtagtgcccattgttctgcctatattacacctgtccattgtttttcgagttcttttgttggcctcttacagttttctaatcttcctcgtcatttgactaatatttctccattcctgatgttgttaaatgaccttacctactcctctcctttttggatgcctctaatctgctgaggacttcaaaaccagaaattttaatatcacaagaatgcacctgattggtatatgcccacaatcaaaacccaggcatatgaacaatgccctttacaaaggcttattgatgtaacataattttaatctctgctatttttgtgtcatatataatgtcaaaaattgggcaagtagagggtctgccctttgaaactgagcagcatgaatcagaaaagctactcagatcacaaggatgttccctaaacaaaactggtagaattatccctttccactttcaatcatgtctctatttttcttttgtgtaatttcctgtttttcagaagaattagaacttgagcacctggagcccatttctggacttgatataagccccaaatatgataagggagtggaggaaatagatgtttcccaaggctggggtcccaaacccccaagccatggacccgtaccagtctgtggcctgttaggaactgggccacacagcaggtgagaggctgttgagggagcatgatggcccgagctccgcctcctatcagatcagcaactgccttagattcgcataggagagtaaaccctattgtgaacttcgcatgaaaaggatctaggttgcacgctccttattagaatctaactaatgcctgatgatctgaggaggaacagtttcatccccaaaccatacccctcatctgtggaaaaattgtcttccacaaaacctgtcc

SEQ ID NO: 131136 - DNA, 1024 bp, Homo sapiens
tcaagaatagatgccatcgctggactatattgtcattaaaaccaagttcaggtcgggcgcggtggctcctgcctataatcctagcactttgggaggccgaggcgggcagattacaaggtcaggagatcgagaccatctggctaacacggtgaaaccctgtctctactaaaaacacacacaaaaaaattagccaggcatggtggcaggcgcctgtagtcccagctactcgggaggctgaggcaagagaatggcgtgaacccgggaggcggagcttgcagtgagctgagatcacagcacagtactccagcctgggtgactgaaaacctattccatgttcttcacacatcaagtgataaactggcaacaatgtttaaaaatattgtttctatgtctttagaaattttctgaaggtacagttgttcagggtgaagatttttacagaattcagtaaggatggattataatatgctgaacatttggttgcttttgtaataatagaggtggacagctgagacaaatctagacaaaatcttacactgactgttttgtaacgacatacgaatgaccctgaactttttaagtaacttaagaaataggccgggcacggtgcctcacacctgtaatcccagcactttgggaggccaaggcgggtagatcacaaggtcaggagttcgagaccagcctggccaacgtggtgaaaccccatctctactaaaattacaaaaattggccgggcgtggtgctgcgtgcctataatcccagctacttgggaggctgaggcaggaggattgcttaaacctgggaggcaaaggttccagtgagttgagatcatgccactgcacaacagcctaggtgatagagcgagatcgcgtcttggaaaaaaggaaagaaaagaaaagttagctgaccactcttcagaaataatactagaaaagaaaagaaaagaaaagaaaagaaaagaaagaaagaaagaaagaaagaaagaaagaaagaaagaaagaaagaaatttagcacttttccaga

SEQ ID NO: 131137 - DNA, 2367 bp, Homo sapiens
gaaataatctgaactttattttgtagggagtaagaatcacagctcctggtctttgttccacccatgtatcattctataattgatttgcaaatatagaatttgcaaccatttgtggacaatggttgtttttatagtagtcccccaaacactctagagtttctggactcattgtgcctagttctcattccccttggccttggacatctacaagacaggctaaaaacacactaaatatatttttaaatagtctaagtaagatgtaatacatttctgaagttggagtgttgtagtggaattgaagccaaagcacttggtaaccaattggatgccagtaggaaatgagaaggtttagggaataaaacaagaatacaaggaagttaacctgccttcccaagactgtaagcaagttgtatgggaagtatgtagaattcagttgagcaatctaatgaaacacacatttggggatttcacgtgtgcccttggaaaaatatgtaagttattgtctataataataagagtgcataattttcgttcacagtcacaatgataccaaataaggggataacatggttttcaatgaagtaacaatttgatggtttgaattataccattaccatattaagaaaggactgttcattcttttctatcagctcataaataactccaggatcaatcaagatgatgacaaaatgtgtattgcatactggtttgcatctttgttaatacatgaatacatgttgctgtctttcaaagttatttttaaactcttagttttgtaaacattcattataatttttccaaagtcaagggaacttcatgaaatctggcctagccttctaattttttagataaaacagaattttattgtatattcaatttggagattaggctctaacctaccctatatttggctctgtttcaggatatttaaatttctttcattgtaatttttgttcctgtatttttaataattctggtatttttcttaaaatgtagaaaacaaatcaagatagccttacccaatttatgcctagtcttaaactttttctttttactattggtaaaaagtgtttttgtttttattttttgacagctagccctggacagtggttcaattttatggtaattcgcgtacattggtgtggcatctttaagtagtatcattcttttttttttttttgagacagagtcttgctctgtctcccgggctggggctggaatgcagtggtgcgatctcggctcactgcaagctctgcctcctgggttcatgccattctcctgcctcagcctcccaagtagctgggaatacaagcgcccgccaccacgcccaggtaattttttgtagaagtggggtttcatcgtgttagccaggatggtctcgatctcctgacctggagatttgcctgcctcagcctcccaaagtgctgggattacaggcgtgagccaccacacgcagcctaagtgtgattcttaaaagtattttacctacagagagagaaacaccatcaagtagggcttatcagtaggttgtgtaccaagaaagtttgactctttctgggtctttgtattgaaaatttattataaaaataatttgtcaaaaaattcccactgtgcctggtaatgaatattccctttattaaatattaaatacatgagatgccatttcaaaataatgtgtatgcatgtatgtgtgtatgtgtataaatagtctaagcatgatgaattggctggctatttttaacagtttcaccgccaccacttcctgattgtccctagctggctctttggcactcacacaattcacatactgcttgttaagtacctactgtgggccaaataccgtgtatcatttctagataatcttatttcagctttggattttggtgtttgcatggatactttgtaagctgtcatagccgatagcctttaggtgttttgaaacctacagtcttacaaatgtccacatttctgtactggtagcttctcttttcataaccctatgtttgcctggatcctgcatcaaagaaataaggggagggaattgataattggaggtaataagcctttcagtattctagtgtttgaagttaaggcttattagggctcaagtattcaaggttttctcatctgttttaagcaattggattctattatttgttggccttctctatctttgatgcctgtacttaagaaaaccaaaactgtaactcagagaagagtgtcatgacttaattgatcttgccctgatcttgagactgtattttgttctgttaagaaaaaaaggcgattcaaatctgcagcatatcaaggttgtgcctgtaatcttcctgatgattcatttttagctcacttttaaaccatatagga

SEQ ID NO: 131138 - DNA, 1835 bp, Homo sapiens
ctgattttttattttatgttctgcttttttattttagacaggcaagttgttagcatttttttcaaggaacaaagaacaaaaattatcttgataagaacttgtttctgaaaagctagattagctcttctctgcacaccaatcatgcaatgacagtacaatttagtgacttaagcagtacattaggattctcagcctaggcagaagcttcaccctcgggccagacctatataatagttgtaagaaaatgatttatgtgttgtaataaatgttacttctcaatctgtttgcttgttcaatggttgaggtcccaaaagaaaaggtctatctcaaattaggactggcatgtattatctgtcaactttatatagtactgtaaaagtcattcagctgacagtaatattagcggaatgttttatagatttttgtactgtgtgaagctttgtatgggtgacgagagactttgggtctgtggtgctctgtggtccgggataaagttgcgtgtagatgagtcgtttctgtgcttctctgtaaatgaacatctggctcacatattgattccatgtgtgaaaatgagatcagcccatataatgaccagaatcaatcaggcttcagccgaggagtaacatacactggtcttgatttgttagacaaccagaattggcagcaccttgcataatttggcaccaattgacaaagattaggctgtttggggaccctgaatggttattaatttgaaaaccccttatatattttgcagagtaaaatcagctgtaacttatttgttccagcccccttcttctcgtacgagccctaattgttttagacaaacgaacgagcttgcagcctgttcactttacacaggaagacatgaattctttgatccatacagtattctttagctcaaccttggagctatttactgaggagatttatttgcagacagacagtagaacagttctttgtgaatagaaatgagtacagcttctatgtgttttcagctcaagtttctgctacttactgtaagggagataaaactaagccatctttatttttaacccaaatcattcttttttaaaatatagttttaaaaactgaaaatgaattagactcttgacctttttactttttcctcacaagttatatttactagagcacagattgaactcagagaatgaccaaataccatttcttattttgtgaattgtgttaatcatgaagaaaaacttgtgagattttaaaatgggacaggcgttgattgtgaacattttacaaatgtgtctcactccttaattccaggcacaaataaaactacctgtgttgtatgaacactagttagttcaagaaaagcaataaaaatctacttttaaaaattattactgccaagtagttttaaagatacagactcatttactttgaatttaactagtaatatttaggtaagtatctaaaccaatatttaattttttcaccaattaaatgagagttattggaacagtctctctaaatgctttatatatatgagccaggcaatgtaatagtaacaataacaagatagtttcataactaagcctttctataatgccataagatatgaactccattaggactgtttgatttctacttgacacagaagagaaaaaaaaatgatgagtttgattaacaaaatcagttctagaagtgaatttcaattctcaattatatttgacaataaattactcaaccgtagtcatctcagagcttaatttgctgagcctcttgataaccagtatatgaaaagtcacccccatgtttttttttcctgcatgtttttttaccccattttttcccctacaaat

SEQ ID NO: 131139 - DNA, 1050 bp, Homo sapiens
tggatcaacttctttcaaacttccctagtgcaaattctggtttggttacttttcttttctgtaaaatgataagaacattaattagtcttgaaggaaccatttactgcattgcagatgattagaaaattgacaataccaacaaaaattgaattggattctttaggtttaatatttggcctaaactaacatatttcacctgccatgtgccacactcactgattattcctgagatattcaccaaacccttccccacacttggcagtgagttcattaatgacaggtatttattttttatctgtctccatagcctcaacacttaataacattcctagcacttaacagatgttccataaatgatgattaaatgaataaatagaagcctagtgtgattcccagctttgcctggaataggtcctgctccaataggaactcttatacctctttaaagagataaggagttcggcttcagggaaaacaccttgtagactccatttatcattacttttctaggttgttgtcatacaggaaaaaagaaatgatctgacacatttctttccagccttacacactaatacagtataaggagccacagagaggaattttaagattttttttaagggagagtatttgattggccaagatgtttgtttaattcaagagaaggaaagccccaaatgctgcctaaacataaactcacaattcaaaacattttagaaattatctggcaactttacatagagtccaaatgtttccagggtatgcagaaagatgccccaaagtcttaagtacccccagggaaagtagatcaaagtttagagaccatttagactcacttccaaaaggatctggcctcagagttttgcagtagtgagcaaaaattctagaaaggtctaggttcagaaaccatagcaaagttacaagagaaaggttttctagcttctgtttcttatgccattcaacaagatttagaaggaaatgcagccaaatttaatggtcgttacctgatgaaaaacagacatcctttggattatcctcaagcagaactgaaca

SEQ ID NO: 131140 - DNA, 1536 bp, Homo sapiens
aatgacatacacacccaataacagggagcgttggtcatttttgcatggaccaaaacaaaattgaagaagtactgctgatcaaaggccaatacaatgcacacatatcattctggttaggttgtctcctgagaaaaatatttctcagcagcagtatgatttattttgaacaatatctgattgaacagcattctagtaatgtagaaaatttatagacatctactaaattttattctagcagataatccacattaaaagagacaaaagtccatgttttacctagaacctctctgtggctccttttctccaccagaaagacaataatttcatatctggcagaagttaatgctttttaagttcttgacgtgtatactctgtggaagaagtgacctaaaaggaaaaccaaatagtttgataaaggataactgtaaagaacaaaaaaagtaaaacaaactactataagactaatagtccttgagacaagcgcatgaattagtgatgaagtattgctttactacatcctgaaaattctttacatttatttcttcagttgaatgaagctttctaatatctgtgtctggaactaattctgataaccttggcattcaaaatggagataaaggatagatagccttccacaaaacgcttcagtatggcaagaagaatcatctaatattgacaaataaagcaacgtgacatctgtgttgaattccaaattgacttgttgagctgtgcaaaaaagtaaaagaaggtgcttattttcaggatgtgaaatacattgggaaaagccaaggtcaaagatgaaacatgactcaatgccaaagattttcaatcttaatgaaaatctctttcaataagaaattgacgattgagaaacagtgtcattgttagaagttcgatgttcttttgggggtctaacagacgaagccccagagaactgacttttattaatagatagcttaagatttatagcttaggaagaacagattaatagtttttggagtaaagcctgaattatagaaggatgacctgagccctggcatgagtgatcaatcagttcagtgtctgcaactgcacaattttaagaactcttaaaaggctctttggccactgaaaatgcattataaaggataagtccataaccagccaagtctggaatatatgtttatatggctatacagatccagtgtttctttaaaaataaagcaaagggtatgacacaggttggtttgctgttacttaggatatgtacgattgaattgagcctaagataagtgggatgtactgggtaaaatgtggatgctggaggaggatgcacagaggctaatttgaatccaggagatttttccatttaggaaatagaattggagtcagggaagtaaaaatcttgaatacaaagctaagaaattgaattttccttgttaatcagggttcaaccattgatgtttacaaatgagaaaaatgtttcatgcaggttaatcctactgcaatattggcaggaaaggtggaggtcagcgggaagagacctctggaaacctg

SEQ ID NO: 131141 - DNA, 1063 bp, Homo sapiens
catgaagcataattttctatttttcacattcattttagagggaagaatgatacagttatttctagaaatagttgtctaagaacaatgaatttcttctctttatgatagggtccattttaaattatgttcatttatgtccaattcttgaagaaataaggccaagctttgaatttatagtccgcaaattttcttttttaaaaacaaactagttcctaaggaatgcagatttttttaaaaggcaaccaaaacctaaaaaacttctctccttttttgtcctcttattgcttaaaaaagtacatgaacatactgtttttaaatttaggcttttaaaaaattgtcctcatgctgagttcttgtttgccaagtttcagcttggagagaatttttatagcttttataaaaccctgaaaatagaaaattttaaatggaaatgcttacacacccttagtgacagccacaaatcttgccactttttgagaatgaaggtaattttttagtatttagggatggtagcaacacgttgatgcgatagtttctaaaggacagagcttttgtttagtcgtatgttagatatgttacattggtttatcatattaagattcatattaagatttagctgtatgttcatacatttcgtatgtgatataaaagttttaaattttagagtgcatttgtcctctaccacatatagtttatatgtagaaatatgtcttatccatctttttgatatgtcacctattatttaacttgactagcaatttaacttgcaagcgattcaccctagaagttagatttattgtagttgaataaactgttgtcctctcacttttatcatataaaccaaagggtcagttgccctttggggaaacccagaatatgtcagatctttgtcaggtcgctgtgggtctttgtcaggtcccaactctgtcacagggattttaggcaactagaaccacaggtgtcacttccaaaattgatagcttgttatactgcaaccagagtcaattttagattggagaagagaaagaaaaagatcggaaatgattgaagctgtgggcaccaa

SEQ ID NO: 131142 - DNA, 1050 bp, Homo sapiens
ttggcatttgatttatatttcatggcaaaatgcacaggtttgggtaatctcaggttcttaaattctttccacattaaatagtgagctaattctaacttttttactgtacttcttcgtgttactgcattaggtttttgaatctgcttggatgactcccgaagagcagtttagtctttgagaaaaccagatctccattgcttccatgaagatcttattaatatttagataatggagagtaacgaaaagaatttggacattgaatatgtctttgtcttctagctatcattctccccaacttaatctgtgaccctgagaaagttacttcatttctcttgagtcctcaacaaatttttcttacacagtatatgccatcttaattatcttaagtatgtacttgatcatctctagaggttcctttctagtcttaggttgtaatagtctttgtcatactggaaaaacatttttaaaaaccatcaaaatgtattctttttttctacactggaattgacatatggcactataaagatcttgtgatggtagaagtcatacatttgaacatgagaatattaatgacagcttgtaaccacagtatttcttatcctattctaagaaataattttagttattaagctggttttttttggtatgtcttgagtttatttgaacgattgaagtatttggaattgcgtcatgtaatagttcactgcaaaattaaagtaatttgtatgaatgagaaatggaatcagtatggtaaactcatttcattgtgcaaaatatcttttgcatggaaggcttagttctattaataattcaaggaaatttttaaaataattcattatacattaaaaaaactactaagtgtgctaacatcttgggatagactacggggtaagaaagaaaagagaatatggactctccatttaattatatgttattatctaataaaacgaatatatgcctttatctaataaaagaggtatagtgatattactcccattttccaggtatcaaaatggagacatagagtgattatgaaacattacacagctg

SEQ ID NO: 131143 - DNA, 3350 bp, Homo sapiens
aatttctgatggtttagtttgacgctggcaaaaggcaatgcagagaaaatatcacctttactcttctaacctctattttaaagtgatcggagctatgccatacagagtttctttaactttaataagtatatccactgtccctaataattttctccatttacactaacatctacaggggttgatgcaattttgtgcaactgaaagcttgtcaaatttggaagctccactttaggaaaaataattcataattttggatatacctttaggacaaaaattaatatttgtgtagaatgagaaaataagtcacagcaaattacggaatttaaattttaacaaataacatagttatcatgaaaacccaggaaaatagcataatatttgtgttcattatctttctgataatctctataatctttttctctcacatttttgtatttttgctttttgatcacctaatcatatgatgagacttttctaatattttctagagtgagaatagtttttgctttagcctggaataataaaagtgtattttttatttttgatgttataggatagtttcctttagctttacaactcattattggtgtgtgatttaaatttatagtattgtcattccatttggaaacacttcccatcaaatttcttacatacatactgtaaggtttggatttgttttcattagctaactaatggctctgtgcattgagcctgttgctctttactaccagaattgtgtagtgctgggcatgtggaagttcttctgggatatgacctctggcccttcatttcctgtcctacactggtggatgtttggaagcctttcctacaccagagcggcttgctgaacatctactggatccagttttagtatgggttcttaaaagttttactacatagttaggtaatagtcaaaattaacacaaatgcaattatcaaacaaacccagtcaaccaggattgaaagtgtcaaacagtgcaacaatcaaggccattctttgtcatgatcaagagcacagagcctggagtcagactgacaaaggtttgagattgatgaaagattgtcaggtgactttttggtctctcctacatagtctggaaatcagaatttggagctttaaactttaacatgggtaggatgccaactatgctttaaagttattttctttgatgcagaaagacataatttttagtatatcataacattaattcacaccattaatctttttttctctgcatattgaatcataggacttcttttcacaacaatttttgttgttataatgttattttaatgttactaattagccctgcagaacccctatgacatcctttggcatcgtctcccatcgtctctctctctctttctctctctctctcattttaataataactgttgtataaaaattgcatgaggaataagttcccaactcccgtgatctgcttataatagctgtactttcttcatatagtcttaagaggcatgtctagtttaagtaccttccagagaaggtgtgtatttatgcaaaacttttcaggggcttgttaaaagtgaagcttttgcatgatttgtataagaaagtaattaggatatctatctaaatgataataagaattcaatgagtacagattggcaattccactttgaagattatggaaagatagagattttatattttaaaacaatttgttaggaatatcaaagcagaaaatattctagatttggatgaacaaccatatattttgtttaaaaagcaagaaattgccccagattacttcttgcattagcaatgtatatatcaaagactccggaaaaggaatttttttttttttaaccactaaccactccttgcaaaaataaggagcattaggactttcctccctaccctttacttttttaattctactaattgttcacacaattataaaatatgtagaagattgttttattatgtttttatctgtttgttcagtgatagtgttatatagtaaaagaacactggtttgggattaagcttaacggtgttttagtctgagcctcaagagactttattcatactctttaacctctataaacctctgcttcctgcactccaaaatgggactaactatactaccttgcctacttctaagtttgctgtgagtatcaaatgacaaaatgtgtatgaaaatgacaagccaatgtgtcatccttgcaattaccatagttggttagaaagatattaagcaacggttaaacttttaaatcctgttttacttgtttttattatgatagagttctttcttctattatttatagagttatatatatgtatcatccgtatccaaactaatattaatgttatggcaacttgtgctttttgagtctttccaaagatttcaacatgattttcataaagcatatcaatttttttcactcacattgtgtgacatcaggttaaaaagttactaacttaaatttcttagaaatattgactagaagaatatataacaatataaaatgtagagacgagtatgaaatatatttaaaactcattacgatactttagttcatttgctatttgtacaaaggaagctcaagtaatttcagtacctatggcaagatttatacattctgtaattagatatcttttaaaacctacggtgataattttcttaaaaattggtcttaaagtaacattgttaacacattggtaataagagtattcattgcctttgttttcttttcccctcattttatatacaattttgttaatgactgtagatttagtggtatatgtggtagctcatgtaatgctctagtatgctcagtttaattatagatttttttaaaaggataattgccaagcttatttgtcctgcacaacatcattgggaatactttaaaaagttttcagggaatcagagaaaaccaaactaaagataatggcctcagaacccaaattatttttactctgtcatgaattttgctaacaaaatcaaaataatgagtactaactgacaaggaccatttaataatctacccagctaaggttagcagtcaatattttacatgatatttcactgataacttatttatcatattttacatgataacttaagattctgtgggtcttaagttatgcatattctcttttattactttaataaatattaaaccacaacatgatgtaattttagcttattactaagtattataagagcacttagaatataactttttacaattaccaaaaattttttaatgtcttatcaacatgaaatacttagtcatttatttagaaagtataagtttattagtggatttactgtgtcctgatttaggtcagttaccttaaaaatacgttcatt

SEQ ID NO: 131144 - DNA, 1319 bp, Homo sapiens
gtacttcacagaagtctaagaactttaattaatagtaaatagcaaagtcaaacacaaatacattcccttaggtaattaaataatccttttgtgagcctgtcaaacagtccctagtgtatattaaaagaacatgccacctacatttttattttttgcctaatttccaagttttgcataatttttcatagcagtgctaacagataaaaataatagatgtcatctttaaaatattcatgttaaaattagttttccaaagcctacataaacaataagtttgactactgagtagattatacttgtcatctagttcatctcccaacaggttaaatggctttaccaagaatctacagcaagttatagggagaagagctgaaagataaatgaggtgagatgagcctggaaaatacccagttttatgttatttcttttttctgtactttaattgctctttagcctgtttctcctgatctcctagggcacaaaatgtatgggtatgtatgcatacagagcattcctggaacttaaacctaaggataactgtgttgaaactgctgacaggataaaaacctcatgtaattaaaactgccaatcacaatcaggacatatattaatgctgttttttttaaagtggttccatgtcatctgttgatgaatttgcaaaacaattatgattacattgacagtgaagaggtatgtatatgaatcagtgtttagaatctagatgcttatttccgtctttgctgaattgaatattttagatggaattaaaagggagctataaattttgcaaagttactgccaaaatatagttacaaattttacaaaaagcatttcttgaaaagcatattctagattattttgtttagcaatttatattttagagttttggaaaaacattatattcaatataattaattcttcttttcttttgaactgtcatagaacttcactctgtaatcttatgtttttagtaaatacagacttaagactttttaatttatttttcttagtttttatttctttccatattgttattaatgttgtttacacaatatgggacaaaaccttttgaatttaaagttataatacagaaaatatttttatgtatcctgtattttctgaccaaataatttagtagtttttttgttggcaccacatctattgtgtactaaatacactggaaaaaaacaaaatatatataatttaaaattccgctcttaatttttttaatccaatgatcatctatcgaaatggactttgagtcactaaataaattattttgaaagagaatctttttatgagattttagtttattccaa

SEQ ID NO: 131145 - DNA, 1983 bp, Homo sapiens
tgttattataactcatttcctatgataaataggtacacaataatcttatagttatgtacaaaggggagtgtaacaacttttttcacgtaaattgctcagcttgcaaattattatagagtttagtaaataatcagccttcagttttactttcccagaaaggttgtatcagtcttttatggtgactatttaagttacttacttttttctgcagtgattgcttcttaatgctgaaatcagaaagaatgtcagcaagaaggagagcaggccaatttataattctccatttgggatatatgaacaagcaattgattatgctttgatctttccggttttacctgtccattgaaatctaagatggctggaaacaaaatcgtcctcatttcctggtaatgtgttagaaaggttctaatttggggtaccttactcagattctgacactttgagaatagataaccatgaccgttcgatttttatttagaaggaacagtttatctcaaccctattagctgaagtgtaataccagaatggcttctttttattaatgctcaattatcctgagcatttggggaggtaaatgtctcttcatttattaactgtacttttttaaagttgacttttcttctcaggaccattttcaagtgagggtataattggctagtgaaagagacctttacctcacagtttcagttttattataaattgcccattagtgcattagaaacaaagtgaaaaagtgagaattgtaactattcttttattctatttgttctaatcctgccactgaatttttttcaacttttttttaatatatgaactcagtatgaaagatgttggggaaattgaatacattattggttaagttgtcaggaatagtatgatcttcaaatattcatttttctgacttcaaaactgaacaaagcctcacacgcatttggagttaagctatttcaccttgtatattaaatataattttgcacatctgaaaaatagcaggtaatgtactcacctaaacgatatcattcttttgtgaggcacatattttcttgggagattagagcttagagaataaagattaagtgactactaaaaattaataagaaggcggagtcagaatgaaaaaaaaaggctgagggctgaagtctttgtttatatcagcttatataatcaacaccttctctttatcaaattcttgaagccatgagtaataacaattttattttatgaggaaacgtgatatcccctggaaaacttgtatataaattgcacagtcttatgttcccaaaggatgctgggcccttgaaagaaacacagggttatacatatattagagggtaggtaagtagctggaaaaatctatgaaaggaagcctcacatcagtgtatctctcctagaaattaaaccatttggattctccttcctaaaaattccttggtaggagaccaagtttgagttattgttcaaaattgggctactggcagtgtttcaagggtcaattctgtaattaatccttgtgtgactatctaatttattgctagtagaaacaaatagtctggttctttgacacataatttaaggcaggacagtctggggatcccttttctaatgtactagaactaatgttttgtctttagcacatagcttattgccatttctatataaggcatgaatttgtgatttttaactgtgattttgttattttaaaatttacagtacttaggcattctctcttctctcttgctttcagaattgagtccctttctaacatttttgtttttgtccaaattgtaaatgtattatattgttggaaaatagaagaaagaagcaacagatttagaatgttgaaagataataataatactgttttttaaaatatattacctactaattcaaacatcttcaggttttagaaaactagacccatgttgagtccattctagtattaccagcattaccagtttgagtagatgacccagaacattcttt

SEQ ID NO: 131146 - DNA, 1048 bp, Homo sapiens
aaataatccctcagccagtatttgtagattttaatttactgcaatatgcctgaaaagtctttgggttatagattcttcatctattctctgacttacagttttcatcagtcaaatatttgctgtactatttaccatgccatttaccatgtatggtaaaaaaaaaaaaatgcgctctgatttcattccatttcttgcttagattaggtagacttatttcagaagtattggaccaattatagatattttgaaatcctggtgcaaatatgtattttccaaggtctgattatctaatctgtatatcgttttgtatgtttggtgactctcccaatatctctctttatgaatatctcaacatcgtgagtgtcagtagcccttcgactcctttttcttcagatattcacaagcatgcagtccctcagatttcgtcattcctcatggcaacagccccatacaaccagcaactcagaaaccccgatctgtgaccacatcctcccattctttcttgtaccttctccatttcttcagcctttatgaaataagcacccgcctccatcagacgtcttcatgctctggattccctgttatgcctccacttgtgctcagcgatccttttactggtctttatttgactgcccatgttattcctcccaaacaaggctcttcactttgttttttttaacccttctcagctatgtattctaaactcttactctttgtaagtaatattttattttaccacaaaggcatccccagcttcctcccattcctaacagggaaagggtactccaccttctttcctaacctgtcttctttaatccctttcatccgtccttctgacttccacactagcctttgatttcagtcttcctttctaccaatctatttatttctgcacaaaagtatgttaaattatcccctattttctttacattttcctctgaagctttttcccttccttcagctcatggcctagagctgaaagattcctgccaggttagggccgtagttaatggattcaacagtaatcaacaagtatcttgaatttgct

SEQ ID NO: 131147 - DNA, 1120 bp, Homo sapiens
taactatgaacgttttccagaagcatttcttagataaattattttataaaaagaaaaacaacacaacatctaagatttagagtggaagaatatacttgtagttaacttccttgttgatttaaaaaatatatttggatttattttggcagggtgggggaatcatctaataaaaaatttaaagcaaacttcattttttctaaccagagtgaagagacagggagagaatcaaatatgtgtgagctccctctgttgctctgtaacagcattttattcatgatttgtgatgtgataaggaaatttttgctaatgtgtcaaaacaaattcaattttcctttaaggcaatttataactttatttaaatggaatataaaggaagaaccccctatatgtaaaattctgaccttcaaatttatgttaatatttttaaattattaaaacattaaaaatgcatctatttctcaccactaagagggaaaaaaaaaacaaaaaaaaaacttcagctatatttagtaagtactcactgaagtcctaaacattaggataaaatgcagggcctaattgagtaaagtatcaactgggatgatgatagtgaacaggttggcaaatttgccaactggatttatggtaccttttatattaattacataagagtaaaatgtgaactcacaaaatagtaatggcaaaaatgaggagttgttttaaaagtatgtaaatggcattttacaatgctgtgaaatacatttttttttttttttttttgagacggagtctccctctgtcgcccaggctgcagtgcagtggcgcaatctccgctcactgcaagctccgcctcccgggttcacgccattctcctgcctcaggctcctgagtagctgggactacaggcgcccgccaccacgcctggctaatttttttttgtatttttagtagcgatggggtttcaccatgttagccaggatgatctcaatctcctgacctcctgatccgcccgcctcggcctcccaaagtgctgggattacaggggtgagccaccgcacccagcctgtgaaatactatttttatggtaagctagaattttaaaactatttcttgcaagtttaggattaaatgaattacatta

SEQ ID NO: 131148 - DNA, 1684 bp, Homo sapiens
atattatccagcaaaatcaggataattcctgagtcggaggctgcattccagcctctatgtcccaggctggagcagtggcaggatctcagctcattgcaacctctgcctcccgggctcaagcaatcctactatctcggcctcccgagtagctgagactacaggtgtgtgccaccatgcctggctaattttgggggattatttatttttattttaatttttgtagagatgggattttgccatgttgtccaggctggtctcaaagccatgggctcaagcagtcttcccttctcagcctcccagtgttggaattacaggcatgagccaccatgcctggccaaatttctttatctcaattgacccatcttcaggtttgctgattcttgcatctaccaactcaaattcgattgctttacttttcaactacataattttcatttcgttctttttgaataataaataataaaatcaggaactgggtagaggatgggactagacataaaatatttagaaatggtgcaaaaattagatagctgaagctaaatagattgagttagagcccagaaattttttaaaataacattggaaattaaaatgaaatttatctggaaccgctaacctttctttgaaacccttgttgctacctataccagtgaacctatcatgctgtgttacagtcatgtctttactgataggtctcctgcactagcctagggaagggttctttgcttcttattccttatatttctaggatctgagccattataggccctcaatacattagctgaatgcagtaacaaatcaggaagtagagttgtttttacagccttactgttaggttgactcaggtttaacatgatgtgacatttttaagcatcttggacttactgcgtgcacatctgtagtttcttttccttatggttttctttgatgtagatatgcaaggtaagagaatactttacttttttgatattatgttggagaggttgttttaaaaagtacgactttagatttagaagaactgagttcaaactatagatctataacctcttactggctcagtagtcattaacaagttatttacattttctgaatctcagattaattgtcagtgaaataggagttgtcttcttgtctctcagtattttttaatattacaatagaaaatactaaattagaatattagaaaacatatggtatctagcacagagtatgttctcagtaattttttattctaaatattggtcacagaaaaatgaatgcatctcagaagatacatttggaagctcattttttttttttattttctgaaattgagaatttgaccctcactctccactctcagaaattactcatagtcatttgggtagttggattgtctttccattggctttcatatataaggcaaaaaatgtccaaaaatactgagaagcaccaaatggtgctagtaatgcaattcatgaacattttccaaatttgctagcaagatagtcggtaaaatgtgccattttcacatcttgttcatagagcaaacaaaataatacttaactatgcaataatatacagtattaaatccccctgggaaaagagttggttttaaatactttgaaaagaaactttcaagttagtgatttacacagttaattataaacaacaagacttgtaattaagtgttgccattttgggt

SEQ ID NO: 131149 - DNA, 1027 bp, Homo sapiens
atgaaaaggaagttcttcagtgacacaaaaatgaatgcttcagaaagaaagatttaataaaaatgtatcacttgaggtgtcagattaagtgtgggtgagataattgtagcagattggggaaaagatcataagcatttgaaaattttattttctttttaattttcatgggtatatattagatatatatttatggggtgcgtaagttgttttgatacaggcatgcaatgaagaaattttagaggatctattatgtgcacaagtttatgtaaaaaagacaactggtatgtaattcaaagtttagccaaagtatgtattttttgtgttttgacatataattcctgattaaataaaataattaatttaaataatataattagtaatttaaatggtgattacatttttttttatgattccccactttaactgactttttcagttaactgactactactgatcagtcaactgataagatgaattctgcagtaatggaagatcaagaaatgctattctcaagatctttttattcacctcttcaagaatcctttttatttttctgagaatggaaagttctaactaaattctttgttgctggactcatttcgttttattgtggtttatttataggaggcacacagaaccaaccaccagtcatccatcgcttgttttgagtttttctgttacaatattgctgatctttaatatattccttaatatttaccaatgtcttactacattttcttattaattatactttcccactagctttctgatttcactataacatttgtgaattctcaaatatcgctgttaaatgtgtccattgtgctgtttttctattttgtactaaagcatgttaagctttcttccatgatggaatttataactcaagagaaataaaatcagattatgaattctaaattctaaggaatgagaaaagaatgtgggatagaagagacattgcggtcaagaggtggtgtgtgaagtttgaaagttctgttgccaaacatatgcaactctcattcaagag

SEQ ID NO: 131150 - DNA, 1096 bp, Homo sapiens
taagttaagagtcttgccatgggccataggaggaagtcagagtctaaaagcagggtgcaaacttgggagtggccggcgcctaaatccttttccacagccctaaattagaccttctccctttttctccccatctccccgtctttatttctttttttttctaagttctggaaaggactctggcgtttttcctttcagtcttccttttagagagtagtttttttaacactgcccccagaaataaataaatcatcttagtataatagctttaaagatctaatgtgtctaatcaggatataaatatttcggaaagtcaggaaatgaattaggtttgggtgcaagaaaggattccaaattacattttgcctaataaatatcgcatccgtaaacagtaaaagtaatgatagtgattagttaacagtaccaaataaaacgtgcatttaaaatgaacctgaccgggcatttttgtgtcatgctgactgatgtgtacacagtccattctttgaaaaatcaaggcgctcatttgaattgtaaattgccaacactgcaaatagtaaattgcagtagtcttattgtgctgtgatgtgacaaattacaaatggaatattggctaggcttccatatcttgcatttctcttccacttgctgctactatcaccattaatctcttttgcagaagttctatggcaaattgttctggacatggaaaggacattaagttgcattgttgactattgcagggctctgtgtggcttctctgacctctgacttctcttattggtgtaatccagtatagtgatactcattttgggtcctgctgtgtgtggatataagggttctggcacagtttatgtctgacatttcacttaaatattgtattacggtcaagaattttggctgaaatgtgtcaagtatatcttaaagtggaatgtggtcctttaaaatacatccatatcagaaacataaactatattaaggatgagtagcttcttagtttggcctttcgttttacaaatgaggaacctgagattgaatgctgttaataaagattagtttttggatataaggcaggctatgtaactgtcagagctgaaaaaca

SEQ ID NO: 131151 - DNA, 2497 bp, Homo sapiens
tctagataggaattagagagaatatttaagaaaacacagagttaactattaaacttgacgtcttccaccatccagtgaaaaatgctactgaatagaggaaggaaaagtataattcgtgcagtttaattagataggttaccacactgacaccagtggaagaaactccagtgtgaattcagacagcagcaccttatgtttctttatttcagcatactcggtcatcagtgtattctttcttcctgtgcttgactgcatttgatagtagtttctgagtgtgaaagctttgtcaagaaggatcctttccaaccataagcgtgcatccactttggaaactacctagaaaagctgcaaatgataattttgataaagagaattttgtttggaagatactaaaaatacagttaacaatgagcaaatagcattctctgacttactcgaaggaccagtttatatgtaattttagatacctgcatttttaaatgattgtatttattagtatgaattttagaaaaaatattaaaagaggggaaccaaaaaaagttatatcttgctttttttcttgtcctttccctccaccttcttctcctccttctcctgtagttaagttcaattacttgtaaaatctgaggttcatcaactacagaatttcacaaaagcaaaaactgggaattctacagaagttacactggagaatgatttaataaattaatgaaagggtgttaacgaatgcaaatgttacagcattggtggacgtaagtgcctccatatcaggcaaaaatggttgtgtttgaatccttgttgatagaaataacattaagttattataaatattgtacatgaaatgggttttcttaggctgctggatgtctaataattttagtgagtgaatcaataaaatacagctttttaattagtatttttaggtgtagttggaagaattgcttagcacactgtggtgttaggtatagctctagcaacatcctcagcagatgccagggaggtacaggacttagatttcagtggcttcctggcccttccacctgcctccaatccagcattttataggtcacattcatgacattcctcagggtcaggaagtaaaatatttttatacattaacttactaaatcctcatagtaatgctatgagatagatactataactcccatttccctgataaggcaaatgaggcctgaagaaggcaagtggctggctgggagttaaattaggctacttagtgatgggctgcaatttgagatttcatactagatccttcctcttagccgcttgtttcttctgcttcctttccattgttgtgttcacaaaaatgccacttcacaggtttgaaattattctctttttagcctgaaatgttctttacatttcttgataggaggattttattttatgtctaaatacattttcttgttcacttttgtcttgatgaattacaagtaacagtttttaaattccatgtcttaatgtttaggatatttgcatttttatgttttattattaagggaactgtcaatattatgttaaacagacatgagcatcgaacgtgttgtagagcaaatttcagagaaatcacttcttaaattatttttgtcaggacaaatcaaagaattgtataagataggtaattgatctataaactggtgaaggggtcattttaaaatccaggctaatttaagttagattcttacttgacttacagtattgtgttggctttggttcatttttttcaccttctcctggtacataaaaagaagaaagattcttggcttaaacaaatcgctaaagttaatcttgtatgaagaagaaaaaatgaggacatcatttttcaatttgctaaagagttagcctcaatttttaaaactttttatcttggtatatagatatatattttttaaatgctcacttgcatatcttagaaccaaaggcctaataacaaaaaataaacacttggttctttcagaagaaaaatcacagatggcaaaaaaaatttaaaaaaaattattggatcttttgaaagctaattggcaatttttatgtcattgctaatcttgaaagagacaatagataaaactccatattagaggtggatgtgtaatacataacccaatagcaatagcaacagagctgacatagccacaatttagtttaatccttgtcacctctatgtggtacactgaggtcctggaagctgtgtcttttccataagaccatgcctgcttccctataacagtgatagtgaggataacaacagcgagcccacttacttattttccctttgtgtttcaagtggtggtgaaaatattctcagtcttttttttttacccgtctgtcctttgggcctccacatcccttaggacaccaacctgcttcaaaactgccataatgacttgctgaaatcgtttatgtcaaggttaaggagagtatagattctctgctttttgcaagtataaaagagaaaatgtgagtcttctccctgtat

SEQ ID NO: 131152 - DNA, 1627 bp, Homo sapiens
tctctctagagggaggcaggttgggagaaaacagagaagcctaagaaagaagttctgattgccctgaagctaattacggtgactgccttctatttgaaacactaacctgtgtgtgatgcgtttaatgaccagagaatcaaataacttgcttaaaatcctagctctaggggcaggtattcacactcaggtcactaccatacagccacaagcttaaaccccatgcttcactggcccagctaaagctaaagactcatcagattatttcagcttagcacagagttaaaaagacggagaggcagagggagagagggctatagaagggaagagagagagggagaaagggaaggggagggcgagaggtagagacagagagagagaattgagtcattctttgttccctttcctgatttaaaaaagcaagtgatgcttagaaagtcagtttaacaaagtatgggtaataaaagcatcttttaatcatttgctatttgatatggcatttttatgattttatcaggcatgaattataccatttgatatatttcttaatataattaaaaagtaaaattaagtaaacatcccgtaatttggatgctagattaaaaacttaatttctaggaaattacaaagtctgtgatgaacttcaaatgtagttgacaactacactggcagttttattatttaaacatttgaactggactttgtgggaacagttaacgtaggattgggacgtttttctttgaattatttaataattgcctcttgtccgtacttgtgacatctgtgcttctgttttaccaacctggatctcgaaggaacctctgctctgtgttaaaaagtaagcaaattttaactaaagttgcttattcagctcacagtaatgaagagttatgtaaactgttttgcccaagtttacagatgtctgcttatattaggtacttataatagtagatattttgaaaagatttttaaaaagtaatttatggaaataatttatggaaatgttacattagttaaacactaaaacctccgtggctctgtgtgtgtgtgtgtgtgtgtgtgtgtgtgtcacattttacatgccagagagttacatttatattttttcctactttatccattggatgtatattatttcttgaaacactaaggataagaacatgccaaattcagagttacttacaaaagcaaatattattatgctatcactgttatatctttgaaattaaaaacaaatagtatcccaggtatcacttaagtgtattagaatatagatttgattgttagagaaagtcacctattagtacgatgtttttatattttttgtttatttagcattttttagctagcattgggaatcttgttaaaactattgcaaatgctttttaaatatatatgtatatagtgtatacatatgtgtgtatttaattaaatgcaagaatttaatttttacatattatataaatatatatattcatttcaatttgttgcatgttatttattttgaaagttgcttgctgcccaccattgacattttctaaatatgttcttacatataaataatgctagcttaagttcacaatgtggacaatttgaaaagatattctttttctttaggtgagggatgata

SEQ ID NO: 131153 - DNA, 1406 bp, Homo sapiens
ctgttttgtttagcgtttttttttttttttttaatagagtattatagtagagaagctacttgaccaaggttcctaagtctgtctgagtagctgcaaacatttgggcgaactacacaactcaaggaatatagatagccttttcagctgtcaaaaggggacaggggaatcccttttctactaatcgtccatctttgatattggagtacaatggactatatatgagaacattcttaccaattgatgtattaaaacttataacttttgcttagaagaatttatggtattgatgttatcatcttatacaatatgatgttttcctaggacctgtcatattggaaacataattgatattgactcttgttacaattatataatgctgaatacatattcatttgcatgaaagagattgacagtgattgaatttagcaggatctgtcataagccttgagcattcttttcttaaaggttcctgatagcagggggttagggagagatgtttagacatttcaattttttaatgaatttattgatatacagtaggaacagttcggctttcacattaattcatacatttcaaagatttttctttgtgatagaatgatgtaaagctattatatattctgcccagaatgtctctcatctgtttctttaaaaaacgttaaagcaccattgaaccaatttttacggtactattaatcagtgtaatcagtattaatacactactttaccagctcagtgccacttgtcagtaatatgacagggtgaattttacatcttcttcacaaaggctttcatctattagggagagaaaaaggagatcaggattttaattgttagcaatcagaagcctatgtgattaagacaggcattctgaataagacacagcacagattatactgagaatatttttcatcctttactaattcttttatgaatttgaatgtagtcttatttacctgaaactttaattatagactcaaaggagagtaatatgcctattagaaatataagaatttaatgttaaaggttttaatgtggttctggctggcttctttctctctttatatcttggcttgcagtgttcccaaatcctcaggtttcctccaaatgaatgttgttggccaggcacagtggctcatgcctgtaattccagcactttgggaggctgaggtgggcagaatcaggagttcgcgatcagcagggcgtggtggcgggcggggcacctgtaatcccagctactcaggaggctgaggcaggagaatcgcttgaacctgggaggcagaggttgcggtgagctgggattgcaccactacactccagcctgggcgacagagtgagactctgtctcaaaaacaaacaaacaaaacccaaaaaacaaaaacaaaaaaatgaatgttgttgatttg

SEQ ID NO: 131154 - DNA, 2863 bp, Homo sapiens
tacatagagtgagttaaacattcagaatgtggataattcatttgttgattcagtcattatttatttttacagacactctaaatgatcaagattctgatctgggcattgcaattacaaagttgaaatatgcaagattcctgcccaagtaaaggttacatctcaataatcttggtaaaaagcaacaaaaaatactacttactcaacataataaaaaattttaatatattatgatttatataatgttatgtataaaaatatgtaattttggtactgtttaaaaatcaaggttttatgtaaacttaaaattggcccactatcattaggacacacgctttgagtttctttagtagcagatgtaatacttttgtgaatattcgtcttattctcttggacaccttatctccctattaggtagtgatgcatttttacatttcagcattctagaagtgtgtagtctgtgaccattgtactaggtcaaatttaattagttatttcttggatgaacctttcactgtggatattgccaggattaaagtttgaaggtaagagggctttagggggtggggggaattgctgacaaataaagtaccttcaatgagttgtataaattggagattcagtttttataagagctaatgggaacacttattataacaaccaaatggttacaaaaattataagaagagtgttattgatatagctcaaatatggtacagtttgcagtttgctggttgtgtttagttaagttaccaaggaagttactatgctacagtttttaattaaaaatactaatttatttatttctgtactgtaacaaagggatatattgcataaatgatggtcatttgctgtataatatatttctgttgaaaagttatgcataaaattcttagtttaatatgcatttgattttccactcatgattactaatctttgcattaaagtaacaggattattgctttttcatgatgtgaagggataaagtggtaggagtaaacaacagatcagaatatcttttcattttttttaaagaggtgaaatgactcccttaacaaattccagcatttttagattgtaaagtacattatgtaacttcattcatcatgtagacctcagacagatactttaatttttttttgaaaaggtcttgtagcacacttaatctgcagatcttttctggcaggaggaaaaaaaagcatatactgttagatttggtgacataaaggtcaaaagataaactgtaagtgatacctatgtttatttttttgacagtgttaaattagcaacccctcagacctctcttggagcagtacaacctgagtaattgaacatgtcgctggggagtatgcttggttaagctgattcctattatgttgacttgtcagggaccaataattaaagctgaagagcgatgctcattagtgtctgcaagatgattcgaagaatgagaagaagtccttgaggcacacctgcaaaaggcaggcattgcatggaggtgagagcagacggactggcctgcttttctgctatgttagcaagccagcgataaaggggatacactaaattaagtgttgcaaatgtattctccccaatttagattataaaatgcattttacttccgcctttgaacataattttattccaattttattccatgtaatcatattttgctcaattatgcttttaatgctatataagatgttttagaaactagatataagtctattcaaaagcactttgaaaaactttatactatgaatcatttcattcattttcctggaagcatcataataatcaaaatctgctttgcttctttgaactctcaatactctgcacgtaaaacatgtgagttatccagctttgatgataaagactttagtggcatacatttgtcacatttacttcacaaaaatggaatttttaaatgtgtatttaacacgtactaaaccacatacagtatacaagcattggctcccgagaaggccagaggaaaacactacatcataagtatagaatttatatttatcacaacttgagcaaagctgttgacttttggaaacaattcaaactttttagcactggaatgatacagaaactcaatcctaaagctctgagaagcatttttcttcttttgaaatttgccttaggtaggctcactttttacaaatctatcataaaatcatgggatatacaaatatcctaatattttggaatattaagaaaaataatttattggatcttttttctgtaatctggttttgaaaaaagtgctttatagtggtgaagtggcctttttacttccagtgttgtgcctgttaaatttatcctgtgcactttggctggagggatgcatgtgccttttattcagagtgaaggctggagtctttacacagaagtcctccgtgtttgtatcttcaggagtcactgtgagattatctctttgaagaggcccttcctgaaactaaactttgtagaacttgtattactgatattccatgttagcatgaaattgtccgtgtttcggtttcctccaactgaaggaagtccctcaatggaagggactgattctcgctaatgtttacatgaacagtggttggagctcaataaaagttggttaaacttaacatagtcaaggtgcagaagagacttgcagggtagttatagatttccaagaataccaagggctttagaagtcaaatagaacaacctccaactcaatgtcaagaatttcttacaggatgttctttaacagataggtcctctcctggcttggtagaagatttccagtaccagagaggtcactactttgcaaagtagctgtttctagattgatcaactccaatttatagtaatgacaaatggt

SEQ ID NO: 131155 - DNA, 1135 bp, Homo sapiens
tgatgttggaagtgagaaacagatgttgaaataatcagtttcatttaccttacatactcctacatttaggacatgtaatcttaagagtccgattgaaattctacctgatatgaaagaaattctacctgatatcttactgaatgttctaagagcgaagttagcagtacagaaaaaaaaccaagtatattttttaattggattatcatttaggaactatccattcagaagactgtgaaaactgtgattgttaagtgtctgttaaactgtgtttgcctttgacagttagtagcttctagggtttgggtgtttggggaatgtagctcccacagatactttgggaagagataggaaggtatcagtaactaggaagtagaaagagagtccctcagtgtttgaggtagaaccacttattttcgccctcttgccctgttccattcatgctcattgtcaaactggtctcagtcaccctgttcttccctttgtccttctcctcacctacccccgggcctctcatctccctcttcacactggcacgcctttcaaagggccttctcctctgaacctgtgccatctagagcagctgcccttatctcaggactccattgacttgcccccttttctaatctgtttggaagccttatctcttcgttttggcctctacactgtaatttatttctgcttctattattacattgataaatctcacatttaaccagactttgagggatatgctgttgaactgatgtaaatcttgaatcgaaaactgcggtgcaatcctcattggtcataatgtgtgggctgttttgcgcataataactgatggaggcatctcagttttaaagtttgagaatgaagcattgttcagttttgtcaccctgaatcaatcattttattttgtgcattgttttatcgtgatgtttttggaataaagattggttctaggaaaggggtgggtcatttcatttggtgataacggaaatgcccttctactttttaagtgtctttggtatgaggtggggccctaggtagggcctggatgtctgactgtcctgtcattttgaaaagctcccttttaagacaagtgggactctactcttaggttatctctgaggacttgaaagaaagggagaaaaaa

SEQ ID NO: 131156 - DNA, 1762 bp, Homo sapiens
tcatgacttaccatcttttgagtttgagacatatgaggatgagaaacagggtcttaaataaccagtgatatagtttggctgtgtccccacccaaatctagtcttgaattcccatgtattgtgggagggacctggtgggagttaattgaatcatgggggcaggtctttcccatggtgttctcatgatagtgagtaagtctcacgagatcaggtggttttaaaaagaggggtttccctgcacaagctctctctctttgcctaatgccatccatgtaagatgtgacttgcttctccttgccttccaccttgattgtgaggcctcttcagccatgtggaattgtaagtccattaaacctctttcttttgtaaattgctcagtcttggatatgtctttatcagcagcatgaaagcatactaatacaaccagtaaactccagcactgaatctgttctttgcatgggctgacgtttaaattgctagggctaaaaatgctagggatgaggtaataggaagcttggaaatgtggcatacatgcatacttagcatcataaaaaataggaaatgccactagacatgatgaatttctggagatcttagacagaagtgttcccaacttcattaagttgccagatttgctgaatagatatttgtgtgtaaaggactcaaaaatactaggaatatatagcagtaggatacactacttggcctaagaaacatgcagtctgttttgtaaagcagaacacaggcacatgaattggcacaggaatggcatttgccatccttttagacagatatggtagcagtataccatatgaatatcaaaagagcacagaataaataaaggaccatggttttgaataaaaggacgttgattttcaagacctgtacagttgactccgagagatttaaagctagggtcagtctttggatggaggatatgcaggcattgcaggtgtgttaataggcaatttaaatatgctgcttatcagtcagtaaaaaaaagttcagaatttagaatatcacagtatttcaaagcagccattcaggcatattatctttgccatcagtttctctgttaaaaaaaatagttttgtcattctgtagtttttaaaagacaatttcaaaactttcagggggaagcaataattgccaacaggaaccttgacacctagaggttgccaatgtgatcagccttttgaatggtaatcttttaccatccctgtttgagatccacatgtagagtagttgggatatattgaaatcacacttagtgtcttagtcttgaaagttctttttactttattttattttattttttttcagacaaagtctctgtcgtccaggctggaatacagtggtgcaatcatggttcactgcagcctccctcctcccaggctcaggtgatcctcccacctcagcctcctgagtagctgggactacatagcaagccaccatgcctggcttttttttttgtttgtttgtttgtttgtttgtattttttgtagagacgagattttaccatgttgctcaggctggtctcgaactcctagactcaagcaatctgcccacttagccccgaagagctgagattacaggcgtgagccactgtgccctgctagtctttaaaattctgcaataggtttagcagtgtcttagcagaaagtgctatttgagtgctggcgactggcttgcatagtggaaatatactggcctgagctctgcccacctgaccacatactgatgtcattatcctcccttcatca

SEQ ID NO: 131157 - DNA, 2870 bp, Homo sapiens
tttgtaagttcaggagcaggggcagtttacaccaatgtacaaattttactcacaatttcttaagttaaaagtttcttttaacttttctcacagtgtggctaattttgcatttgggactccctaaaatggattcagcagcatttccctggaatgttcaaaatagttcaaggcacaaagtaacctagatatttaaatggcccctttacaccttagcaacgtggttgttatgattttatgaaaacagtctttgtttcttttctctgctaacttctggctttagtcagcaaagatttctctgcctcattaatgttgtaaggactctaaataaaatttttcttcgtggattcctttttgggcaggcctgatattgatcactgatttaatgcttctagtttcctgacctgttttataaattgtgggaatagcctttttagattttgaatgcccacagtagtcctctttctagctttgggaaatgatttgagaaatgaaggaatgttgattttatttttactctactttgaaaacaaacaaacaaacagattaatcagattaataaacagcaacatgaaggtggatggagctgagaagagagtcatctttaaattctcttaaagtataagcaactcattcttgtgctttgggaacctagtgcctcccaagaaagtcaagatgaagatttgaaatgtatacatttatgactcagtatttctataagtatataatgttagtaaaggaattgtataaaaagacttaaaaggccagttcatccatccattgtctgttattgaagtcaacaacttgatgatttggtttcatataaaagatgtacacctgggggaaagtgcatttcaagggcactttcaagggtaagattttacaggaatttgacattttttaaaaaataaaatctttggaaatttgattccaaattttaattcatttataaactctgtattgccctaaaatgattttctcatatggcatcgaatgtgatgaagctagattcattcacacattcaataaacatatatcagtgtctgctgagagcagggctttatgctgggtactgggtattcagtagtgaaccatacagaaatatctctcatggcagttacttcttctgtgtatatctgaacattcaagggtaataaacataaaccatttgtggtgcgtgagacctaggaataaatcagaatgagctcacacctacttacttcttattataaccctaagattgacactttatgaatttagtgttatccaaataatgatgcagtatcaaagatgaatacctagatttaaaatgctaaaagcttgttttagaaagccagtgaataatgtactctcacttttgtatcaatatttcaagtgctgctgggtaacatattgaaatgctcacaccagccatggatgataataaatatggcatttttattaatgttaataaactgggtagcataaatggagaagacatcttcataggatttcataatgtattttgttattcagaaatattaatgtactttgtaatgctgatgcagtaacattaaagaataaaagacagaggttttatcttgaaattgtatggtgtttagtagattttgaaatgtggatacatttaaaataaagttcaagagcccctaaggcagctgataaccacgggtattctgatagcaatgttaccccttaacatatgaatttttttaggtatagcatctttgtaaaagtggttttaaatttcatctccttatcctttaaaaaaataccacattagcattccaaagattctttatcatttctagttatagcagttgttttatcattaacacggtgctttcttatatctagcaggtttgattctagataatttgataactccaaaagcgtatgcaatttgtcataaaactatgttacagaaatataattgtaattatggatttgaaaaatcttaattgtacagaaccccactgagtagatgatgaaaaaaagcagtgattaagtacaggccaataatgggaagatataaatccacaaagtgaattttatgcttccaggagtaagtgtttttcatacttaattgctaaaatgctttgcagcactgagaagaaatattgagaagcaagattagttgtgccaaactataaccttgaattctatggaaaaccagtgcctggatgccttagtggctcagcctctttatctaggggaggtagaacagctaggcttaagcctcgactggccattccttccccactggcttgttttctgattttcatttataatcatctggaaattgaagagctttgattgaacgccagtgggagattttagctttatttcatcaacctttcccaatattaacagtaaattacaactatctttattactgctagattaagttaaattatagtaagatggtttatcatcatgtgtcctttatccctggtcttagactagagtttacagaatatctcacaaatttgaagaataatatacaatgttttatctgtgttagcaagaaatgcaaagccttttttttttttttcctgtctgttttgtgaattgagcttagaactgtcctcgtaattagaaatctggttacttggattctaagcttagagtttcttagttttaagaacacatcacctcataattgtaccataattatgaacgttacaagtagtagtgtttttgtgtctcttactgtcagtgacaagcaaaaaattcgctagaatatattactcttccctaactctgagatggaagacagataatagccatggtgcttgaaacatgtggtgctattgggatgggaaattgtaacagcatttgacatgcaagggtcatgtttgcacctcttcttggat

SEQ ID NO: 131158 - DNA, 2039 bp, Homo sapiens
tatggccacgaatttgctaaaatctatgccatggtatgaggataacttacatgaaaatatggtacaagattaggtaaacagtgttgttcatatgagaacttaaaaattcccttaccttgaagtttcaagtaaatgtctttcgtccttttaatttggtgtgataagaaatattgcctttggtgtaatcagaattatgtagcatgatgcttcttcttggtgctgttatttttactgcagtaaatatttattttagttggcattgttgagttacctcatttgtgagcacagctagtaaagctatggttaaattttattgcttttactcttagaatcactttctcagctagtttaccttggagagacaactttacgttttccaccaaattaaagaagctgagaaaattgggtggaatttttttctttttttttctgtttaaaatgtggttactttgtagtactttggcgaactcactaatgtatgtatgaaagcacacgcttatcaaatggaaaataaaatcaaaacaatgaactccagtatgtttagtaataaagaaaacaaaaaaaaaaacctgtcattttttccaatgcaattaaatacaaagagaccactaatattacatttatctaattcatgtcttctcggcaatatgaaccattcagatgttcctccacctcttttgagagggatgtatgctgtcagactttaccaatgggatacacagttggggttttggaaataattttgaatctccttgcagggtagcctgctaaaagacagggttgtagaaccacttccgagggccttctaaacttaaaaaagaaaaacacctgtagctgtcagcactactttcagcaaacagtccacatcgttatgtgtcatttaactgctttctgcttgtcagcaggagtctttgtttcacacctaagagttgtcacatcagaaatcagaataaaggcctaaggtctctattcccacggggcagtaacatgttatgtattattttcctctaagtattctccatctactcaactctctcctggaaacctacatgtttattcgaagcccctatatatatagtgtagggtatgaagaaaaacgtgtttggctttttaatgacagtcttttcaagtgtatgtaccattatttataaacctatgaatgtaacattcagtggagttaatgtgttcacaagtataccatgagtgtggatggtggccagaaaagtattattcctgaaaagaacacaactatgtaagcaactcctgtattttgactacttgctgtagataaacatgctcccctcatccaagtctgctacaggagtggacagaaatcttggggtaccaatattgtgagggggttggttgaattcagcattttggcaacagaaactggaaagaaataattggcggcccatacggtatgtgtaatgggcactatgagctgtttaaacgtacaccaattattttgaagctttccaaacccatctgtcaccatattgtctagtcacatgacatagaattgtcatttctccctgcataaactgatacagttacaattgatttttgcttcaatcgtttgtataaatagacctgtgtcatcaggatctattgtttttgttttgttttgcttttgcttttgtttcccctaccagtgatctatggtacaatttacttgaaaaacaaaaacaggtatagctagagggccacagcataaaaaataaaattaagtattaaaggcacttaatatagggttaaaaaataccctgtgaaagctacggcacatcttttccaatgtgtacaattgagtcaagaaagcatagttgtatctttattgcaaatctaataatgtaccccatagtattgtatttaatcgctgctatttttctctcctattcatcattgtgtaacgtgtaatttgacataaattcctggccactgactctttctgcggtgttggcaggctcagttcataactggaggtaattggagtgagatttgagcactgttcactgcaagaactgaacaatgtttaggat

SEQ ID NO: 131159 - DNA, 2668 bp, Homo sapiens
aaacctggatacgagaacttgaaagcttttgtgaactcaggaatgcatatgatgtttgtactacaaactcaacctcatcatcttaatctctttgcctagaagagatgaataaaagtacaggttatatttatgaaactgaaatctataaaggcatggagctcttttcctcaagtgggaattcttgtgtgtttatttgaccctttagcaaattagtggaagtaaaggagggagagagggtatagctgtatggaaataaagctggtgaagtattctgctcttctgttcttcttagtcttgatggtgaaccatgcctacactatactatcactctggtaccagatttattgcctgccaggattggaattcatgcagagaggaaggattcatgaaaaaaataatcaaagtcaggaaagtctttttctgtaatcttgtctcatacagtgagttatttttgtctgggtagtttacggggatgtaactccttcagtcatctaaccgtgatgtagtaaaagtcatttgcaggaaatgaaactccactttgttacttttttcacttaaaggctaatctgattagctttaaaacatttgttcatcttttaattcagtatttgtatgatgcctatggaagacatatggatttaaatagaacttggctaaccatctgccaataagagaaagtgagatgctaaatcagagaggcaggaaagtctatttcagtaaaagctattttgatctgaaatactgtaggcagtcttacagagtattttaattgggaggatattgatgcatgctagtaaaagaagtgtatttgctgatatggttgaagttatgtaatcattaaatttctatataagtttagagatgtggaactatgtgaaattttgatcctgttaattataattttttttcctaaaaaagccatttgtggaaaaaaattttctgatatattttttagagcagtggcacgttttatatctcatgccagaaactagagcataaaatatcaacttttcaaataaattaactagaaataaagaacaatttattcagtgctaatttgttgataattttttatagtaaactatgttttaaaaatttaactttggggaaattagaaagaagaaaaagaatatcttttctcatgatggtaaaatgctgatgtataaagctgaaaaatttacaattatgtcatatttatgttttaatttaaaattgtgagagtttagagtcatgtaagcattaagaaagataaaatatctgaattatatatatttgcatatatgtgcatgtatatactattcaacttaacctttataaataagccttatttttattattcagattaattgttcattcttatataaaatgtgtctggcatttggtttttgctgggggagtacaataatacatggtatctgccttctgggaagaagtacagtaatgggtcaggaattaggacagtcactgtcagtcacagtcatcatctcagttaatcctccaaataacattatgatgctgggcattgtcaactcaattttattgatggcactaaggtatagaaaagttaagtaagttgccccaaaataacacaactggtttaaaactctcagtatgagaggtgttgaaaccatagcctcttacaactagaagatcactgtattcaatactctaatccctgatatatcatgaatgctgaaagaggatttagactctactacacagacgccctgaaagagctgcaggaggcacagggaattatattaacatagtggattgcacgttagggacagaaatggaccaaggagcacatgagaagtccacattgatagaggtgcctggcatgggctccccttctctgcccagatggtgttggtgtgacctgatgggtggcaccttcttgacaaggatccttgctttagatatttggaatattttatgttatcaagctatttagaaattttaagtcactgcaaaagtgctcattccaaattctgtttcttgcctttgtcttgaatccatatctgaatatttaggaagatttggtattggtatagagaggtatcaatttggcaaagatccttctttgccaaattcctggaagtggaattgctgtgtcaaggacagtgcacctgaaaatgtggacaggtaatgccagatttccccacccccctttctaataacagtgaatgacctgagaagtaattgtgtccatttagaatttcattagattacgatggaaatgaaggtagaaatgaagaatcaacatgtggaaaaaatatgtctgtaactaggaattgatgtactgagtttttctgtccatgttgatttattattcccttgatggcatttttgagaccaattatttcaacatgtggtgaatctttttattcatctgtctctctgtatctggaacaagtatatcttggatatacctgaggcctaaaacttggtgttaaccagactttcctctctatggtgtaaactgccatagttggcaagaaatattccagggaaagcaatgtaaattttctcaaatgagaaagatgcgtgggtttatttaggataaaaagcagagacataaatgctacaaacatatatggtattagaatgattattacatttatcctatcaggttttgaagcagtattattgccttagtttcttgcat

SEQ ID NO: 131160 - DNA, 1036 bp, Homo sapiens
tgtgtgtgtgagtgtgtgtgtgttttttttgaggtttttccactaaaagcaaggagcttttagacaagtatgggacacagtagaacaaagatatgagagatactgcaaatactagttcttttaatttatccatttgcaaattttcctcctttagcagactgagagctcctgagggctgtgcatttttatatttttgtttcttgttggccctgttatactgctaatcttttaggaggtctaaaatcaatatatctttaatggaatagaattatatgaggaaatatgcattttttaaaatttggaaaaccatattttatttgctgtatgagactgccgtaccgcctgtgtaaattttctaccattaagattataattataaattgattattatttgtatactcttttaggactgatgaattagtaaattattactttgtgcattatttccaataacctttagggtataagattatctagtgagttacttactctggaaaaaatcaattacagcaatttagggttcgtataacaataaaaaggatttgagctttaatggaacattttaacacttggcatgtatctatatctacatatatatctatatatatcccttttttctgagttatctggtgaaacagagatttctttatagaattttgtgacacaggaatctagagacacaatctgccagtgcatttctaggttttaaaagtttcagttcaaacctaaaaagtctatttgttaaatcatgactccaaaatttattttttatataccttctttttttaataaaattgactctaggttcaattttggttgaacttaatcagtcttctttctacacagctatattattagtttatatagaacacagtgctggcaagtgttgaaacaaaaatgtgaagaatgatttaccataccaatatactgcttccttctaaagaagggagatattttagaatattagatactgggctcaagataaccagaaatgtgtaatgggaccatttatctatatcattttatggccaagtca

SEQ ID NO: 131161 - DNA, 2063 bp, Homo sapiens
cttcaaagttcacacgctttactatatttattcttttttttttttcttttgagatggagtttcgctcttgttgcccaggctggagcacaatggcatgatctcagcttaccacaacctccacctcctgggttcaagcgactctcctgcctcagcctcccgagtagctgggatgcgccaccacgcctggctaattttgtatttttagtagagacggggtttctccattgttggttaggctggtctcgaactcctgacctcaggtgatccacccacctcggcctcccaaagtgctgggattacaggcgtgagccacggagtctggcgtatatttattttcagtgtatcattagcagaattctagagtcagctgttctgtgagggtaaaataatgaagctggttttgtacttaccaagtttgtaaggcattcagatgaaaatatctaatggatagctggaaacgtaggctgtcatagggaatagaggagttggaatgacttccaaattaactaacattcatttaataattgaatataaactgaaagcctagtttgttcagaatattataggagcagcattaccatgactaagctatagacactgattctttaagacttttgcaaaccagtagcaaaaataatgttcaataaaccgattacagcacaagaaaaaaagagtgtcaggtaccacagagtgagaaaaaacaacaacaataacaaaaaaaaaatagcaaaatgttgtagaaatttaaaaaaggaaatgaccccttctcaattaatctatcaagacagtgttccagaagaggttgcttatcagttggttcttgaaaagtggtatttggaaagcttaagaaacatagtacactagcctacagagaatctaagcagaagttgaacttttcactccaactaaaaatctatgttaaaaaaaatgagtgaggccccctctgcagtgaaagttactattttgacatttgtgagatcaaattttaagatcctctgggtatgtcaaagtcttttcgtaattgataggattcagaaacaccacaaagacatgcatgctttaagtatcttattgtaaccagctaaactaaaagaagagtacgttttagaacagaaggtgggtatttaaatcaaagtctaaaataaaaatttaattgtttaattatgtaaataacttcaaaacgtttatcttcttttaaatatataaatatatatgtagggtgtgtatatatgtaaatagcgtttattcagatataaataaaaaatagccctactacttagggtcgtatatacatattatcaaagaaaaaaatatacatgaaaagattcttgaatacccatttaaaaatgaatgccgtatttactatgcctgttggatagattcattatatataagaactatcaaattttagttttatgtattggtgttctgatttattcgctaatcatttctcttagatttaacccagtggcttattttcaagtcttgtttaatgtcttattttataattgaggaaaaaagagaaatgcttgcctgtgatatatcacctgttgtttaatcgctaacactgttacatatcttaatactgtatcacattaagtcattttaaaagcattctgctttcccttttgtttaaaattcctacgatccctgggatattggtagggggttaatggaagtcttgattaaaatcttccaagctttaaggctttcagttcttgtaaacaatttggatctgagagataggcctatttatgactttttactagcctatttacccatttaatgttaagaaaaaaatatgcttattaaaagttttgttataataagtacaaattaaaatgtcttttaaaaaatcagccacacttcgttgtgtgatgatcacagaatttatggtagttcttttgaaaattgtctgaagatgtattataatcattttaaaagtaaaggaactaccctgagtataccaattttccattattttaaacaaaccttttaagttttatatctagattgcttttaagtagttatttccaaacttgaaggactatgaactctaatca

SEQ ID NO: 131162 - DNA, 1047 bp, Homo sapiens
gggattggaatgcgtgttggtgagtgtccgaatttaaatatattggtattcatatggattcaggatttattttcaaagaacagatattcactagaccaaactaacctgtactcaaacttgaaagaaatagaaatagaaaaagcagaggataactttgtggagttaattcctgatatactggtctctaaagtttcttgttgtccgataaatattaatttagcacctgctgggtttcaggcaggaactgtggaagaacttataaagggtatgaaaatgagtatatcaagatttctgtactcaagttatatacagttagctgtaggtgataagacaggtatggtgacagctaaaatacaatcagacttccataaaagaggtgaagggagacgagaatgattatgattgtttaaagaggaacagatcacattgtgttgagaaaaccgacttagttgtcccaaaaggttttctgagcttgtttcggaaaggaagactggacttttagcaggtgaatatgacagcatgaagggtaagccaatatagaagaaacaatgtaagattacaaggggcattttcaggatataggaaagagaaaagcttgatgaaaagttaggtatagtatagtatggggagctaagacttgacataaaggttaggataattttctaaaatgtttatttgaaaaactttatctcagaaggaaatagggaaccattccaggatttgggcaaaggataatttgatgaaacctttaatagggttaatatgaccatcttacataggttgacatggaaaggaggtggacggggttgaggtgacgaagactcattagtaggctgatctcttactctatgagtaataacagggagcctacactaggataatgatgttgggaagtgatttctgtagctatgctgagcagacagtcttcaagagttagcaaagtttatatgtgcgggtgacaaaaaagaggctttgagttttgatgactgaaaggagacaaataatagctaatctttgataaagactaactatgggcaaggctttact

SEQ ID NO: 131163 - DNA, 3437 bp, Homo sapiens
tactttatattgcatatgcagtatagtttattctttagagaaattgatttgtaagaagaactcattttcttaagcagagttgagtcaagggttttaattaaaagcagtctactcaggctttgcctttctcgggcgaataatttctctcttttctctgcttttgctttgcctccatggatgatgctcctgctacccttcacgctttgtcaaaccagttttgaagttttcgccttcccccgatgtatgtcgcatgtgtgggtaatggcatgggctttgagggagtacaagagaaaagaattgatttctcttttctttaaaagatggcatttaattatctttgtttttatttttttgctgaaatatattaaatgcacattgattccgttaagtatttttctttgataaagttgtcagaatgtcagaatatgctttttttctgttattgatgcataatatttcatacattggtgaggtatacgtgggaattttctgcaaacatagaataaataatggtcaagtcagggtttttggggtatccattaccttgagtatttatcagaatttcaatgtgctggtaacattttaagtcctctgttctagccattttgaaatatgcaatatattattgctaactatagaatatttttattattttttatgaaaatttgaagaagcaggggcaagaatactttctgaattaacattgcatttgtgctacctatatgctaaaaaaacagattctcaggccactcttaaccatacatttataaaaagatgtatgatgttatttatgaatgtttaagacaaacaagttaagccactcttctatatggaatctaaaaatgtacaaacactgcatttgaaagagacattcactttacttaaaaataattatttgctatttttttaaaaaaagactcagagtgggacttttgagacatcctcttttgtacattgaacagtggaaaaaaactttacttgttaacattttagaagtatatttgtttgcaaaatcatggtataattgaaggcaatactggctatattttaggagatgcacatatttggcttatctaaatcttagtgtcagaaattgcctacctgaaagttccctggtaatatagaaaaatctgtcctctttgcctgacttacaaactaattctaagaaggttggatgtttttaaagtgtaaattgtctggatggacagtttgtggtctacaaatttattatccagctaatactgtcataactttatgctgtgtgactactgagtgtttttgagtttttaaaatcagagctttcctcaaattcacatgtgattaaaatatttttgaagagtctaaaatatatactaacctttgaggttccagctgggtttggaggtaggtatgctccacatttaactctggctgtggttcaggcctgcctgtattttattttctggtaaaattagatgttattttttctttttgctcttcccttgtgatgtagtggaaagtgctctggattggaggaaaggagactttgtgttctagattcactttgtgactaactagccgtgtgaccctgggtgagtcactcaagcctcatatactgtttcctgctttggaagattatagtttgaagtatgcagtttctcaaatctctttacaattgcagagtcaagcaaatctagagtcaagtaaatttcctttaaaaccttaaacattcagatctatgaattgatacccgaggcaactttaagacaaaatcttatattttggacgtaatgatgctgatgtccaaagatctagatctatatctatatctatatctatatctatatatatatatgaactacaaattcttaaatatgatttccaaccagtggctgagaatccataagttataagcaactgtcacacatacagtctgaaagcttcaaaaattgtattatttgaacttatcttgtacaagaaagcccattctttggaaacaactttgctgcaaaagaatcatgtcaaggggctgctgatgaatgaagttaaaggaaagtaagcacaatgagaaaataattctatgagaaagtgacatgcttaaagtctccttcctcagtttcttggcattgagcgatgatgcctgttttgttcacagtcagatgttcaaatcagaattttggatgcagaaactaattttagtaggtggggtgcaaatttcttatgagtccatgaatagactctaatcccagctgtttcattacaattataaaaataaaattggctgtgaatcattcaaactctgtttaatggatgtgaataattcagtttcatcccactgaaatcttaaaactataaacctatctttgttctttatgttccttcagagatcatatgtcattactcatatatgaattatttgaagtatgggtgatcatgatgaaagtgaccaaatttctacttagctcctgtgggtttcaggagaggaggtggcctctagggtgaggctagggattaagtggagaaacaaattgggaaaagtccaggaaaagagaaaagggtgttaaattaggatttcttggcattatctttcctatcaagatatatgttcattatagacattttagaaaatataaacaagcaaaaagaagaaaataagttttcaacgtttttaatgtatttacttctggacacagacacacaggcacatgcacactcagacatgctcactcacacacatagacatgcacctgcaaacatagatttgtatgtttattattaaataacttttaatttcactttctaataaattacacgctgttttatagcagcgtatattctgctacatcatatttattgacttcatagtatttcactatatgttgtactagttgtcctagaaaaactgtctatcgatttcttattgttggacatttatttctattttttgctattatcaatagtgccacttttagtatgtttatagctgaataattgcaacttgcttgcgattttaaattttgagaattggcgtcccaacagtcaggctcctctatgggaccacacagtagtagagtttattggcaagcataggtcactttaccagatcatgtatatagactcctgagaaacaggaaaacagtattatttcttggcttccattattttgaattgccttgcagtgatagctaagaaatagaaaccctgaagttttttaaacattattatagtggaaaaagtgaatatgattatttgaataaggtgcatttcttgagcagcagcaaagaatcagccaggtattgattttactttcataattgaaagatttctcagtcacttggacattcagagaatatttcataggacaatgcacttataaagttatatatatatatgggatttaactgccttcaaaacatttcttaatatgtcaaatttcttaatgtgttttggtgagcaca

SEQ ID NO: 131164 - DNA, 1589 bp, Homo sapiens
tcctatcctctaatatcttctcttccgtttttggtttctacaagataaattttttttttttttagcttccacatataagtgagaacatgcagtgtttaactttctattccaggcttatttcacttaaaataacgttcgcctgttctattcacgttgctgcaagtgacagaattttattctttttttatgactgaatatattccattgtgtgtatttacctcattttgtttattcatttatctgtcgttggacacctaggctgattccgtatcttgattattgtcaatagtgctgcagtgaacatgggggtacaggtgtctctttaatatactaatttcctttcctttggaaaaatactcaggagagggattgctagatcatgtatgtagctctgtttgcggtttttttgaggagcctccatactgttctccatagtggctgccctagtttacactcccacccacattaatagcacttgaaaaacgacaacaacaatgtttttgtaacctaggctgtttgtgaggtctggcatagttctgctggcccaggtttctaaagcaggtgaagcagatgtatcttagtgaattggactgtaggtttgcagctactgtgaaatgttatcctttagtgcagtatctgttcattatttcctatataactatcttttgcttggcttctcttttccatggactgcatgagtcaggacataacagggcccccaaaagaacccattgttgagcattcttagatgttggaagtgaagagtatacagaaggtggcccaagtttcaggagcacagggccagaatgattcaaaaatgaggtatgtagtgttgatgtgaatctggtaattttccggcagagcccagtctgatgggtccattttacaggcacattaatacctaaaatgccacaacgaggttttattttggatttttggggattttgttattttcaccaaaaaggtaaatattatctccattgtctctcatatatatatatatatatattttttttttttcttctctcccttccattagatactgttcaaaactttccttaagtgtttgtaagcaaaggcattgattagtagactgctctgcttgttaactcaaggaagcttggcaagctaggtactgctgtatctagttgtgttatcagtttaaggaaaggcaaattgtttcattgatgtttgaagaccctttttccttttggagaagcaatactacttatagacttttattatgaactataatttacaaatacaaggaagtctggaacacagctttatatcagtggttaggagtgaagcaaaggaatcttagttttgtttttttctgatgacagcacacttgtgataaattgagcgtttggcatcattgttcatctcagaatgattaaatgcctccctctcacttgtaattttatatgttaacttgcctcttttaaacaaggcagtttcttaattttgaagaattactttggacatattaattaggaaaaggataaaccattttctaccatggaaatttatatatgtgtaacatcatgaataaccagaaaatgctaagtatatacactatagatatc

SEQ ID NO: 131165 - DNA, 1587 bp, Homo sapiens
ttacaaagcacataattaaaatgttgctttcagcatattagtctttctgataacttttttttttaaactggttttagcaatgaaagtttgctgtacttctcaaagtgaggaaggaaatataagaatcacaagaagagctaaaatttcgaaatgttctcttcattaacattagtggttttctcctttttttggcttatgtcagggtcagtgtttggcttttagttttgtgttcaatatgatatcatttatgtatatttttatttagtaaatgtctatatttttcccttgttattagtatggaattgatcttgatataaaaattttcagttgcatatgcctctgtgttgacttctgtgctttgagtatgacaaaagccacattgccataaacttgatcttataaattgctctaggaaaactaggcttttttttgcatattaatcacacaatatttctacaaaatttttgagtattttcttgtgttagtaggaagaagtattaagggctttagaatctttgctagaaatagtctaagcttatatgacaactttattatcttaacatttctagaatagatcttatagaacatgaatcacctcctgaaaatggttaccaacatttactaataatattttgaaaacccagtgtttttatttaaagtttaggtctgtgaagaggttaacatgtttaaaattacctgtaccaacagtataagtaaattattttatatattccaatagatgtttcttaatcattttaaactaagtagtatagtatagtcagcattcatgtaaagttgtatacttttctgacaagttttttttttatgatgtacatctacacaaaggtatttattttttagataaatttatgcagatgcaactgtattaattttattgtttcctgaataagaaattctggattttatttttgtaatggaatttttagattggatattccattgcagaaaacttggctttttatctgataactacatgaataaggatccaaaaatcgatcattaaatttcacaaaaaaattaaccaacattgtgtagtttttcatttgttaataaaatacggaagtacagttaagcttattgggtgagtctttagggggagctcatggaaaatcaacattcaggtaaactcctccatgttatttgtcaaaacggaatgttatagataacttgtagctcaggttcttccataggttcaaatgctgtagttattagagcacttttttcttgcagctagaggaaagataaatctccttgagattgatcttggtttccagtttaaatttctttagaaaagtctgtcagttgtaacatctacattttgtgctacttggcttcagcggagatgctcaaccatgggcctggggagttgagttccaagttctggaagttgagttccaagttgagccactgactttcaaaggaagggcctcccaggatctccgttcatctgtcgcttggagaggatcatgctgcctgccaccctcacaggagtgttgtgcagcttagttaattaacgtttgtcaggccatttgagatcctcagatgcagagtgctagataagtggaa

SEQ ID NO: 131166 - DNA, 1037 bp, Homo sapiens
ctgagcgtagtggttgcattttttgagcaagatggagatgttaatacttttctaaaaagttgtttttctcaattcctccacttccttaaatccctgatttcaagtttctattgcatcattttaacagccttttcagttcctccacattagctgctgaagtaggaaaccttaaacaagagattccttagctgtgttctacaataatagccaaattccaaccctatgatttattatcttcaaaggctgtaatctactaaatttcagagatctgataaaattacattaatatatacaaatacatgcatatgcatatataaaaggaagaatattgaatcattctgtggttgcaataaaatttaaatcttttaagattcacattttatatttgaatagtgcttttggaaatcaccaattttactggatatttggaataggaagggtagccaatttaatttattgggcaacatttaggttattagctgtatatgaaattttcaatgtgtacatatcttagatgatgagctttttaagacacctaacagaattaagaaacagcccattctcattgtgaatttgacaccaattctactttggtggtattagttggtattctgaaattatcataccgaattacctacctctaattcattaccctaccagtggtagaaaaaaaaaaaaaagcagaattttgaggtcatgtttactaaaggccaaaaaaaaagtactataagtttatagtttcagaggcatagttattagtgaagatgtcctgtaataatttaaaatacaccatagaaatatacagatataatttacatgttttgaacccaaattacagtagtgtataaatatatgcctacagaatgcatgtttatatttgaaacaataaaatagaacttgaaagtaactacaattattcagaaattgtaagcaatttaagaaatgtaaactatcagattttaaaagtacctttttaattaaatagttttttcaatatagcattaatagagcaagtatattaatacatttatatatac

SEQ ID NO: 131167 - DNA, 2748 bp, Homo sapiens
aataatttgataatgatttattattttatatttaaatttagttccttttaatatatggaaaagctgtacaaagcatttcagcattagaaattgaagtgtatctacagggggaaaaatcctcaatttagtttaaataacagaaagtgaaaagggcattttaaatcaggtgtgaaaacttaagaatagtgacttaaatgatataattcatgattatccatcagggtaaactgcatctatcaaggcaaaatgaacagagtggggcatttaacagtaattcaaactaaccagttttaatgctaatcacctggaatgtatgcgcacaagcacgagcagcgtgcgtgcgtgcgtgcacgatgcgtgtgtgtgtgtgtgtgtgtgtctgtgttatacctattactgctaatataacaagggcactttgaactctttatatagaactgaaaatgcctgttaattacattccagttttggggtgttaagaatattgcatttctttctacctactatattgcatgagtaggtagaaaattcaggtgcttaaaggctattaaaaataaaacaacccttcagaacgctgtctttgcagtaactgttttcttcttctccaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacgggtaggatggtttcatttttaaataattcatttgttttgaagggcaaaaggaggaacacacattctttctctacaggattgtgttgtgtgtgaagtgaaacttaatgatctgtctcaatctggggatttatactcctaaggccaaagtggcagcaagtaactcatgtgtgtttgtgtgtgctgtgcacttacttgatacagtgttaggcagtcacttgtttgtctttgctcttagctcagattgaatgttggttaatcattcctggtgactatacaaaacaacaaggccatatttggagaagggaggtttagaatcccagaaggatgtacatctgctacactgaaataactaaatgacttttaaattttaggctgctatgacaatatatggttaataaggaagtcagaagagatttaaatcactaagaatgtaatgtccttgatgagatgttcataccaaaatacggagttttttaaaacccacgatataattatgtataaatgacaatgcttgttgttgtcgagttgccaacaagagggggaaaaatgagaaaaggctaagtgtgaatagtgtgaaaagcggccaaagaagagtgccatgcatttgatatgaacaggatcttttagggggaaagacctagttccatgtggaaaaagaaaacaaaacctctgagtaaggtaagatcctcgattgctctcttcatactatgtagactcagcattgttaaaaagtattttagattttgaaaattcatgagctcccaataagtgatagttgctcgatgcctaagacaccacctcttggacattttaccttaagtctgtgaaagttttgagcttctctggatgattttgaagctttgtttgtgcatagaaggtaggatcagaaaccagctaacctttacaaaagatccagttgggaaatagagttccattagccaggtgctttgacctgcgggtcatagaccagtgagttctctctggatgtattctggggagaaaaattgctcttcccaatgtctgcttggctgctctgctctcatttcctgcagattctctgaagcctatctgtgcttctcagtattctctagcggagttgaaaaacgccccttagaggtgcacagttaattatagaagctgttagctttcccatctgtagtcatgccctggagctaagagaaggacttgaatacagaagaggagatgccccctgtacagagagaaacaaagaatccttcctgcagggaagaagcaagtttattaggagtaacttcgggaaaaaaagagaaacagtttctgtgcccttcaagagggggttcaatttagggaactcccctccagtgaatatacatggagctgcatttttatcattgtcaatatttgttgttttctcagcatgtcattactcttctggcctcaagtgactcatggcttctggttataaggcgggaatgaaatgtcctatgttttattaaattcatactgcattttgagagtatggtatatttgggggccttatatctatatcaccggaacc

SEQ ID NO: 131168 - DNA, 1037 bp, Homo sapiens
atttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtg

SEQ ID NO: 131169 - DNA, 1087 bp, Homo sapiens
accaacccttttatattcttcacttctacggtaaaacatttttgtgtgtgtgtaaaaagacatatgtaaataaattataaatgaaagccatggaaaacacttcatggaaggaatagtttttaaaactagggctaaaatcaagtataaaaagccatgctagtccttagtcagtgaaaaagactttaaaatactcttttttgtgccttaattgttttaggtgtttttatataactttaattcacaatcaaaggactccatagtcagtcatttgcttgtggacaaaagatgcattttgtagtttcttgaagaaggccatgtatgccaggtcaagtcagtggtgagggtgccatgaagtactgtggccagcgaatctcaggtaactcaggggccttggtgagacattttcatctgcttacatctcccttcgttcattcattcagtcaaaatgcattgaactcctgctttcttctagatgtgaataagactattcttgtagctcaagaaggaatataaacagaagtattatcttagtaacagcagattgaacctttgcatttacagctaagaatattgatagtgacaagtgtgtgagtttgtcactgaatgaatttaccacttcccttctatgtaatctctttatcccatttgcaggaaaaatttacttgaatgattcattttattaaataataatcctacctatgcacatgttactgttgagtgtgctatctaatatggtattccctaacaaaatgtggctatttaaattttaggctgggcatggtggtgcatgccgtaatcccagcattttgtgaggccaaggcaagtggctagcttgagcccaggagttcaagaccagtctgggcaacatggcaaaaccctgtttccacaaaaaatacaaaaattagctgggtgtggtggcatgtgtctgttgtctcagctactctggaggctaaggtgggaagattcacttgagcccaggaggcagaggtgacagtgagcggagatcgtgacattgcactccagcctgggtgacagactgagaccctgcctctaaaaaagaaatttttaaaataaatacatttcagtt

SEQ ID NO: 131170 - DNA, 1116 bp, Homo sapiens
aacatggaactgagtctaaataaatgtatacatttaattttagtaattttagcatagtcaaaattcatggtcagcttgagaaagtgtattagtttttgttacagtttgtagatttttattgtattataaggccagggggatttcaaaacatattagctttactagtaactttttttaggaatgattagaagtacccagagaactaatgaaataaatcccttaaaatatcagtcatttttatccacttgatagctacagctcatttgtctcagacctctctattgacctaataccaattaagaaaagcaggcaaagaggttgtaaataacaggtagtgaacatattttgcaatacttgtaagaagaatcagaagagaaatttcctggtcctttaaatgtcagaatggcaatcttatcactttaagggagatataaagaactcttaaaacaccagtttcatcttggtaaagttctctaaaaattccatcttagtttgtgattttccacagatagaattatttctgtggagcagcaaattaacccaacatagttattatgcatgaaagctacatgctttgaactgctgtctattaaagatcatttcactgtcttatgtcagatacactctgctgtcaaactatgattgggaagcaaatacttgttttagataaaagggttggaagtgaataatgtcagtatgtgaaacagtgttttataattagcaagtaatatgaagttaatacctggatttccggcaggcgtttcagtctgttcactctagggacaacttctgagggaagctgatctaggctgtcagggaaaactctaaaaacgaaaattactaaggcctatagtttggaagaattcagatttttaaacacacttccatttcccccaaacagttatttgttaggttcttagttatttatagtaaagtttatgtttgggtagaaggagctggacacttttcctgggcagtgattttagaagtaaaacagatgtgtgagctatctgagtttgaactaatagaactagaaataaaacagctgatcctagactatgctgtctgctaaatccttgcagcacacaccgaggaagacaaaaagtggtaggaaag

SEQ ID NO: 131171 - DNA, 1052 bp, Homo sapiens
tagtacataaaaatattaaactacctttactattcaatgatagttttcaccaaatgctggcaacatagtcaaagacattcctacaaagcacagcactcgttatttttgttatgagtgaaaatctaatttacatataataaaatgtcaattcacatcataaccatcaagataaatagaaacatttatactcttcgatgagctactctttttgaatttaagtgctgtgcttggctctttgcccagagaccagttgaaatagcctaagtttaacagagaagtagggatgaagttgaaactgacttgtgtgcaaatgtaaagtcagattggcctatgtgaatcaacagttgtcattgcagatattttaattgtgtgtgtgtgtgttttgagaggaaaacaaaaggaaaaactacttttctgcagggaaacaaatggtaacatttctcaatttgcacagtgaaattatgatcttattccaatcagggattttaatacatttgcctctcactggttatgaaaggaaaaataatcaattccccttgccttttgaggctccatgaggtattcttgctctattttagtttccctagttagtgaaataggtgcattctttttatatatatacatgtgtcctacagtgtcattgtgactatagcctaaagtctttgaaaaaagaaagttttgtaattttcttataaaagtacagtggttaatgcattttttctttaacatgtatttggatatatgaagattcatttaggcaaataggacatttattacttacttaccacactatctccttttacctagacaagtgcatttgaaatgagatatttaaaatctagagaacatagcaagatgaaataaaagcctaataaaatgtgtttgggctagcatcaaaacctttgaaataggatatctaaataatgtgcattttatctcagagggcttttggttagttctagtgtccagatgactattaatgggcttttgtgctctgaagcatatgttaatagaaatgatcattttggattagtttgatgtgaattaataag

SEQ ID NO: 131172 - DNA, 1024 bp, Homo sapiens
ttctttatgcagtgatatctgtataatctatttagctcaaagataacattgagtttatatccacgtatgtttatgaatgtgtaatttggacacctgggattttattgtatgtagatgttttatccgttccctttttaaaatccaatgttctatctgtaatgctctgccactacacattctttcaaaaaaattctgattctaaatctttaatgatgatatgcctcaatcttcttttaacatagatagctcttctggaaaaaaaacaaaaaaacaaaaacaaatccttcaaaacagccctcttcataacaaaacatcttagtctttttgccaagttagtgaaggaatactggttttttttgttttttgttttttgtttttttccttaactacgcgtgctttaaaatctcagttaaatttcttccttgagcattactttcttagagtggcctttcccactgtgttcatcagaacattagttttgttggctaaatggcactatgtgacataaagccaaatgagattgggaaatttcagtctagattggacacacgtcaccctctccaatccctaggacttcttagagctgtaaacgctaatgtacattgtggatctctgggagggatatgtattatacagtttccattaaacttaatctgaccaaggaatctcctttcattttctttttttgaagctaatattatgggaagagtctagagacaagtcttgggtttcttgtcatctatgcttaaacagttaccgtattaaaatcccaggcagagcttagctaaacttgcagtgagcatggcagaatgttctgaaataccataatattttttcagaaaaggttcttatagttgaagctttctaagcctgttacttatccaactccaaattatgaacggattatatgtttactttttttgcccatatataaagcttttcatatcctagaagtcaggaaaaagttatttaattttattatgagaagttgctttcaagtatatatatattttaagatcagttt

SEQ ID NO: 131173 - DNA, 1036 bp, Homo sapiens
atgtgttaggcattatgaggcagattcgaaagttaggataatctggtactctgtgagaatattgggaagattgtatattcattcacttgacgtaactatagaggcagacaaatatgtttgatagcagcctttgtaacatggcgtcttgtagattgtgttctcttgtaagtttcttaaaatgttatcactttttgcattggttaactgttgttaaagtgattatgagaaatgcattgggaaaccaagtggtctttagattccttcagacccaacttgttcatgtgctaggtctgcacctagacaagcgatttaacttctccatgtcttagctgcattatctgtaaagtgtgaatgataatagtacttaaaggattgttcatccaaattaaaatcaaatgagataatgcactcttggcacagttcctggctcatataataagaacatgaaatattttttattagctagaaattcaggttagaatatgtatcaacactgaagatcataggccttaaaaaaacctacctctgacttttggtttctttcaacattcaattaaattctgaaagaactatttgtaaaacacctgaacctggaattatatatgtgtatttcccttactctgttatgataggggtccacaacaagattgatggagaaactaataattggggtgcagatggtgaaaatcttttctaaaggtgtgtgtgtgtgtatggctccgtgtatgtttagatagattcttaagtttatactgaatttgaaagtgaagattgacgagattgcctatacaaaatacttaacaagtgagctaatttctgcccgaattctgtagtcttactcctgtatgtcacatcactattcttcctctcatatgtgaatgtgtaaaatagaggctgtgtgggatgggtccagaaggaacttgtggtcatcctctcaggcttgaatctcaccactctatctggctttgtgtttacaattaatttaagtttaattacctgtttcagttttactttgacatctacctaacctattttt

SEQ ID NO: 131174 - DNA, 1050 bp, Homo sapiens
tttggtgaaaaccaactggggaaattacgtgagccagtaagcaaatggctggtcataataagtactcaagaaatattagttctcttccacctttatgtagcttgtctttgtcatataatcaaggtagtgcatcctcatggaacatttaatatctacagatgtgtgtctgtgcttgtccttccaccaccaccaccaccagcagaatcacatacagagttcttatcctctcttctgtttgcctgtctctgattatcttcacccctgtgagggtgtctgttgctttcttctcttgtttttgcccttcatctctcttttcaaacccctcaccctttgaaatcccttttgttcagaacgctttcttttcaatttctcttctcttccttcttttaccacctgtttgcctgctggggcacatcctggccctttctcccgtacaattcagcctgaggcgtcaatgacccattccactccattggattgcttgatttgctcatcaaaatatcgcagctcaaaggtttctcttcattatattactccatgctctctgcagagcaactgctgtttcactgaaaaatcgcacacacactcttaaactttagctgaaaagtgcacagatcttaagtctgtagctcaatgaattattacaaaacaaatacacctgtgtaactatcactcatgtcaggaaatacaatattgccagtactctagaagccctttgtgctcctcctggtctctttcttcgtcctccaggaatcagtcactctcctgactgctaaacactttagatagttctacttgtttttgaactttacacgtgtccatatacattgaaagcatgcattcgtttgtgtctgccatgacacactcagcatcatgtttgtaaaattcattcatgttgtatgtagtttgttcatttgtattgtaccatagtattctgttgtatgaacaggtattgtattttataatcatatgccacaactttaaaaaatctattctactgctgatacagatttagcttgtttccagtttgagaaattcaggaagtaatac

SEQ ID NO: 131175 - DNA, 1117 bp, Homo sapiens
atgttacaacaggattaaaagtactgtttggtactctcatgatatgttaactcttttacgaagtcatttaaataacagtattgtattttctgaatagcaccctggtttgcaggctcaataaacaagttatctttagcaggtatgaagatggtgataataccaccagataccagtactgtttaggtgaaatctgtagtaatttgcttttgaaataatcaggtaaaactgttactatgaaatgctgttttgcaaaaagttcaaaagactaatggatgtgattaactttaagttatcctatagagtgctactttttcttgggtattatgttgcttctttaacaaacatccttttctttccatgtgtaggcttatttcctgtagagagcagtaaaacatgtaaagcattattcatgctttgacttctagaacatgtaaagcattcatagattggggatcagtcaactaattcttactttgcttaaacccaaagttctcaagcttgtttaggtgactgtagtcttggactttgtgattctgtctgagaaactccgtggaatagtgttaaattatcatatcatacaaagatggggcaaattatgtgcaataaaatgtgattgtatcatatctgtgtgtacctacaaaacaaagactaaatgccacatgaaatagttttaaggaataagattttcaagttttcttagcacatttgtgggctgcctttttttttgttgttgttgtttgttttggttagttgctagtacacattagaagccatttgatactagaagccaaagtcttaagaaaatattaaccaggcataaagttgaaaactgatggcattgtacctattaacttatgttttttatgcaaaataagaaaccactcatcattattctgtttgtgagatgggatacctcggtctactgatattacatagatttacagcaaccaccttagatgaaggtagaatctagcacacacttcatgtaaacacagcatttattcagccttataaaaatattcagaattttagatacatgaatcctctgaaaaaaccacagtattgttttatttgctcatctgttccctccggtcttcttgggtaagcaggttacctt

SEQ ID NO: 131176 - DNA, 1016 bp, Homo sapiens
aaattatatgtatgtacatatacattaatatgtaatatatagaatataatgattatatttacagggttatatttaattcctgatgataaaaaaaggacgattggcattatcttatcagaaaatgaaaaaatgcatcaaaatcagacaatattttaaagaaaaaatttatgtcatttcagtaatgcttttttacttgacataattatgtaggaaaactatccataatccagtagtaaacattatgtatgaaaacttgatgtgaacttttgtcaatacatatgatacattattatctaatgttttcaggaaaacaaattttctacaacatttatgtgttaatcttttatttcctggaattgaaaaatttaaccaaacaccacagaaattgctaataccactgaacttgtctcagttcccttaagaagccacattctctcttcatctgggcctttcccaggtctcctgccatttcttctgttggaatcactcaatcctctcttttcacctggccagtttttgctatccttgtttgtgttcttcctttttacccccagaaccccttgttgttataccaaactgggattagtcactgctcttccttgtttatttatttcttttctctaggtagactataagctcactcagggtaagtttcttctctgccttgttcacagttgtatcctcagcaccttactcaacactttactcaatgcctgacacatagttggccctcagaaactatgttgaatgaataaatgttacgtgagttttgacttaggagcatcagttatcatatcacttggtcagtttgcaatatttgcccaaaaataggatttagtgcaaaatgagtgctgatgccagcagatatctttgaccttggtttctggggaaaaaaaaattctcatatcagcttgtttggataattgcttgcagagtttccatgaaagggaagtggtagatgcacaaatggataaagtgtaggactttttgacaggactaactgcattctaacttat

SEQ ID NO: 131177 - DNA, 1060 bp, Homo sapiens
taatatcaatatgaatgacaacaaaagaacactgtccaggcaagaatacaaataatgtaacagataaataaaatattgatagtcataactccaatatagctatataaagatgatcatagcacataaattctggaaaaatccagtatcattaatgtctccattaatgtataccagtcaccccatctttttatctgaacctgtgcgatatttctggggttttaaaaattccacttccttttacgatcagagttgaagatttgttttgaaacccatcacttttcttcattttctacctttcccttcttccgtctacatgtcacaccacatctagtttagttttcctaatctcttctttttagaaacttcaagtggcttcctgctttctccaagtggtccagcctcatcaactgggattcaagattctgtcttattaaccttggcaaccacgtcttccatgtgagccatttggtttaaacctagcttcttctctgtttcttgacatatgttaatattgttagcaaccgtttgtttctcttactcctgtttgctggaatccccttttctgtcccctgtagctgtgcaattcttacttctctctcaggataatcttcactctcatctctgttaactgtttcctctgccattgaccacgttggttattttattatgaacgaaagaaataatagaaatattaataaaagatagcaaacatttagtacttactgattacttttttgtgtgtgttttttttttgctttttttgttttgttttgttttttagatagagtctcactctgttgcccaggctggagtgtggtggtgctgtctcggctcactgtaacccccacctcccaggttcaagcgattctcctgcctcaggctcccaagtagctgagattacaggcacccgccaccacacccagctaatttttgtatttttggtagagagggtttcaccatgttggccaggctggtcttgaactcctggcctcaggctatcctcctgcctcaggctcccaaagtgttggggttaaaggcgtgagccaccacgcccagccaa

SEQ ID NO: 131178 - DNA, 1025 bp, Homo sapiens
tgaatataacaaaattgcccattttttatggagataactaaaattgtgataaagtactagattttattaatgaaaatattattagtctttaagttagtcatgtactttgtcatatagcgttttcaaggagctgcttaaagtgtttctgatattttgaagtatatttacttacacaaacattcttgagtagatggaagtgtgtgtctcatgcattctcaatcagaaactataaataaagtcacttaatcaaaatttaccttatgtaatagtttcaaaagcacatgaagccttttggagtgactaaggctatatatgtatataaggctactgtatttttagcattctgggaactgaggcctttatgtttttcttaaattatgaactttaagacagtagctatacgtggatccctatcaagtttttgccttctttacatcatcaagcttatttttaaattaattcttgttacggacatgctttttataccctctgtattaatttccttttctagaagtccatattagtaaggccatatcatgaaaattagtatttttagtagggctgttctgaaatttttccacaagagatattttgcaatgactgagctatattgattcatataatttgtatccaactgcttcattttgccttgagatttccagtgtacctaatattaggtaaagaaaatagttgatatatgactggatgtgaggtggccattttaacttgtaggtgacaggatttatctcttgatttcttcgttaattttaaaataaataaacaaaaaacaacataaggaagtttagatccttctttttaatttgtaacacttcaacttctagtattgctttctgtaggggagaatttttcagttgataacatgagttgatttcataagttatagtatttaaaactagagatgttttgtcacaaaaaagttgtccctttaatatatgatttagcacggcaactctttttaaagtaatatgtttaagagaaaaccatgaccttatgataaaaataat

SEQ ID NO: 131179 - DNA, 1129 bp, Homo sapiens
gtatgtaggagtggatgctgttgaagatgcctctattgccagctgtacagcatgtgtgctgggctagtttcctggctgctaaagctgcgtggtgccctttaatgatgggaaggaggacattaaatgtgttgggcttagtgttttcacttgtgaacatcagggagcagagggcatgcaaactttgcccaaaggctggacacggtttgcatagaaatgagctgcgtgtagtaataactgacttggtagatgcgcagctaagcactgattactaagtaaaagtgagtgcaacctcaggccataggtgagctaggttgaccagggaaaggctgcgttccaagaggtttgtcttccattggggccgccttaaaatgctgatcctgattcacactggttgagcagtgtgctgtatgttgtcttcacttgagatagaaactgctgtcatttttattttatagaatggagagaactgggtctcaggaaagtataataaattgcctaggctacaacaggtagcaagtagcagagtcaggatttcagtccaggcagcctggccctaagagctgaggctccctctactttgtttcttatctggtgggtgaacaagatttgagttgctgtatcttccaaggtagtattataatggtatttcaaagactagctgactttttaatgttaacagtgttccaatttgctttctccttaggccctaattcattgtcagagataaggccatcacctttatatatgagacatttaaacaaatgtttttagtaataattcaggaaacatacaaccggtattctttctgtagcgatatctgcagtctcttgttataaaaagaactctattagtttaagtaactgtctcttcttggccccattacagtaaaaagtctgtgatcagcaccctcttggaaggggaagttgttgaatgacagggatgtggtactgtcctgataatcctatggctttgtatttcttagtttatttatactcctgggtaactacccctgctccacatggagtattgacagctttgaatctgaggtagcttatgtgtgctacaaagacaaaaaagaaaaaaaaaaagaaagcgtggtttgggttagacttaaaaaagtactttcatc

SEQ ID NO: 131180 - DNA, 1051 bp, Homo sapiens
aattagttattaaaatctggctggaaaaaccataagtggtgttttacataaactcctcagcatttataaaaaactaatgaaagaaaaataaaagaacctcatttattttaaatactttccttatgaatcctgtcttttgaatgataaatttcaacttcaaatgtagtgaaaataatttaaaatatacatttaatgcctctatttttcttttaaatttctcaactttccatttctagccatgacttcacagtacaatatggatgccatttatgtttattgattatagttaagctaattttaatcatactttgttggagtggaaatacaggaatatttctctgtcttcttagacttctgaggtattttacttaaatcccttgtttcttatctttcaaacctaatagttatattgtatagtccaaagggtgaatgcccacataagtgaaattcacacattacaaccccaatgctattgtcattttcacctctggattttaaagaattgtggtaaataccatgcagaaagatgttgaacctaagacagcccccaagctctttcagagcatagctccagaagtgtctttgaaatgctggaggaggtggaggaggaggtgtgtcaggccctggaaaccgctgggctggtccagggtctgtatttgaaccccgttcagttcatcttgagtcgcagggtgaagaagacattgtacttccatttgcatggattttccgctctgtcttttagccagaaggcagccttgtcttttttgttttgttttgttttcttttttggttgttttgtttctttaatgtttctttcaggtgaaaagccttttataaatatcttgtaaatagttattcctttaaatgaaacagtttgctggtggaaaataatcttactcattccgtcagatataatcaattaaatcagaaaactatagaatgatctttgacattaaaaagcaattttaagatgggttaaggaactattttgactagtatgctgatcatcccacgtaaaatctctttcttggtgtggtgagcatactatatg

SEQ ID NO: 131181 - DNA, 1003 bp, Homo sapiens
ggtgggggtttattttcataaacaccattgtaaaaataattgatgaaatgttttttgacaaaagatcatgtacatatatattaactttctgagctaacagaatgtacattttatttcattaggttacattaataaaaccatgtacaaaaacatacaaatggaagaatagatgaaatcacctccctggaatcagatgtagggtaaatggtgtagtctctgagatgactctcttagttctgtgatttcaccataagagctggcccccatctattctgctttggacacattgtgccaaagtgtacaatgttcagcttcccacaaaaggagaaaatacgggtttaggcttaagattcttctaacattctgttatggagaaatagaccttggccaaggaaacacttcttttctcaatgatggaactttcttcagctggtcagtctaaaatctgccattcaagtttggttttacttctttgtttttctttacttcaggtatatcaaagtgaacattgggtcatgttttattctgagtgacagaacggacttgagctactatccattctagcatgatcttattttacaaacaagaaaactgaagataaaagtgacttccccccacttggttaaaggactgaactagaacttgggtccgttcaccatcctcattcatatgtgaaacactaggtgattttgatgtttgctgaggaaatttgcccactgtttaagattcattagtctttatttttccttttgcacatggatatgagaatagaattaaaatgtcatttattaggatgcagtgagaaattgatgatcataatgaatcagttgatatattcacattatttctttatcagtactttagatatgggcatcaaatgtttagaagctatcacagaaagttaaagaattactgtgaaaaatctaggcttaatgcttttttcagacaccttagcaatagtaatgttggattcatttagataaaatctaattggtactgaaaa

SEQ ID NO: 131182 - DNA, 1066 bp, Homo sapiens
ggcagaagaatacttgaaagattctcaccatcagtatgttttagattcccaagaggtacaatgccaagtgtcatgttatcaactctttgaggtctacagtaaggagtttacttgtttctggtagcttataaattcaataacatcagtcacaggcttcttaacgtatttatgagttgagctagtgtagttcaataaatgattgtacttccatcaagtcgagggagtaacgcaaactagaatagtagccatctattaaggatagttctgaggtttggaatttgtaactgatttttaggagctacgacatgaatatcatatcaggtagaaatactcagagtgatcaccttttatgaaagttagttctatctttcatgtctaggaaaatataacagtgaatgtttgctttttgtatgttttgtctccaagcagaggaaactgacagttttatgttttaagtgccgaaagttgtttttggctaggcagttccagagttaatcactgggatgttaacttgaatttttgtctttaaaatgttttagatttttaaaacgaaatatgcttccattatttccaaactgacaccttgtgttctggattagtttttagagaaatgttttccaaattctcttggattacttgaagtccattgattttgaaatatttagtttagtttttttcttttaaagcttatcagaaagtagaggaagtactttatcttttcggggttttcttattccagaaaccttgttattgcctgtaaaatgcaaatgaattttgcacttattttgttttattttctcttgtgttttcagaaatgttttgatgcatcagaaattgagagatcagtgatttcagttctcctgtcacacctttttatgataaaatattttggtcatttctaaggagtagttagagggaaatcctttcataaatcattttcacttcaaaaaaacagtgatgttggaaaatcatatagtattctttgtgattagttgaaaattatgaatggtgtaaaataatatgacatttaattgtttctcatttagacatgatgcattttatatct

SEQ ID NO: 131183 - DNA, 1027 bp, Homo sapiens
tggtaaattactgtaagaaactcactgtcatctaaacctcaattataataaactattttactctatcccatcactgtttattctatttttaaagtcccgtttttaagaaaacttgtgcttttgaaggaatgccctcattatttataacatattttgctttttctttttactttgataagctttaagaaagctgccagtaagatgattttaggtcattggtaaaaataataatgtacacattttatgtgtaaatatgtgtacacaatcttgcaccttcactgtgtctaacattcagctttttagtgttatacatatttttattcaacattacacatatttgtgtacatttagtgttacacatatttgtatttagtgttacatgtatttgtgtacatttatgtacatcatgtactttttactcccagaataattcagtatatcactgttagcacataattatggacatacatattcttctcacttcctgaacgattcagtgtgtccttggcaatactaacactttaaaaatgagagtaataatgattagagctggagaactgggggtagatagtagtattagcaggtttccctccttttaatttttcccattttcagttccttctttaaaagagagatgtatatatatctgaacagaagggggactaggatactgtataatccatgataacataaggaacggttgctgcatatggctttatttatatatctctgacatagaaaactttgacccctttgcctgttgtacttgggaattttagataaaccccactggggtcacactcatcagttccggctttgcgtgactcaaggcattctctagcttctggtgcgctactgtgctgttttccttcaggagtggaaggtcctgtaagttcatttggcatttggaagcacaactagatttcttcctttttgaaaatcctctgactgggttacagaagagtaagcagagatcatgggcagcatgatgtcgttgattttaggatgctaaagaaaattatgctga

SEQ ID NO: 131184 - DNA, 1408 bp, Homo sapiens
attttttaagtctcatttctgttaagaggagcagttaagggacaggactgtttgtgagtatatcactttatgggctaccactttatagtttacaattctatcatctcaaaacgttatgtagaaataatatggaacatgtaaagactctgtactatgacccaatgcatttttccctagggtgatggattctgtgcgtcacccaaatgtgatgctatttgccaggcttgtaatactggttttgagggttgatctatgtcctatttcatcaagcaacacaatacaacaactttggtatctagggtaattgacacagtcaaaatagtctctggaaaacattccatatacttttaagttaagtcagaagttaatgtacatattaaatttatttaacatgaataaacaaatgatttattgttagctatttgtctaatatactagatagtgttagaaggaaatatacaagtatttacagtttatgttccatttctttttttcttttttgaggggagcatggttctcttgtttgcgttcataatagctttatctgttaattactttgtattcatgatagtgagtagtatagtatcataaatcatagtaaacatgtttatattatctgctatatatgtcccaagcttggaaaaagcattaatattactagttgttaaattgagtattatagtaaccaggaatgaatccagtaccgtataagacaatagataagacatcaactgctatttaaacactaaaaataccttagctgtagaaaaagaaagatcaaaaggatttcagagctgtttttacttgtagaatttggacagaatgtataaagcttacaaatcaataaacattaataatataacatgtgcttcctgattagattctacaatacaatgtgaattgctatttcaatttctctacatatcatatggaagatcagatatgtttataaatagtgtaaaaatatatggcagaaattagtttgtggaatctaatttctctattacatgatacacttcatgtacaaagggatcaagcattactaatctagtgttagcttttgctctctgagctatgcagaagtggaatatatgaatttgtggcttcatattaaataagtgcgtacatgtacatgcaggatagctatagtctcacttgcttagaatgtttttacattacaggcactacatggaattttagcatattgcatattttttgaaatgactttagtctttgtaatgcccattttaattacttaatgcatcccaacacctatttgagggttaatttaattgtaattttggttctgaaatgagagcatgatagacaaaacaaattaaaaaccaaattctacttgtgcctactttgtgatgtcattatctgcacatcatctttagctttgcaagat

SEQ ID NO: 131185 - DNA, 2069 bp, Homo sapiens
agaacttagcatttcgatgactaatattttaaatgattttataaaattttctgcatacgtgtttgaaaaccagtttaggatcggaatcagtgtgctaatccgaaataagttacacatactactaccatattttcagtattatttaagtcacctaccactcctgagtttattctgatttacatcatatagatctcttcctataaggaaatattcattcataaggaagacctttaaaacagggaaatgcatgcatctgtagaaaagcagcttttacgattctagtatttcagtgacggttctattatcactactattattagatgtatatgtgtatgtgtgtacagacatacaacccacaatatgtgattaatgatgtgtacatttttattaagaaagcaaccaaagactgtagatttttataaacgcttgtcttaccttctttgttgtaaataaacattactgaaagtttccagaggacttgcagcaaattgtttttgaactagaactttattccaaatttgaaattggaataaatgctgataactgacctttaaacatttttcataacatgaatattttagaataattatattttaacttcagttcttcttttgatagcaacaataatgtaacaacactatgctattacgtgtacaacaacacagactttaagaaagttatgggcaggtgtctataattgatttaaaggaaagattatttttgtaataagtgatgaacttaaaatgactggcttacattaaaacatattcttattaagatttctctggtgtgtaaaatgaagccattcattcaacaggctgacaactttccacttggtatttgcctttccttaatttagtttccgcaggacagctagtgtggtagtctgcatctgtttttagcaggcatagaaaactataaactcagacagttctgtcccaaatattgcagctcacaagttacaatcaatttgataaaaacccgcaagttttatgggctcgtattttgttgttcatccttgctaggtcaagctttcaggtaataggtttctttttctccctcttttgctgatgataactgctaataccattgataactaattctgagtcttgtttactcatttatcatccttatttaccatttgttgaagttttgggaaattaatgacagcatacgtagacttgcgtttactttgatggcttatctgtgaaaatgacatttatcttttgttattatacagaaataagtaaattctttgttaccataatagttatgatttatggaatttttgagtcccccttagatatagcataaagatggtcttctagcctttgccaagtagacatttaatctaattgtttaagagtgcttgtcatgtatagaaaagactaacatactttgcaattatttacattaaaaattatgtagaggtttgttttagtgtaattttaaaaataatttgtctcccaaaagctgtaaccagtggattaaagtaaataagctaaaataccaaatcttgttttataccattgttctatagcaaacagtgctgcagaggatgtaactactttttaaaatttatcctccgatgtaagtagggccaaagtcatttgtttgtataaaatattctattaattatatatgacctttataaataatatcttcgattttattattatgatcactttttgagctatcacagtgctcagttgttctcctattcctgagaactgaatttggcctttagtttggttttctgatggacacaataatgtagaacttgactttggttagaaagagatctttgagcttcaggaatctctgaaggtgcagtaggatctacaggtgaaaaccatttgaattgttaagcattagttaggtgaagaaactctactggtccctgcagcatatagcagctattatcgtagcggtctactttttgctatcccagttttttttttttttttttttttccttttccaagagcacaaatccaaatagcaaaaatgaaggtgaaattatctatgtacttcaaatttggagcatcatttgaaatcattttctgattc

SEQ ID NO: 131186 - DNA, 1059 bp, Homo sapiens
agtatacacattttccattctgataactattgccaaaatcatctccagaacaaaagtactcattatctctttaccagcatggcacgaaagtgcccatgggaactagacaactttgaagagacttggaggcaatgggcagggctgtatcatttcctaccatctgcggaagctaccctagatcttccagggttgctagggatctataatcaagttgacatttactattcctctctatgtgccacagtcagtggggtaatgcagcagtgcagggaaagcagtcaaccagtagctctagacttccttgtgtttctggggttctaaaccaaagttccagagtttctcttgagtctacttggtcatctacatatattccatgtgacaaagtctcataaaatttagttatgtgaaagagcatcgagtctaatctcttcatttcacagctaggaaaatggaaatccagagatatttagtaactttatcaagggcacaaaactagttggtgaaaaaaaatagtaataaaaccaagttatagctcctatactatttttctcatccatttctatgttagattatgtcatatcaattcaagcgattcttagatatgttaggcatttcgagaagtaagttatctctttcaggatttgatttttaagtcatatatcatgtagcatacctcttcccccaacatttgacaattatctttaaatggttggcaaattaaaactagaatataaattaacacaagtagcattcttgaaaattccccctaaaagaaattcttacaaatgaaataaatttaaacatatcatggaaacatgtgactaagcttttgataactatttctagacaaaataacattatatgatgggtaaatttggccatttgtactctggaggttcttacttgagacaaatactgaatgtagggcacactcaatgattaattctgaggaaggaggattcgtgtcactgttctgcttggtggatttttttttgaccaattcctcattgatacagtcttccccaatgacatattttggtgcctaacttagcttaagtg

SEQ ID NO: 131187 - DNA, 1036 bp, Homo sapiens
caaaaattatttagatgaaaattttaagaaaggttttgtgatgcgaccatcctaagtaggtaagtgaacagtagcaaaacagaatgacttctagagaattcagagaccacctttcctaacttctcccataacaaatcaaaaatgagtagcaaaattaaaaatatgaatggaggatataagaaagaaagaaaaatagaaagcaaagaattgtgtggggaaagaacaaaggagaaaaataaggttgatgaaagaaaataaacatccctatgcctgatgatgttaccacattatctcatttgattttccctggcttttccatactgaataaactggctcctagttaaatatgttgtccagtgttatagaaatagttaatctagccaagctggaatgcaacgttgggtatgttctcctaaaagccttctatttttctagaccaacataatatactctgccatacttcactttcatatgaaaaatgacctctgggaaaatatttcgacagttttccttatgaaagaatttagagtaaatgaacattacttatgacccagaatatggataagcaaatccataatctttgcaaagcaaccacatgaacgttgttgagaaagataaacatgcttgttgattatggagcactttctgaacacaatggatgaagaacaactttaactccttggtgtagccttctgtatttagactttataaaactattcctcatagtattcaggatccttgttatgtggagtaaccaatttttcattcgtataagaagtaaggattgtgaaaacattttctcttctctagcataatgattaagagcacaaaacataggagtgaggcggaggtggatccattcctgccttctgactcactggctatgtaacttggataagttcttaacctttgtaactcggattcttcttatctctaaaatgtggataatagggtattgtgatgaataaatgagagccagggtcaagcactagctcaacacctggaaaacaataacagctgctgactactataactg

SEQ ID NO: 131188 - DNA, 1048 bp, Homo sapiens
ttggccatactcctgggacaatattcttctgaggacactgtttaatgtcctgcatgttaggagttcctctattccggctggtgaagacaacaactcttcatcatcctgttttccctggagatttttctgctagctcttttccagtggttctttctttggccttggcagttttctcacatgcatgtgataatcaatagttagcaaaaagcttcaggggacctgtctgcaaatatccagaactttatcacattgaagctttctcctctgccccagagttttttccaccttgggctttctcaactcggggacatgggtgagttttgcttgggttcctcctcccagtggtgtggcctgaaaatgctctccaagtattaagctcagtcactcatagggcttaagttatttcccttctctcaagattactattctacattgcccattgtccaatttttgaaaactgtagttccatagtatgttgtccagctttttagttgttgaaggtgagaagttaaatctgtcccctgttattcctttttgcatgggagcagaacttctcagcttcctggctctgtgctctgcttctgatgctgcctctggcacttccaagatctaccagtcttcccaatctttctctgggtatttgaatttaaattttctgcctagattctgacttcattcacttttctgaccctttatctctgatcagctcagctgaggggtccaagcacatgctttgccttctggattttcactcagcctcaggaagcactggttcctttgctgggggtggaagtcagacaattacctatttaaaaatctgtaataatttgataggtgaaaataaaaacttgttttgatttttatttttatggttatttgtgaggctgtttatatttcttctttcatgtgtagacactatccactttcaattttctatttgctttgtcccagaggtgccacactggaaactttagttcctactgtagtttggatagatttatgggacaattgattatgccaaaatcccagtgctctcttcatcaaatgg

SEQ ID NO: 131189 - DNA, 1175 bp, Homo sapiens
tgaaagatttcagtaatttttgatttgggaattaatcatagtgggaaaaactgtttaggaaaacatgtcagtggaaattaactcgccacagtatgtagtgttagggaatagcttctgttcggcatttgatttgagtgctgtattctgacatttttcaggaacaaatacatgtgattcatcttctataaatatttgcagtttcttcaagttgaaatgagaaaagctcgtaaattgagcaccaggtctaataaatcattcacttacccaagaacagaaagacaggaaaagctagcatgttaatctaatgaaaaaatcgaatgttaaaaaaccaagaaagtagaagatatttgacattaactttctaatcattgataataatctaataatcataacattattcttaaaacctgaaagaatggattcctgctcccaatgtgtttttaatatcaacttaaactaaaataatttttttacctatttttggaagcttggaaattgagatgtagttgtctaatgttaacctaattaagagagcttggtgtgatttctcatatacagcatctaaatatttaagttttaatgtcttctaaaatattattacattcttcatactatagttttttaacatcctttagaaaacttgtatcagcttcactttcaaaccatgctggcatcgaactcaggtgtagtggtatcagaatgttatgaaataattttttattttcattataaactccatttttacaataaacacttctcaaccaaattaagtatgtaatacactgtcattttaaaaaaaaatctcactgggcatctttttctatgctagctctgtatttttaaaaattctctcttttttttttctaatttaagaagtatttatcagatacctactatgtcaagcactcttgatgttccaaagcagacaggacacagattctgcctctgagcttattaatcagcatatgacccaagaagggaacatgaagtcctacaagctgatagagtatgaagtcataagtgccttggagagtgctttgggccatgttaacagaggatccttctgcaattgggttgtacagaaggggtgacagtggttaatagtcattgtggtaaaaggataaagatctgagtctattattgaaaagtggtgactcccaagttggagtcagaac

SEQ ID NO: 131190 - DNA, 3789 bp, Homo sapiens
aaaaaaaagaaaagaaaagaaaaaaagccgtaacagtagtgaacatagcagtaataacatcatctgtattgttattttaggtcaataggagtaaaggtgaaagaatttccagtgtggtagttcattacttagtcattaaaattaggatgaatcatttattacctcattgtcatgaatggtaaaggaactccctttaccttactagtcatgagcttctttccctttaagccccctgttacttacataactagttttgttttctgaatcattagttatagactcttagagctagagtgacactagagttttcaacaaaggaattttcttctgctattggcgtatttagcttcttagacgcaagttaccaaatgttgccaatgataaaaactgaggttggaattcagagcagtggggttctgctggttgtgtaggggaaggacatctttttttcctcctcagatggagaaaaataaccaaaccattttccctttgaattttagtatcagcagcgtcgccagcaggagaatatgcagcgccagagccgaggagaacccccgctccctgaggaggacctgtccaaactcttcaaaccaccacagccgcctgccaggatggactcgctgctcattgcaggtattgttgcccagtgcaaaacctggctggttttgttcgtttcttaggaagcagaagacagtgagaaatttacaaacagaaaagcatgccgtaaaagctagtatgtttgaaatagttgcaggatgaatttgaatctagcacctgtaatatctgaaatctaagaacttgtaagagtttgttcttttgtccaggtcctttcagtgcttcactctgtgtttctaaacatttttgagatggcataaactttctaaaatgagtcctttttcatggaaacccagaaaaattgtttacagtcttaatgcagaagaccacttagctcaggcctcttactcttccttttccagcacagcactgtacagtgggtacttgacttgaatttaggaaattatttcccttacttggacttaaattgtggcagcacaaatgtatttccggataaactttttctggttatacttaatgtttaataccacctttaagcaggagaggtcctgtgtcctgtactaggacttgattttgaatatatgacattcatgcccttatttggctataatcttatagaaatgttaaatgccatctgattcagtcagatccttacctgtgagaagattttatcaaagtgaaaatcctactcaaaagctgattggcaatttctcaaattatattgatacatttgtaatgtgggaggaaattccaaattccttaacattttctagtgtacatacaaattaaatttggaaatgagacacaattccttcccaaaggtccaattcaaacagaattgagatccttatattttgaagaagtatgtaactgatgtaactgttgcatgggattagatcattaaagacataaaaagcaatgatggagccctttcttcaagtgaactctttactcttactctgtctggctcgtaggagaaaactccttaacgttcccaaagcacaaactgaaaacctaccgtacttgttcacatctgggtccagtgggtctggctggtttgcagctctgtgatttattgttagtatctcctttctacctgtgaaggctagtcagcgctgttttctcagttgtacagcattggtttgatctatttagtcagtccttttgactgacagctattatgtccttagggctgataagcttttgaggagtagtttttctttattctccatgtaattgagagtggacagtagcttattttcaaaagaacttgtatttcttatcccttatggaaaaataaactctggattcaaaacaataaacaggtgattctgttttatgctgatttttctgtttgactagctttctggatcattttacaatttgtggaacattatggctctatctctttctcaaatgcacaggccagataaacacttactgccagaacatcaaggagttcactgcccaaaacttaggcaagctcttcatggcccaggctcttcaagaatacaacaactaagaaaaggaagtttccagaaaagaagttaacatgaactcttgaagtcacaccagggcaactcttggaagaaatatatttgcatattgaaaagcacagaggatttctttagtgtcattgccgattttggctataacagtgtctttctagccataataaaataaaacaaaatcttgactgcttgctcatttgattttagatgtattttctctggcttacttttgtttgcttatacttgtttatttctaaaagctaaaacaagccctgaccggaagtttcaccaggcagaaacctataggctccaccacttttgctgcctctcaggtgccacctttcaacccacttctcccaactacttatcccagctcctgaccccgaggccctggcatctactgtgaatattttttttttgaatttttatacttcgctgctcccaaatgagcaccccgagagaagtccaggcttcatgtacttgcccaggaattccttgtccccggacccggaatcacttggcctaattccggtcagtctgccttttcatttctgcaggtgatggtcaaccagtccccgtactcataggccatgggacacaagattattattatcatcattatttttaaagacagagtctcactttgttgcccaggctggagtgtagtggcacaatctcagctcgctgcaacctccaccttctgagttcaagcgattctcccacctcagcctcccaagtagctgggactacaggcgtgtgccatcacgcctggctaatttttgtatttttagtagagatggggtttcaccatgttggccaggctggtctgcatctcctgacctcaagtgattcacctgcttctgtctcccaaagtgctgggaatacaggcatgagccaccactcctggacaggccacagaaattttaaagaaaagaatcatgccaccacaagtaaacttcattttgtttatattatttaggacttcacatttgtcttccgaaaccatgaagtataattctgctaacagcaagtgttgtgaatgaggaattaggaattaggagaatggtagtacattgggaaaaacatattttagtaatttttatattttaaagataatcacagattttgctgtttgtgcatcaccaaaatcagtgagatctgccagctggtgggggtgtgcctatgagaatttttgattatgatcccctaggagggttatcaaaaaaggagatgggtgaaagatcaggagagtcgagaaattcattttttggacaacattgttttgaaggcactactggggctctgggatcaggcagccagattgaaacctggctcctccttttcctaagttatttaacctccctgtgcctcactttttgtcaaccagataagataagaaatgagagcaggtctgttacctcacaaggtggctgtgagtgttgaagacgtttgttgggggtttgggtgaagcatgcaaactctggttggtatgtggcagccactcagcctgtatttatgatgagggaggcattctaggcaccccttccaggatgttgggttgttggctgggttttactttaaaaagctcagggcctagaacattctagaatccaagtacttgctcacatatataattatttctttaggataatctttgatatagacttacgagtcaaagggtatgtaaaatgtcagccctttt

SEQ ID NO: 131191 - DNA, 1833 bp, Homo sapiens
ataaacatgcacaactccaggatatcattcacattgcagttgtgaggtctcattcacaacaaactacattgctggggagttgtatggtgctagtgagcttcctacatgtgcttgtctggtctgcctgacctaatccctgtgctctagccatgccaggcctcttgtgtcatcaaatctgcctaattcttgcccatctcaggcattcagtacttgtattttcttttgcctacaatatttttggcatagctgactcatctttcactttcagtctgtcatctcctcaaagagatactctgatcatgctatctaaagtaagtgtctcttcacctcccccttctctttctcctccatccctaatcagttataagatcaatgaagatatagaacatgtatgtcttattcactgttgtctccctgttttctagtactaaggctggcacataataggagtttagtaaatacctgtttgcagttaatgaatgggtactactctttagaagcttgctattttaaaaatatatatatgtatagtagctgtccaggcgttaccatggtaggagataagttgcaggcagaaatcagtgaatatggtggtcattgtgccagtcattacatcactttataaagcgatgttggtaactgagctgcaatagaaatttcgggagagaataagaaatatgaaagactgtactacagattctaggaaaggtaagaggaaaggagcctcttcatcatgttttgtagaataaatgttaccattgttcatttaaaacctagatagagaaatcatgtgccagatgtcataatctgtgtggttctttcctgtgattactgataaaaatgttatggaatgcatttgggcaggagtaagttaatgaaaagaatttgggaatactgaacttggtataaaaaatatgtattatagatgtctcactaggtatgtttaacagttcctaccctaacatacctgtgctctcacaataagaaactcagctatttcaggtatccctgagattatagttggaagttcggtatggaaagtttagtaacaagttgactcagattttttcctctgctcttgcttttatgcatatgtgtgctctcattcttttagcaaaagccagttcaagttcatatcttaaaactgtttagagcagtagcaaagctataatttaaagtaagacttgtcagtatatttactttacatttcagcaatcatttggggaagaatctacagttgctgatggacagagtggatgaaatgagccaagatatagttaaatacaacacatacatgaggaatactagtaaacaacagcagcagaaacatcaggttggtattgtggaaaaattcaacaaacagctatttctaagtttcatgtatttcaagagtcatgttcaaaatgacctaaattatctttggtaaattattgaccgttagctactctatattatatttttaaaagattattatttttatggcatgtttgtaacatattatttacaggttatacttaaaaatacctgtgttaaagagagctgttaagctcagattgtaatgccaaggttatgcaaataagagatacatttattgagaaaatcagaagcaaagagattccagaatgtcacagctcatttctttactaactataattggtttggcagtggctcattgtggcatagttagcaatcttcagttcatttaaaaaacggagcaattgtgattaagagcaagcaatgttgataggaaataatagaccaactgctgtgaagtagatagtataatacagacaaaaaccctagaattatccgaatattctcatatgcacacat

SEQ ID NO: 131192 - DNA, 1024 bp, Homo sapiens
aaagaaaaggcaatgttactgaaactcctaacaataagtccctgtttcagcatcctagttaaactggtactgaaaagattcccacaaaattggtcttggtagtggtctgattttctgtcattgttaatttctgatgcccttttaaggcctgtagtacacagattgtgtgtgtgtgtgtgtgtgtgtttctgattgttttttttctgaagagcattatcataatataaaagttatgaaatgcttaaagtccacatatttgtgcttgtagcagtgttctttcacaataacttcatatacttgcagcagataatattagtactttatattaaagacttttctggtagaaacagtgggtctgttttagtagtgcctttctcattactgtaaacaacctccaagatttaaggtctaggtgtattttctctgcatatggcagtacctctcctgtgctgttattttttccctactgtcactgctttccccttaacctcccagccacagcattggtgatgatcttttctttctctgatttccttttgcaattaatgacataaatgacttaacaactaatcatgtagctaacgacatttcctatacttagtatagccctttgggcttcaggttgctcactggtaaaaatgaaaggatcagaaacctgaagctagtgcctcctgtcttcttgccttctcaggacctcattaggttgatctactccttccttcttcatagattttcagtttctttctatactagtttttttttttcaatctttataggctcatttttccaattaaaaatttatgtttaaattttcaactctttagacaatttgaaagaaaaatacagtgaacatccatccataaacctttcatttagattcaccaattgtatatcatgccacatttgcactctatctacgtacgtaaacactttttctttctgaaccatctgaaagtaaattgtagacatgacttttaacccctaaatacttctaaaatgcgtgcatctcctaaaaacaaagaca

SEQ ID NO: 131193 - DNA, 1052 bp, Homo sapiens
aaagtcttaacggggcagggagatggacgatgaatgtaaatggagtgctcagtaacacagccaggttgcaaggctaatttggcaccaaaaagcatactgtttgactgcaaacatatattcataatagtcctttaatttgtctgttttagaaggtcatatttttctttattgcttttacaaacacattgggcacacctgtatttaaagcatttagctaagaacctttttcagcatacaaggttacaatttgatgtattaagtatatagttatataatacttttaaatttactgcatgaaagcttttgcttacataattcatgtcttcaccttttcccaggctgcctttattgagcatacaaaagaaatacatccctgatggtgctttaacattaccaatgagctggtctataatgtccatttgtccaaagcagcatttataatagccaagaaaatgttctcagtttgccctagcaactgagacctagacaaatattttattatagtttttgtcttctgtatttttacgtaaatgaggaaaaagaggtcccatttctttgctttccatatgaagttatttaaagtgtaaattggtgttcctgttaggaggaaaaaaaatgaagcaactttgaagcagtgcttttttgctagtagacacttacattgaaccaaatcgaccatactattttaaaagacagaaagataagttttgtacatctcaatttttaatttctgacagtaattgtgtgatgatggctcaggccagttgccataaaagtttgtataagaaaccccatcagaaataattcttatgcaggtgcttaaacttggtctttcctttcacagcctatagacatgggcaccagtttctttgatgtgcctgataagtttgttctctgcgacgactaaaacatactgtatttgcttttgttgaaaaattcaaatttttttattttaattttattagatggaagttctagtaatagttattccataacagcctttattagtttttaaaaatgtgtatcacaggcgttcagcttttcacacatgt

SEQ ID NO: 131194 - DNA, 2402 bp, Homo sapiens
taaagaaaaggatttttcccctgaagcgtaagtgtttgggggcatctggtaaagggttgggtatttttctgttaagatttttctttgccacatctcttgaatccttggttgtggtgtggtaatgcttttgccatgtggactgtagaagttttctgcatgccgagtgctgcttgctctctccctttccatgtttaaattattctttagggaatatctcatctgttgttctcaccaagggtgaattcagttagaatgggaattaattagctactggattcgaagaaataaatgattgaataaagggaggtggaaagagtgatcagtggctgtcagattgtaagctctgtgtcagactggttgtgagctgtgtgtcttattttccgaacccttgtttaatgagggggtgggaaagatataaacattttaagaatttggtaaagaatgtggcttattggaaattttatgggtgacagttatgcagagaattaactgatggagctgttttgggatcctatttaatggcattgtaatatttactttaaataaattaaatacttagaattcttccattttctgttaattatagaaatttttagttcttattgaatcaaaattaatggttttgacttcatgtaggacggttcttctctagtttcccatttggctcctaaaaagttaaggtgcagagaattttaaaagaaaagctaactcatgaacaattcctggatgtggtggttataactaatctatgagaaactgtgttcttggcatgttctaactattgtatctggagtctccttgtgttctgctacttgttaaactctaattcaagaggctttttaaatgaacttttcaagaaatagagtatttctcatttctagctattttaaattaagttgtaggtgtaggttgtgtagcataacttactgtgacatttacattttagtatcagtgaaattttaaagatacctgataacaaagaatgagtagtttcttctgccaagaatctcattttctgggctttagctcaaattcgcatcattttcaaagttactcaaatcactcaacttatgcttgactctgtaaaactccagtttctctactttttttttttttaagagtgctaatgaaacaaagatcttggatagggcctgtaattaggtaaattttatgaagtagtcagtttagcacttacttttgaccatcagactaaagtatttttaacatgcttcacagattgaaaaaagcaaatatcacctttgagtacatgtttgaagaagtgccgattgtaattaaaaattcacatctgatcaatgtcctaatgtgggaacttgaaaagaagtcagctgttgcagataaacatgaattgctcagccttgccagcaggtaagtggccctgcctaatgaaaagcccatgttttagaactttttgcaaaagattctttcacataaactttacctgtgaaacaagaaaacagttacttaagaacgtttataggttcttaaaacatgtataacatggagtaatagtctggccctgttaggatgtcagggaaaaacgccaaactgataacatgaaacaacacattatttgaatactaattgctcatattagaagaaccctctgctgccttctttgctgtatcatttgtgctttgataaggtcagtgcccaagagggagggcttttttatatggctcagctttatttcttgtacacgatcctaagaggcttagggtattaggtctggatatttaataatgctcaggaaaagaacagaaatgcttttttcttttactggttgtacttacccttgttcagatgcagactcttgcagttgtaaaattacagttgtttgagttttcaactaaaatttgaattttctgaacctgacattggcttcacctattttagttggtgataacgatttcctccaccgtgactgccttagctatctagttgctgagataatgtttattatatttgtaaaatgcagattgaggtttccaaaaggaagtattgttccctttgttaaattaatgtttatttccccctcatctattactcttaacagaaatgtgaatagagccacatgtatagctcctcttaaatgccctttgagcgttatgttagtgattattttgtctgtggtggaaggaggctagcagcagacttgtggaatgaaattaaatggtcagagtaggtaaagaatcaatatatgcttgttggctgaaagaaacaaggtgtgttttcttaagcaaccagtttggagcagactaaattatttatcagatttctagttatcttagatagagacttgttaaaaaaaaaaaagtgtacagactttgtacttcctcgatataaggcaagtgggatgaacccagaagggccagagacatcaa

SEQ ID NO: 131195 - DNA, 1316 bp, Homo sapiens
ttcttacaaccaaccaatttagtaattacacaaatttttcttaaacatttactattttgagagtttcaaaaaggggagttagacgccacatttaataattctttggttagaacaaggtattaatattgtgtgtaatacattttctacaaaatattttttcattaaagaataaaaggaaacccctgatgatttaaaagcctaattttgttttgctttatatgtgaactgaatgaattttaaatctggaatcctgttccctattgctaataaattgttatgtagacatttgtttccaaaacggcttgtttttgatgttggtaacatcattaaaaagttttttcttttaatttcctcttccccatcatccagtccaatatcagatggaaatgatgcggagccttcgccatgtaaacattgatcatcttcacgtgggctggtatcagtccacatactatggctcattcgttacccgggcactcctggactctcagtttagttaccagcatgccattgaagaatctgtcgttctcatttatggttagtaggaggtttattattcttttttcccttaatattattactactatttttgctttctgtcctttttgcctctaagagcagtctggcaggccttctcaagtaaataccaaccctgtttctgcagcagcctcagcagcagctcagtctagacagggtttccttctttctgtttatttttcttgctatcagagccctgatgtgtacattttggaatgctggagtagctgcttcatttctattcctccatctcccctccctcattgaaggggctggtggaactagaccagatgtctaacaaaccccgattgctagagtgtctggctctgtacgtgactgaccaatcataatacggtgtgccaagttttttttatacctctgacaacagcgtacaaaacctggactgtttcttagcacaaagatttttttcttttcggcctatttaatggtgtttcctcaagctctccagaccagatgttctgtgctgtatcagaactgtaggcaatttaacagctttatagccttccccctccccaaacactcacagtttgccatatctggcagacttgcatatagtttccagctgagaagtaaatgtaacgtcctgagtatctgtcagaaaaaatactaatgaatacgatcaatcttatgagctgccccaaaattgtttcagtatgttaacaattggattacagtaaagaacaagttgttaaagtatacttatattggctggaaacattgcatcatcagaccttgatgaattttccacttgtttcaat

SEQ ID NO: 131196 - DNA, 1476 bp, Homo sapiens
tttgaggatggggttaataaactcagtctatacctttatggtgtgtggtacctatgggacttttgaaaatgctcattaaacaaaagagcccttgggcttgtaggaaggttttttaaattgccatcatcatgtgtttggaagttgaaactattattttctaggtgaggaaattaaggcctagagagacaaatgtgttgactaccaccagttcattgggcaaccttattgaagagagtatcttttagaagatgaggtcactatagcattatcaggctcctagtgcaagcagtgcccagtaaatggtttaggagcaaagaaagttaagtgattctgtgggtcatttattatcaccacacttttgtgtgtacactacaaacagtacctccaaaaagtgatcatttgttctcctttgaatgtttagtgctcacttctgatagatctctttctgttttgtaaacaagtggagtttgaaatgtacagattgtttctgtaaatttgattacagattgtttctgtaaatagaaggaaactattaattcattttgttagccccttaatcttttttttttttttgtgaagttgtacaaacagttttctgtgtttagaaaagtactcaggtcgttctctccttgatttacattagaaactgagatttataggaaaggcaaatcaagcatgatttttctataacagaaatgtcttcttaaaatagttttcattgaagccccacatgaaaatttcattttagggttagggtaatttcattcagggttaagtactaggaagtgtttcacctactttaagatctgatatttgtctccctttggatatgaatgaccatgttttcctttttgctttgatttggcttggagccaaattgtatgttttaatcagaatatccatggcctgattcactttgttcaagtctctgcctctccttcagtttctagtttctatattctaattaagatgttttgtagttctgatattacttatcaccttgtatggtttaatgcaagctacctcaagtcctttgtgaatggggcagagcgtgtacacatgcacacaggtgtatgcacacacacttatactttcccagtagttgtgacttttttcaagtatgttaacaacaatcacgttttttaaatattccattctttggaaatattttcagcacctctctgctaacattaatctaatacctggaaatatgacaagaggtgttacttgtcctcatgaaagagcctattacatagtgtaatttttttttttttttttttttttgcctaacactaaagattctcatttggtcttctaacataccatgctcttaattgtagcaagaggtagcattggtcagtaagctattctttatatgagagttcttcatggtgagcccttccaggtaaattcagtttgtttgtataaacacatctcaaatgacatagaattaacttcctgatggctctctatctt

SEQ ID NO: 131197 - DNA, 1564 bp, Homo sapiens
attcacacattccttgaaatcccaggataaggattcctgggttagatattgtcataacaggaaatgtaacatggccccatttaaaaataaaccataggttcctaacctcagatttgtcgtttatcatgggctgccatgaaggtttctgcttgatcatttttcttagcttggaatgctgtatttcctatcctacgaaaagtgtttggtagaagcagagtgtgtagggaaagaggtgaggaagtgaggacaagaaaggatgggtggagtgtgtggttataaaaacttctatttttctggtttaactaaaccataggaaattgtttgctcttcctaaccttttctataactgctgtcactttccattcttgccatcttccacttctttaggttacagttaaggatagtcttcaaaaattatattcctcaggctttcttttataatatctttgatactattttttaaaatccaaatcatcctgatgtttgaaggtaaaggaagcttatctttgggcagctgaggttgctggagtgggcccttctcctaagcaatacatggtgtatgataaagctgtttgctatatttaacctactttagctattcacttgggtgggcagttttttcagatagccttgtcccagtcccctgagtaagctggcattactgctcactcctctttcccatccccactgctcttctcagtgttttccttttttaaaaaagtcacctgttggggataggggcaggaagcttatttcctctctttggaagagttattaatggaatcaggagatagaaacttatatggtacaatgcaattatattgttatatgcacagtaataatggaacacccaagattaccttttcttgaaatctaatttctgtagcttgtctctttctttattgaatctgttctttattgtactgaatataattagcttagtgtttttagtatcttagaagtatttttttctcatggtagattgttttttgatcatattcctatttgtacatatgaattctgtttcatgacatgaatgttagaaatgcatagactttgatttttgtagtgacacatacaatctccagtccccctccccattttcctgatttcccccgtcgccaatatggagatgagaaaaggggagcttgcgtaacactccatggaggccaagttaatccaatccaattctacacaaacatttccttctgacccagatgagtatcatagtacctgggttctaaggaacacttctgaataataggtgatggtggtaagggtttgagctcttcctgaggtttccagtgcaccaagcttttgatgcaaatgattttgttcaatcttaactgccttatgaagtagatagtattgtgcccaccccccgctgcccagcccctacgacccccacattccccatgttttcttttttggcaacagaggaggccagtctagttaatttgtcgccggtcacacaattaatgtgtggtaaagatgttattcagaccaggttaggtgcttcagattcagagtagtctggtaccctatcctgctgctcccacagttt

SEQ ID NO: 131198 - DNA, 1035 bp, Homo sapiens
tttaaaacattttataattgaacaaattgtggatattcctaatgataacatctgcaggatgttgatttataaacactgtaaaatgctgtgttgttttgatgctatgcatatttcctgtagtgtatgtgtacagttcaaaagaattattttcttatctatttccttcaatctttgaattttagccctggtcataattctgagtctggaaaagatttcatgatattccagatttctgtgtttttccttcccatcaataattgtctagcagttttatgtaacattaaggactgttgctttaaaaaaaaaatagcagtagtagttaaggagaaatgcatcatcttgtttctttggaataataggaatagaatagctgcaaggtaattttaaagtttatattaattgaagaaagggaagaatcaccgtgtcttttggaaactgctttaaaactgtgttcattctagatcttcactttaggggggatccataaagaacagttttacagtggatatattttagaaaattcactctctgttttttctactttcaatcaaatactttggaaaaagccctcacatctgcaggacttccatctgggaagaacttgatcctttctgcccagtttcatcttggccctctccagtggttgtataagagcatctctttgagattaaaacatagaacaaagacaggctccttttattaatagtccaatgaaaggctacagatttttgactagttctttttgcagaaatggaattattagtgacatatcttatttttctcttttctaaactctgtattttaaagttgtactactgcaggggacagtgcttagacttcctcacctgtcaaatgggggcagaaacagtagtcttattgttgaactgttgggaagattaacatgaatacatgctaagtggctactgtgtagtaaactgtgaataaatatgggctactattaatcatgcccgtggcttcagaaaaaaataaggatagctagaattagaaagaattcaacatatgtaacctgcctgg

SEQ ID NO: 131199 - DNA, 1009 bp, Homo sapiens
gctgacagtagtcagaactgattcattctagatgggtatcttggacatttcaggttgcttatttaaatgaatgattgctttcatgatgctgtttctaagtatctttaaaaggaatcatggagtacacaaataacttagcaaccctcattgttagagattttttttctttaaatttagatggtttaccatagatttgaaaattatttcagaaatgaaagcagcattggaaatgatgcagttttaaaatcctataaaaatgccccaaattaaacaaatgtttcctgacccttcataaagcacaaacagacaaatcaattttttgtgaattcctacttttgtctttatgtgatacagtaatgaaacaatgtaatcataaattgtagcagttatttaaaaatttggagattacactgttgatttgtgaatttagtgccatcaatttgtgatttgcttttcttttgctgaagctccaaaagtttcagcaagtaagatggagatttttagtcatttttgtgaatgtgtaaactttgttgattcttaataattgaatttgttttgcaatattcctttagtactgtatctggcctaaaattcttcctggaattttgatgttttcttgttgatgcacttttccatgagccccttttaaaggtaacacatacagttcttgcttatattccagttttcatgctaactgcctattcacatttcctaactccaggctttcattatcatcttgtgcatgaattactgcagtggcctcttactgggtttcctcatccaagtcttttcctttttagtccatcctctgttcctaggtaatgtcttacagcagaagtttgagtgtcactcttcaactaaacccttgtctgacaccttcttgccagttcagtaaagtctaagtttccctggcctgtggccctttgagataatggctcaggcctgccttcccagctttattttttattctttctcctatatatagtataagattgtttgaagattaccc

SEQ ID NO: 131200 - DNA, 1150 bp, Homo sapiens
gtgcctggcctaaaagggcatttcttttataggcttttttttttttcctattaaaatagagcttcctgttggtggtattttgaggcaaaatttagatgactgaagaacatggtatgtcaggcagaaaatgcatggggattatgtagtacatattaactgaccaaaggaaacaacacttgagagtccatatatttgggatgtcttggggctttttagacagagtaatacccagcacctccccccactcctcttcccccaggtttgtaggagcttggggagtgagtcaaaaccaaaaggtggcatttggtcttgaactgcagtcagctgttagtactgctggcaacatttctttcaaagtgtggtatatgtgtgtttcttgtggatgcagtctgcaaatggattgttatttatgaatggtaaattaaagttgtttttacatttcctaactaagtagtttaaccaatgtttgctctcattgggagttgccatcaaacttagtaacgtagtaaactgtgtttgagctagggttataaaatgcccctttgatctaagaatactgaggggcaacagagttgactgaacagtaagcattagggttgaatgtattcccagagacagagcagtatcactgattttggtgaaaattagtatggacttagccatgatacattttcattttgcttatcagagcctttaatgtgttgagaataatgggtttctgattcatttgcttaatttaacagaggaaaagtattttctacctgtttttactttttatttaaaatgagtgcagagagcagagataatctttgaatatttgctgtgtgtgattatagtaagcattttttcttctacatactgagaattataagaaaaatacattataattagatcctaatgtcaatcacacctggaagtggcagttaggatcaaagtaatgttatagcagtctacaaggattagtacattctgtgccccttttcctaggcttaaatgtctgctattacagccttttcagtaagtgccttagctcagttagaacttcttttcaaattgttttgttttgtttatttagagatgaggtctcactgtgttgccccagctggtcatgatctcctgggctcaagcagtcctccttcctcagcctgcc

SEQ ID NO: 131201 - DNA, 1061 bp, Homo sapiens
aggtttcttcactgaaaagttactttttattccttcccctactctattacttagaattgagtcactaagtccagcccataattaagaggaggggaattaaattctgtcgcttggtgggaaggaacatcaaagaatttttggaggtatatgaaaaacaccctactaattaatattatggggactatcacactatatcttatcaattattattcacttctgctagactggatactcactgagctcaggggctgagatttatttatccccaatatttattgttagaatagtggaatataatacatgcccaataaaatatttgttgaatggattaaatggagattgtgaattgcatacgaagctaaagtagctaaatttaatcctgtaggtatagaacaatattaactgaatgatgtgaaccctccagccccccaaaaattactgtgtcagtttcctttgttttaaatttgtttgaaattgaggaatatattctttcctaaatttaacacaatatttagaaagtaatttttctttctggctttggagaactgattagaataaagtaatttaacaatataaatttagaccagaagtcttactttatgattaaagatagctagttcaatgttttgagtataccctatatttagaagggtggactgacttgggaaagcatataatttgtaagtaaattagcagtgatagaaaaattctttcccatttctcaaaaaaggtgtttaaaagcatcaatttattatgtttaccctaacttttgcattacaaatggactccctgaaccccaaccatgctaaatttaactttcatagtagttgccagttttacttatggatgtcttccggcctccctgatcaaactatataaatctttttcttttctttatgttgcttgactcactagaaacaggaacagtaagccatacttgcatttgatctttgtctttttttgctaaatagttggtaaaaagtagagaggattttcccttaataacttgaagactttaggacagagacgttccatcttttggctcccctaggccacactgg

SEQ ID NO: 131202 - DNA, 1865 bp, Homo sapiens
ttacaaagagaatcacaggaggaacttttgtaattattttagcagatgggaaactaagtcccagagatgcccaagtttaaaattaatggcaaatgcagaaccagaaaacccagtatgcccatctaatatataatccatcacaatttagggaggtggcagtaattccagtatgttttcagaagcacagtgagtgatgcagttgcctgcagttgtgacttgtagacatattgtatttacttaaaaggctgcttcttggcattactatttactatcagcacaactgaaatcaaatgatattaaatttaacaccagatttttagaaagttaagtttgtgggtgtacactaggtattatattaaataaaaatgaaggtcaacagaaaattagcggtggttgaatgtatacagacactaaacccatttcactgctgaaagtcagcacagcctctactattttgctacatggaatggagaaactaactgaaaatacagatcaagctgggtagggtaggggaagaaaaatgtgttcttattaaatatcactgaatgccattacaaataatagtttgaatagatggtttaatttgacttaggaaatcagtgcctgactgatgacacaggaagactttctagaatacattgctttgcagatgacttaaacagacaatactgataaagcctgtcatgtgaatttccttctttactgagtacacagtatggttaagtagtatgttgtgcagtgcttccaatctgccgtgactgccatctgggcaagcagaatgagaaaagagcatggaaaggaaatggatcagttagctgtaaggaatctgtgtgaacgctgggtgccactcatgaaacactgagcagttagtgactcctttgtaaccagtccaactagctctttgtaaaaaatgaaggtgtgcaccgtgaacaactctcacaattcatcttttcaatgtcctggtacctatggctgagacagaccagtaaatccagtgacagtaatcatgatcacgctacccttttcttatttatctcttcgtattttttgatttaattttttgctgcttcagtgtttggcacaatgttgaggtagatttaataatcctagcatttttactttgcctaaatggagtctttttggaaacaaattatgtgtaaaagcaagttcctaagaaacatttaactacttaaagacaagagctatagcttcaaaatcttacaagttgtaacccaacaaggatatacatgagtgatgaagttgtgtatggataagaggactggctagcagaatctaacctgtatacctttgtcagtggatacatctcttacttgaatttcaaaaatttgtacaatagttctttttgcatacgtgcatatggttacctttttgataaaacatgtgatcccttacaaaattgtgttaaccatgagtcatctgttatctccatagaaattaacatacccttatatagatggctaataatacaaagccacgatggtttctgtggttttactaactgtggttccatttctaaaacatttaaaataagacctgctcctttttaaaaaattttttgggcaaagggttgtcttatcagaaagtgcaataatttaagcagatccataactgggaggaattaataacagaaagtttttgttgacaccaggaagtagattaaatagtgcaattgtggtaatgagtaccatatatgataagcctgagccagctgggttatattaggctgcttgatactttgatcacagtattatttcaaggcttgtctatttaaattgctaaggtttcttgtcatctttgcgatttagaccataatttcttttattgcaaaaaaaaatttttttttt

SEQ ID NO: 131203 - DNA, 1888 bp, Homo sapiens
tttgaaaattacaggtggatacagtgcttaaatagtatttaaaattcctaagtttccccaagtctaaaaatgtaatccttaaattactgttcccagtggtttaaattttaattaaataaaaactgtcttacttttgacccacaacaactttacgtaaagatatttgaatttcttactaaactttaaggtaatagccattaaaatgaactgttttagtactaattaaaatgtcaaaaagtcacaattacagtatgtaaccaaagatccttgctatttctttttttcaagttcagacttgcttcctatcttgcccaggagaaatggtactcagtttcgttcccccaattagatatattacctaaagtatgttttacagatcgataattaattataattacatttgatgttttggtgctaatactgagttttccaaactgctcttcatcctaaaagagtgctatcttagttatgccagtaaagtgttctgtttgctttatattcatctctcttcaggtgaaattttgatagtttgggactttatctgttttgagattgttcttatatctgtttgagattattcttcgtggcttacctattagcagtttcagaattgtgttttcataccgttaacacttctccaccatgagtattatttaatgcttttttctaccagtaatttttactcagtacattttagatgctttctgatatagttgaaaacaaaggcagtatttattttgactttaagtaataatgtaatggtgtaggtttataatgaaaccccacgtctccctctttccttacccttatatacatatttactgttttttttgccctctaacatctaacctacagacattgtcttttgatagacagcccttctttcctgtgaccgatgagagggccatacaattattctagtggtctttgcagaattgtactcatcttttttctggtgtatagaattggatgggtgactcccttatggagacatattttggtggtaggctactaacctcacaaccagcatctgtggtagaaggagtttggcagcagagccctcgatggggctccctagacttgtggcatgctgttatcctcagcagacagcaatgacagcagcagcagcggcggcggcggcagcagcagtcctacaaattccagttgttctcaagtcactatagattccaagctcatctgctctcactttagtgtctcctttttgcttttctttctttcttcttttgttgtttattcatcaaaccaatatttgagtggaaactgtgtgctgggcactttggcctttgcttacctacatttctgctacacatattttttgaaatgtttgttatttatagaacttagtggttttaagcagtgtatttgacttgaacatgagaagcatgaggaggacttgttttagtgcattatgttagtgaatcagattattgaaaggtgaatgttacattaatatgcaggtaaatgtgtctggaatatatttttgtttacctggagaatgtattggggttataaacacatatttacgtaactgtgtatctccaagtttgtaattcaaagtcattctgaatgtatttgtttcataagatacttttgttcttgaaaatttgtaagttgaccatctttttttctttgtcatattagaagtattttattttcatttttgattcattgtcatttggtagcaactcccaatactttaaatgtactcagtttttaaaaaagtctattaccaggattattggtaatgtggattgtttcttcttaatattttaatttctcttcttcctccaactaccagcatcaccaaccccatgaaaaaagataaaataaaacattaaaaagattcagtactagaagaggatgagga

SEQ ID NO: 131204 - DNA, 2461 bp, Homo sapiens
tggattcagtcttcataaacttttatattacagaatttaccttctagttgaaagtgaaataatttgatcatattagagaatatatgctttttcaaacaaaaaagagtagaaaaactcatactaaaattcccattagggggcactgttatcaagcttagcagaactggagactaatttgttttctcaaacgtgcaacccaaggcttgctaaaagggagaaatattttcatcttataagattcagatactgttttatacaactgaattccttaaatatgttataaagtgcactgaattaaacacagattcaataactcactgccttgcttttcagcaggctaaattgatttactatttcaggtgatataggaagcttactttattttgcgtcagagccaaatccataattttcatatttggagtggccaatttttaattttgcttactacaacacaaaggatgatccttagccttcaaaataggttgatttcaaaacgaagcatgaagactgccttgtactcctaaaattcagttaggggaattaaaataatatctttttactcagacagtattcatgtgtgcaccatgtataattattaaagtgatagttcacaatgtagtgataaataaaacacatagcttttatctgtttttttttcattttcagtaggagaaaattgttacttgaaaattatttgtttttgtattaatcaaatttggtgttggagtaagagatactagtgtcgactgttaacatattttgtttaagttttgaaaagaaaagcagagttgtagaatcaatcctttcagaggctaaaatatgaattgacaaaactgtaattaaaatattgatgtatttagagtagtttttcccagcatagggttatttttgtgtgactgaggttggagagaataagtttgtatggtgatgttatttgcagtgctctctgtgcaagttagtcatgttttacattggagaaaatctctgcttagttacttgcttcctcaaatctcaccttccttctcagctttcctgcagcccacacctagggtaaaactgctggaaacctagtctgtggttactattttgcctttgtattgctttagagctcagagaagagttgaatttggacagagaaagcttttaatattttttagacagatggggacattttgtgaatagacatgtgtttacttattattttgtcttaccccctatctgtatgactagtcagtgatcgttgtggtctgtttgacagattttttcaaaactctctttcttttgttgcatttttaaaaatgatatatttttggtagaactgttagaaataatatgtagacagtttgggggcatgttttgaaatttactgcagaaaaatagcatgtttacctagtgacctcatatcgttgtggtcaagtgtggaggtataataaaatgtttcaaatatccagaaaaaaaaattagtccactgtaattcacttcagcatttagccagcaaattacttgagtgggaagtaaaaaagatacaaagacaccaaatcctgcttactgcctcagaagattttaagtgggagagacaagtgtgtacataaaaaaattgtaaaacagaattgatataagtccagactacggaaggaaaaaatgatgcgaacactcagctatcagccactaattcctttcggggatgacttcacaggagaggtgaagtttgattctatagatagatgtcagttgcaattttaagaaactgttaaacaagaaagttgtgtcttttgaatgtgttctgattatttgtatgtttgggtcctcataagtggcacacacacctctagaaatcaagaacaaactaatatgtatatattttttatttgacatctttattgttcagattccttgaaaatacttttcagatattgctgttgctttagtatccaggtagagaagttgtttttgacgtttgtttttatacatgaaagttctcctgataatgatgttagtgtcatgtttatagaacctcggggcccatattgcagttggttctatttaaaatatttagtaaaatacttaatagatacttggttttagaagcattatgtatgcaggtaactagagagaatctgtacactgaattatgatataattccccttgatactcatctttttgttacgtagtattttgaaaatgttaaaactgttcacatttagtgatttactgctaaataatcagggcaatgaactttagattattgctcacttacatttttttggataactcagaaaagcctggtttgtgatgtaaaactttaacttaaaaacctaaatttactttatgtgtttggtttttggtttattaaggtgattagaatatacgagaagcaaaatctgaataggaagcatcagttctcgtattttcatggctttttggttctttcagtttgagtgtctcaagattttaaataca

SEQ ID NO: 131205 - DNA, 1058 bp, Homo sapiens
agtgttttgtagttttcctcgtagaggtttttcacctccttgctaacccatatactctatattaatgggcattaaaatgtagtcaccagtagatttttattaaacttagataaaaactataattttctgttatatggatatatattagaatagtcctgtatgttgatttttaaaaatcatggtaaagacccattgcatttcttactgcttttctattgttttgtgctctctaaaactagcagttattcagaggaagatctttttttgtgccatccacctcggggaggtaatataccaaatatttcataattttaatgagtatatatttcaggtgttttgtttgtttgttttggtgcctcatgtaaagaggagatttttaatctgttgtccaaaagtgaaatgttaataaatggtttaaatcagagatggacaaacaatgatctgatttgtaaataaagttttgtagggacacggtgatgcccattcacatattttttaatggcttcattcccgctacagtggcacagttgagtagttgtggctgagaccatatgggtcctaagcctgaaatatttactgtctgacccttaaagaaattttgaccacctgtgatttatgtaacttcatgtcttattgttctccctctcctgtaaagttaaagaataaggcagtaaatcctctctttcatcataaattgataattttttgtgcgatatttgttcttgatgttacctttaatcttgacggagctcagaatatattttgagcactgaaacgaaaatacactataggatgtttgtttcactggcacacctaggaagtatcagaataggtagtttttgctttagttttagtgcctttttcatttaaaaagaaaacacatattaagttgtaattcatggttgctgacctgtgactaggcattgtggaaagataatggtatgaggccaaaaaacctgggtggaaatctcagctttatactttggagctgtgcaacatagaataacttctgaaccaattttttctgactctagtatctttttaattgctcacttgag

SEQ ID NO: 131206 - DNA, 1004 bp, Homo sapiens
ttctttgtgatgctattgtaaattggatttttcttaatttcctttttgtcatttttgatatgacttttaactgatcacattaactttgatagaatgttacttgcttcatttgacttacacaccttcatagtaccttgagcatataataaacacaaagtatatgcttgctaaagtgaaataccttgcagtttgtctgcaaagcaggttttcattaaagtaattcctctagaaactaaccagggctacttttgttctaggcacctgaacactagcatacttggatttttttaaacccttatgcagtgtgcatcttttttttttaacctggctatgctctccctatttcatttgaattacctcccacagaattaaggttgagatttctctgtagttctttctggcagtattagaatacctctgtttctctatacatgcacatatgtgggggtacttaattatatttaaataatcactagtttaggtctggaaaagaagagattgttaatgcagtttctttggtttacaagtgaggagcttgagaggtttaagttttttgtttggttactgggttggtggcacagttggaagtagaatctattccagaacagttaacactgtcacacagttttctcaggtaattaattttttaaatcatattcttggtttagaatatgaagaaataatattcattgcaattatggtaggcgaacgaaacaaaatatattactaattctagatcattggaagctaacttcttttacgagcttgaagtacttgaattgaccaatgttttatttcacgaacatgtactttattttttaaatttctacaagctctttattttcaaagttttaaaagaatgtttatttcaaaagtttcacatggaataagaagcacagattattatcctaattttacagattggaaaactgagaacagaagaataactgtgtgtttggatttacataggtagacttcgcgagagtagattttttaaaaaaaat

SEQ ID NO: 131207 - DNA, 1136 bp, Homo sapiens
gagatgatctgttgagaaaggcaaaatgagaatttatcagaaggctctgctttcaggtgtcccgataattgagacctttatctctgtgtcttattgatagttttgtcatttatgtgtctattaacaggatcactttctcaataatagcctcaggttgagggggtattctttgatttggctgaaggaactcctggatgccagaccatggggaagctttgatttaagagcataactgctgtagatggacgtttttgacatgtaatcaaactcctggagtttcagatctgcgtttagattatgtgagctttattatttatgtaagggtaaaggaaaggatttgtaagacatttatttattcctcttatttaatttgtggttttgcaaacctagtacagtttcttttgttttttcttagaaataaaggaaataataaactaggatggttgttaagctcccttctgtgtgtgtatgttttaggtggtattaaagataatcaaacattatcaagaagaaggacaaggaactgaagttgttcaaggagtgcttttgggtctggttgtagaagatcggcttgaaattaccaactgctttcctttccctcagcacacagaggatgatgctgactttgatgaaggtaagggtgttcatcacaagtgtgtctttgcagtgcatacaaatggatattgacacaggtctcaccataacttttgataatgtgtgaattgggaatctgtcaggctagcctacttcacttgatgtctgatactttgggaaaattatataaattctgggaaatgagggtttatactatagacatcattagtttggcctttacttatttggaatttgtgattctgatttgtcatagattggataggaactgtgctgatgttgactttgtcaacatgaaatcagcttgctaaataaagttttgagggacaaagatcatccttatgtgtctgttatccattcccttctatcctcttttgaataagtcagtgtttagaaagagatggagttcaattttctgcttcagaaagaagatactcctcaagcatttcagaaattttatttttgtactataggtgtagttcctttgttagcaaaggctgagagtagttaaaagctcacatcaa

SEQ ID NO: 131208 - DNA, 1368 bp, Homo sapiens
gtgtacattcataagaattcatgtttaagcttttactaaaatttttttcttttactcaaacattacatttttgcaaagaaataaagatttctagaataactgtgtactagacaacaagtagaagacagcagtgagaggtttgaatgttggggtttcatctgggcttactcactgaataaataaatcactgtcttacagaagttgtgattcaaagtgggccctgctgctgaaaaaagtttgtttttaccattcttaaaaatacgatgttcagaatagaattagagctaagggagtcgtgatctgacctcagtggaggagtatgcctgtcatctcctgtagaagcagcaaggagtggcagagaaaactattcatttcttgctcttctcaactactgccacagtcttatgccactgggcttacagttacataagtgcttggtagctacacagtttggagctcatgtctattgtggtcacgtattttgagagacttcgtgacataaattaagaagtgtttgcttctgtagtctaaatgctcagttttgggagttgggaaataactgtttacgtgcttaatgttactgattctgtaaaccagtgctattcaaagtatgaggtatggtttgggaacactggtctgcacagtataaacacagggttaagatagagtgtttagaaacttttattatagtagtttgacactgctgtgatatccaagtgatatccctgggctttgtgtgtgtgtgtgttttattttcatctttctagtgagtaatttttattgtattttactaaagtgttggtctgtgatagattgggggaaaatgggttctttaccactgataacctgagaagcattgctgtaaactattttcatgtctattttggctaatggcatcttcctgtaaccagagttgccgagaccagctcagtcggggagaccctaacccagcggcgctagaggaattaaagacacacacagagaaacatggagtgtggagtgggaaatcaggggtctcacagccttcagagctgagagtctccaacagagatttacccacatatttattgattgatttatttatttttctgagacggagtctcgctctgttgcccaggctggagtgcagtggcaccatctcggctcactgcaagctccgcctcccaggttcacaccattctcctgcctcagcctcccgagtagctgggactgcaggcgcccatcaccacgcccggctaattttttgtatgtttagtagagatggggtttcaccgttttagccaggatggtctcgatctcctgacctcgtgatctgcccgccgcggcctccaaaagtgctgggattacaggcgtgagccatggcgcccg

SEQ ID NO: 131209 - DNA, 3236 bp, Homo sapiens
gaataatgtcggacaaatcacttatcagttttctaatatgcataatgcgagttagtacagcacttcattgcaagatcagaaatgaaagcatttttacataagagacactacagaaataatgcgaactgtaatgctattatgacggtttgcctagtggtgaatgattaaacatttaaaaagtttactttcatcttagatcattccatcggaaagaggtcgaaaatgtacagtaggcatgcacaaaggataccgcctggaaagaaggtaaaactggaaaacaggagggaggcggggcccaattttggcttctccttccgtctccgcccctcgaacgccggcctgcgagtgacgtcacgcgagacttgtacttccgcttccggtaactcacgtttctctttcttcctgtctgcttggaaagatggcgtcccgcaaggaaggtaccggctctactgccacctcttccagctccaccgccggcgcagcagggaaaggcaaaggcaaaggcggctcgggagattcagccgtgaagcaagtgcagatagatggccttgtgagtgctgttctttttcctctggcccacgtggggagcgcagttcccagccccgtcccaccagacgtactttctagcattctcccccttgggcttggtgtggctgggccaaagtttttccctagtacgtttctctttcatcttcactttttgttcaggagcttcgacagccttctcttgtcttctaacgggacagttggggcttcaggaaggggactgagaataggggtgtgagtgacaggttcctggggtcttgttttgagatgaccggtggggggatttgaagaaagactcctggagaccagcagctaacgaaggtgtcgagaaggatttagggacctagtagggctctgggaaggagagagtaaggaaactccactgattccctgctgggatctgacatctataacgttccaagtggagatgtactttgtagccactcttttgagcctgtacttcggcgctttatctgaaaccgtataatttagaatactcttttgtagtgttcattctgaaaaacataaaagaatatcaaagagaagggccttaaatgtatttagtagttaaggttcatgaactaggacatccaaggaaattcttgataaggaaatggacttagctgggaagaggaaaatctagaatgagaaattttatttctgttgtttcgaagcaaaatgcatttatatgacgttctagttttaaaagtatccttcctgccctctttttaaaaagcatcctctcttcctttgatttttttaaaggttatttcctattaatgcagatcttagatatttgtaataagaaagtacttttaaattcatgtgaaaattgtaattgcaagcaggtatttttaagtggaaactgttgataatttaaacgcagcatataattgaatctgttgaactgacttagttaaactggatacaagagtgtagcctggtggttaagagctcattcagtcttctaggctcttccacttaaccagctctgtgactttaaggcaagttagcctttccaggctttgctttcctcatctgtcaagtgggaatgagaagtatctgtatcatagagttgtttggattaaatgaaaaagtttatgtggtgacctgtagtacagtgtaatcacttaatgttaattatgattattattatgagtttaatgtctgtggttagcagagtttgaaagatgcaggcaagagattaactttggaatgttttgttctaaatgtcacttgtgtaatactttgaaaatgcaggccgggcgtggtggctcacggctgtaatcccagcactttgggaggccgaggcgggcggatcaggaggtcaggagttcgagaccagcctgaccaacatggtgaaaccccgtctctactaaaaacacaaaattagccgggcatgttggcacgcgcctgtaatctcagctactcaggaggctgaggcgggagaatcgcttgaacctgggaggcggaggttgcagtgagccgagattgtgccactgcactccagcctgggcaatagagcgagcctccgtccaaaaaaaaaaaagaaaatggagtactatctggcctgtgtactggcactgtggctttccctggctcatgggaggcagatgtgtgttcaggaataaatgacgtatctttagagattgcaaatctctaaagttagtgggtggacttagattacacttgttaaaataagtaccacttatgcacttgggaaatgtttatttcttagaaacatatttcttattaaatttgctatgtcacaacagcactctttgaatcacttagtttccagagttgaaaaaggcaacaggtcggtggcataaatctatttggagatcatttatttagcaaatattttaggacattctgttaagtgccaaatactatctaacacagggcagtggtaaaagcacttcagtaacaatgtcctggcagctttaagagggattgttgaattaaacagagacctgcaggtggagatggactggatcacttcaggtttcacaagggtgcttagtcaagagactggttctcaattttttggactcagaaattattattttttatcagctctctcagaattgattaatgctaaggaaccaattagtccttctcacaggagattggtttatatacatgtaaatgttgatttactcatttactgtggaagacataccttttcagtggtgaaaacgctcatatctaccaccaaaaagacccttttgattaccaaagcaccttggaaatcgaataaaaaaaatcagaagcttaccagtgactccaaaatcaatcataataagagcaggtaaaggattattttacttgagagttatttatatccagattcttgacgaacttagtgaattatctcttattcacggtggtgggtacctctgtgcttttgttctccatcggttgggtagatattaacaaaataagttcctaacaactttccccctttttggacatctgcctttctgtcatttatatggttttaggcagctagattatattgcagttgcaaggttcttttatcttggttgctcattttttaatggtgaatgttttccagttaccataaatcatgtagggaacatttaaatggtatgttctttatgcgttttacattgttaatacagggaatactggttactctaaattttattaatggattattgcag

SEQ ID NO: 131210 - DNA, 1337 bp, Homo sapiens
ttggatacaggaaagtggtttgatcttagacatggtgaatttgaagagttgatagcaggacatccacaggctggcagtactcaaaatagaggtcaagtctaatgactaaagcaagcaaaatcttcttgaaacagaaagatgataaaggagatgaagcaagaaagaatctggcaaatgctggctagggttgaggaactcttatgactaaatgtttttttaaaaacaacttgatgatgtgagaagttttactgttctgaattgaaaatgttttgaaagtataccaatttgtacttgaagcagaagcttattacgctatggttgggacaagggagctgttgtcaaactgcaagtctcggtaccacttgctagttacttgaactttggcatgttacttgaaatctcagaatggggtgctctaaaataaggataatttcaaggtaagcgacctaacttcatagggttactttgagattaatcaagaatttatgtaaagagcaatttgcatactacatggaacataataagtgctcagttaattttaactgttgttcttcctacttggtaaatgcatttttcaagtgatcttttaaagtaaatggttaccagatgacaaatttagattgtaacagcatagttttattttaagaaaaaatcgactattgttttttacaccttatgtaaacaagtgaaatgtatctgctataatttttcttttcagatgtgtgttaaaagagctagaaacattgggaaaggacttatatggggcaaaactgattgcacaaaaatgccaagttcgaaattgtcctcatttcaagaatgcagtgagtggatcagaatgtctgctttccatggttgaagagggaaatcctcatcattattttgtggcaacacaggtgatactacttttaaaaccacaggcaattttcaccatttctatttatacttcatatggagctatttataatcagaaaaaagttagaatgattagacttttaaaaatacaggcttctaagttaatttgcagtcagtaaaagcaattgtcatttgagaatttgaggaaaactttaagcatgttgatattctttttagtagtggaaggttgggttttgttttttttaatgattcctttgttttgctttttttgtttgtttcttgagacttgagggtctcactatattgcctaggctggtctcgaacccctaggctaaagtgatccttccacctcagctcctgagtacctgggattacaggtgtttgccatcatgctggacactggcagaagtttctttttttaaaacaagaaattgttgacatgagatgtgatgatttgttgtagg

SEQ ID NO: 131211 - DNA, 1176 bp, Homo sapiens
ttcacacagctgctactaacactgtgctcagtttttatgtttttcttcctttatcatgaaatatacccccattactcaaatgaataagtgaggcttactcatttgaaaaataaaatctgtgatctcttttatttttaatacagttcttgaaaacctatttaaggtaccttaattgacatttgaactaaataattctgttttcttttaaataggatcagaatttgtctgtgaaagtaaaaaagaagcctggagttcctctcatgtttattattcagaacactatggttttggacaaaccttctcccaaaacaattgcctttgtaaaagcagtggagtcaggtcagcttgtctcagtgcatgagaaagaaagtatcaaacatctcaaagaggaacagggtttagtgaaaaacactgaacagagtagaagaaaaaagcgcaagaaaataagtggtcccaatcctcttagttgtttgaagaaaaagaaaaaggcaccggacacacaatcatctgcttctgaaaagaaaagaaaaagaaaaagaattcggaacagatctaacccaaaagtactttctgagaagcagaatgcagaaggagaatgaatcctttggatactttcaaggacattcaaatgtgaaaatgaattttttacaactagaagtatttataataaaagaccaaacttatttttgtaaatgaacccatatgctttagctaaaattaattataaaataaaaacagtgaccagtctagccagcatggcaaaaccccatctctactaaaatacaaaaattagctgggcatgatggtgcacagttgtaattccagctactcaggaggctgaggcatgagaatcgcttgaacctgggaggcagagattgcagtgagcccagttcgtgtcacttcactccagcctgggcaacagagtgagaacatgtctcaaaaaaaaaataaaaacagtgaatgggtgtaggtgtgatggaattcactttacttactaaatggtttcgggaggttgtttctccaggtaaaattgtcgcctctctggtcccattcccaccttcaaacattatatgcaaacagttttaaaaaatcttacagttctaaaaggcttgtgacaaaaaaagaggcagtccctctttcacattgacagaagaaacttcctctttcaattctagt

SEQ ID NO: 131212 - DNA, 4234 bp, Homo sapiens
tagtttcagagccacttctacctatgtgtgaggatgtgccattatctcagacttagttgtgaatgagtattaaaatagttgtggtttctgttatggctggtatatagtttcaccatagcctgggaacatcacaactgctgccttgcacccaccttggactttaaaaagtcatttaggcagcatgtggctgagaactaggttgctcaagtgaaatatataataaggagtatagcccattcattttaaaacaccatataaatcaacttaggtagtctgcaggctctttggtactgctccacaatgagattaagagtctgccagaacattagtcatctagaaaatcatgttgcaatatttatgtatgtatatttagttgaaataaacagtatatttagtggtacagttgatttatatcctgaagttctttaagaggggccagtaaccaaaacctccatgatcagcagcagtccacagaccacatagtgtgtgtagatagcatccttatagcgcaatatagaagcatactttcagccaaatgtttgcttgcacatagaggactttgccttgtaatttaagaaaaacagactcttcagtttgtactctaaatgctaagtgattgctcagcagcattaagtacagttttctattagttcaaaatacacaatctcaaggtaatttaggagcttttaggagatgtagaaatacttcatttttcattggacttgttttgtcagctttttgggggtcatttttattcaggatgaagatgcatcagggggcgatcaagatcaggaagaaagaagatggaacaaaaggactcagcagatgcttcatggtcttcaggtattgccgctgttgtctcagaggaaaatgcttcatcaaaggcttttgccattgttccctgaaaaaaaaaaagttagatgctggaaacagaaagcatacctttgtcaaactttttccaaaactacatttttatttatttatttattttttctggagggagagttttcttttcttttttttttttattatagtttaagttttaattaaatacataaactgttaggccaagagtaagccggaaaagcatggaggagaatgcttgtggttttcctgaaaagcagaaccatggtgacataccacacaactcctttgtatgcctgcaccttcttgttttttgttgagtaaatttaatgtgctgaatcattaaatttattgggtcattgtgtagcatcagacgttacttttccttgtgctttaatgtcctagacatagacaggatatcttgaatgtctgcaaaatgccaagcaagttgctcaaggtttcttaaaataggacagttgacatgtgtttattaattttttactttaaaaactataagtgctagattttactactatattacattagctgtctaaagaaattggttattttaataatacatgtcagaacaattttgctggtttcttggactttcttatttggattttagatgtaccataacatactttggccttttaccctcttgattaacatgagaatcacatactatttaaaaaagtgcaatctttgtcctaagcagaatatatagtttgttttttccagtaaccaaaattagcatctgtgttagtctgttttgtgttgctctaaaggaatacctgagtctgggtaatttataaagaagtttatttggctcacagttctgcagactatacaagaagcaaagcaccagcatctgcttctggtgaggcctcagaaagcttatagtcatggtggaaggcaaagggggagcaggtgtgtcacatggcaagagagggcatgagagagatggctaggcgcttttaaacaagcagctcttgtgttaactaacgagcaagaattcactgattgccacagggagtgattgataagggatccaccaccacccccatccccaccccatgacacaaacacctcactaggctccatctctaacactgggaaattacgtttcagcatgagatttggaggggacaaatattcaaactgtatcagcatcctcactgaattactactttattatacagattaagttacccttttttggttttatttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttacattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgtacttttttgagtattcattattcagttggtggtggtccccaagggaaagttggctgaaaaagttaatagagccaaacacttcgtttgtttgccttatctagaatagttatccatacaaaccaaatgaatttttcaaaagaaagaggtcttagactaaaaaatggaagacagactagcttgtctccaaccttctttgttaacagaactaggtgatctgaaattttaataaatatataattgttatgtgtgaaggtattaagattaaaaatgaaaccaacaaatggctggtacagaggaagctttggggcataaatatatctctgtaactgctaagtacatacaaactgacatgctatgtgtgtacatccttggtgctccaa

SEQ ID NO: 131213 - DNA, 2880 bp, Homo sapiens
aactcatttaaaatcattttcagatggaatgaaatgtgaatatgataaaagccatgctaaattatacacttatatttattagaacatacctttggaagatagaaatcagtggtgactttttaattagatttattttataattgaaatttttcttttttttttttttaatagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcggtttgttctgttggaatagttccttgatgaagttcacatgagtatttggcttaaaatttacctttatactgtcagagtgaaagaaatgaggaatcaaagatatactcaaatgtttgggcagggaaatgcattggatctgattgccttatttaagtatgaagcctcctgtctttccagagttttaaggttcagaactggcagggtagatagtctgctaaagaattgtcctacattgtactgagggtaggacttgtccttttaagatcccctttcccctttacgtatattgctaaaaattgagtaaatctttatggagctaaaattttatctggccttcttcattaaagaaagcattatgtatgtcttagtgtactagtttaaaaaataaatggttctataatactgttcaaaactgtatgacctatgttttctcttcatatgaccaattgcagatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctgtaagtaagcaaatctatccattaagtcatttgaaggtattcatacagtcagtagcaagtggtatttagggaggccttttaaagtatcttggttttgacagaaaatggtaaggaatgagtccagaggaagaagagcaacaggatatagacagtccactcggagtgagagaatatgttctgggagtcggtgcagtctttcctgactctttttgaatagtattgctttagagtgctccagagtgagcatccttgactctgaagttggttctgatttattatttggcaaacattcctgcacaccttcagtactaggcagttttaggtcatcttattaagtaatcagaataaacttcaaatacctgagaaaatgtaaagcagtatctgtctgcttcattcaaactttgactaccattgagttcagctaggataggaaagctaagcaagtatgaaggaggaaatagtagggtttggtttagggctttccaatcttaagtccatagaataaatgaatttgtgcaaagggaggcttttagataaccttaggcttcttgttcagcctccatcaagaatactctgccaattttaagaactagttttctgtgccctctggtggtaagagttgtcaataagagcatttttctgtatgagctcaggaataggaacacagtaatgagtaggtgactttcataaccaccctccttctggtaattctttagtttcttttaaagactttggttttaatgttcttaactctttctgtaaagcctgagagaagatataggaagtggacccagaaaagcaatgtcctcactcctattatttgctgccgtgagacattcaagactctcagagagaaagcttatgatttataagttacaatataataaccttacagaagctttagtagttaaaaagcatttgactcctaaaaagtaagtatgaaaatgaaacatggtttaggataagcagtcagtttcttttgtaagctacttcaatgtagttttataaaaaatcaaaaaagatatatactgtaataaatttttccttgtggggaagtatagagatataatctcagtatttctttttgactagaaaacttcagccactgtgtattttcatatttaaaataagctactttaaaagcatatatcttaaattgtcttatttgtattgctttaagcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggtaaactaattaataattttcattccagatttagcaaaaacctccaaccagctttatttttcatattggggctaacttaattgatgctgagcatcagagttatttaaaaatgttagaatataagcaaaattttaccatattcttcgtggtattgatcatcattaggaacatcaaattttatgcttcgctgtaactcattggctctcttgtggggttttgaaggacatggaattgtccttacactgatttcttgcttggcttctaaattgcgtgtagctgcttttactatcttgtggtcagtggacgattcttactgctgttattgtctgcttctgatataaccttttctgtatctgtggtggcctggaaatcagataaccatatgttttccacttgtctgggttttgtttttgtttttcttttacttggaccagggtaaagcataactttgctaaaacacttagactgagtgaaggcttaaatgactttttctttttacaaagtaagaggtgttttaggaatcaatttctttttcctggggcatgtttacactgttgaaggtcttttttcttctttttcttcctaatttctggatcattgaggttgttgtttaagact

SEQ ID NO: 131214 - DNA, 1073 bp, Homo sapiens
taaagaaaactcaatctgtgagtttgagtgatgggccctgtttcaaatgagaaaatgagcccaactctgaagagtgtgatatgttcattgtttacagtataaaactacataggcaaaaatgtgttggcccttgcgtcattttgcttattttgtgctaaaagtctatacatactcattcagcaaatttttgttgaatgcccgttgtgttccagcctctcttctgaatggtggttggaaaacatgagttaaaacgttctatcctcatgaagtttaacttctctgctagagtctgtgtgtagaaaagcaggggaatatagtcagtccagatcttgtagctgtgtgttccatgctggcctctcaggaaaatgatcttattttttattatcattccagttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaaggtaatatagtttgcagaatttttacttcatatacattttgagcatctaaaaaaaaaagattctaaaacctttgaatcatttttgatcaagtattttgcaactgtatggcacattttcttttttctcccttaaatcacagtgtactgggcataacttcatctgaaatatatggataagtgagacctgcatttctaaaagatgtaaaatgaattttccttacattaaaaagccactgacgtgtttaataatacttctctctgtaataaattattagttatatcgtcttagtgtgttttacatctgaattcttgaaatgttttctgaatgaaacatgagtggttctcctttttccacagtaaagaattctggcttcaggaggttttttgttgttttgtttttttgtttgtttgtttgtttttccatttataggctcttttctgctcacattccacagta

SEQ ID NO: 131215 - DNA, 1174 bp, Homo sapiens
atcccttttaacataattttgtttttccattgattggctgttgtggtttggcatttctttttcaaattataactaacttacattccctatttcagatgacaaacttattagtaataatgatggcggtatctttgatgatccccctgccctctctgaggcaggggtgatgttgccagagcagcctgcacatgacgatatggatgaggatgataatgtatcaagtaagcatttcatgttcagtgattctggggatgattgtatggcatccagaaagatacttaccatagaagatgacaaactaaaagttgtagtttttagtgaattataaatatctttaagtacagtgcttatgattactggttctgattctatgtttaatcttgcacccctccccatttttttggccaattgggttcaagtctggcggggctttcccattaactagaaaaatattttttcttagtaataacaggatttctttccatttcatgaagagatttttctcctccccatttgtgggatatatgttatataccaaagctttttgtgactttttttttttttttttttttttacagtgggtgggcctgatagtcctgattcagtggatcccgttgaaccaatgccaaccatgactgatcaaacaacacttgttccaaatgaggaagaagcatttgcattggagcctattgatataactggtaagcatatgaacctttagatttatacagcatacaacataaggtcctatttctggtttttgcctgtctactgatctgctactgttgtattagataactaggcttcttgcttttttctgtttttttggcctgtctactgatctgctactgttgctttagttaactagcttcttgcttttatgtcacagtcatctgtcatagagtctttcttctatccaattataattttgagtattttgtagaatgtctgtgcaagttgctgtgaaatacaaaagtatagaacaagctttctgataatgcatatcttagtctcctggggttcccagaaagttagcagcttacttgtgtaacaactggaaaacattggaaagcttttttcaataaagtacaattctaaatgctgtgcagttggtctacgagctggaaaaaactaaaagtattctttttaaaaaaaaaacaaaactagaggctgg

SEQ ID NO: 131216 - DNA, 2041 bp, Homo sapiens
gttttgaggtattaatgttctggatatggctgatagtgtttagattggtgtttagcattacatactttttattttttatttagtatttttaaactatatgagagattattctttattagagaaagaaactgagtctcagggaagtcagggaactttagagtttacaccgcctgtaagttgcagggtcctaatgaaaacccatgcctatctagcccatgatttctaattttttcctctgtacttgatttagtgacttctgcatattacattgtatttgctgattattgatgcttttcaaatttaaatacaagttaatttccaaatcacttacattcttggattgtactggaatgtgtgaaagtattaaatattaaggcttctaaaacttggtgggttatacatatatatttttttaatttttcttatagagagaattgggatttgtttttcttatacatagacttgaaactaaaatgtatttgaccttcttttaaagtgacatcgatgtggcccagcagttcagcttgaatcagagtagagtggaagagataaccatgagagaagaagttgggaacatcagtattttacaagaaaatgattttggtaaaagagaaacaaattattagccattaattataatgttatattgtgttgctaatagcaatttcaaaagaaaaccagactatagacagaaagacttaaaatttcatgtaatgcattttcatcaagaaaagaatttggctttctaccagtagattaagcattattttcatacttggagctaattgtttacctacttctctccctatatgcaatcatagaacctatatattgatttctgcgaggagtcccaacattgaagtggtgatcacgtttaaaccaaccattttggaacagttagtttccctgttatacttgctattcaaaaacaggtattcaaaactagttagcaaggcatattgttttttaagaggcggggtctctgctgtgttatccatgctggagtgccgtggctcttcacaggctggattatagcacactacagcctcgaactcttggattcaagtgatcctcccacttcagcctcaagtagctgggactacaggcacatgccactgtgcccagaaccagattcttttcttgatgaaacacattataacgggaaagtttcagctgtgactgttaatgtaacttaacatacatacatatttagagtttatcaaacatattttaggatcatttaaatctagatctaagtttgaatttgctagtcatgccccagtgttgtaactgtgtgtaattgagtcattttaaaaaattcagatgctaaagaattaaagtttaaactagatattttaacatttgaagtaagacttcagtaagcaaatgtgacataattagaataaatcattagcagttttcttttatcacagtgctatttctaatctttctaaactaatgacaaattaaaatttgtttaggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattaggtatgtgggaatgatggttattccagcataaacagaatttctttattaagttgtaaagttttggaaacagttgctaattctgagtcttgaacagcttttagatatatatgagtgaattgtgatcagttggttcaataggacatttcggtaaaactagcctcttaaaatgttgtaacaaaacctaaatatgcttatctcagaatgctaaattttattagtacttaaaactgttctgtttgtgtttgatagctgtgttaagtaaaatattttttaaaatagataaataaactagaaaatacaaatgaagaatgagaatttttttttatataccaagtgttttatacttttataaa

SEQ ID NO: 131217 - DNA, 2682 bp, Homo sapiens
tggcatacttcacctattactcaattggctgaactgtgtttcatgcccactgaagaacaggtattagcagagaggaatgagacatctgtcaatgtgggggacatttgcttctcaaacaaaatcagaattgacttagcaagaaacaatggccctggattggcaaccaaaagtgttacgtgctccttaatgtgctaatgacacaattcatggaatggtttagtgcttgcttcctagcttccttcatgtttgtgttaattcgtgaatttccagtcactctgtcttttcaggatattcgatattcagggaatttataggtaaggacagagaaatgtatgtgattataaggcaactttaaaggaaaaagataaaaagaagactatgaatggcacgaaatgcaggttttggaatatgattaatgttttattcataggtgaaaatggcattacggacatcaggacatctcttactgggagtagttcgaatctatcacaggaaagccaaataccttcttgcagactgtaatgaagcattcattaagataaagatggcttttcggccaggtattgttaaacttgtttggtttttgttgttgttgtttactttggagtttctcatgttttttgtgttactgtagctaaacacattttctaaatctacatgctttgttttaattgaaatacgaggaacccttcaaagatagagcaaggcttggggaggcagtgcttcaagggaggaaacctacttgcgtctgttctccctgtgaagtaatggagctcacccccatttgttcttcctttggagctgcctttttaatacttttttcagcagcttacatagacttgagtcatcaagaggttaaaatgttggaaactaattgttatgtgatgattttttaaaatatagctcagaaaagacaattttaggattttaaactttttttcctaagtaaatattcttcgtagttttttgttattttgttttaggtaatgattggttataaaactggagtctgccaaccacaccaccatctaagaagataattaatatttaaattcacatatctttctataatttttaaaagcattgatgaaatttttattctaattaaaataatgtgtattttattaagaaatgccttaaacagtttctactgaggatacattctagtacttcagtttatgtcagtatgtgaacagtaaaatgtctgagatctaagattttatttaaaagtaaaatatttagaaaaagactacaatacttaaattaacatgtgaccaataagcacattttatctaaataacatgcttttttttgtctttcaaagtaaggcatatttattatagacaacttgaaaaatataggaaaaagataaagaaaattaaaattgtgtaattctttctccaaaataaccagctccttttaacatttaaggtactcttctgcagttattctttttccccctcataaatatcatgtttaattaggaaactattactagttatttgttgatatgtccgtttaaacatttatgagcttaatgcataattagtgctttgactttttcctaaagcaaggaatacaatttatgagcatggaaaaagagaagtacttgtgcttcaaggtattttgcatatgttatcaacctttctatgagaatataaacttaggaagttatacctacttatctccctctgatccctagataatttatgggtagctagatatttaagcttagcatttcttttctaggtgtggttgacctgcctgaggaaaatcgggaagcagcttataatgccattactttacctgaagaatttcatgactttgatcagccactgcctgacttagagtatgtgtcttcttttaaaaaaaattgttgacttggtctgcaataagcagtagtattagcttccaaatgtatagttttccttggaatgttttacattaacagctaaaatgcatatatatatttatataggatagtatataaatatggaacataaaacctagaaagttgttcttctgtaagaaaatcatgtggatgtcagctttaacacagctaagatgtgagagttttgacaagcttaggccaaagcttacgtaaactgaaacagatacgcttgttatataatgatagcagggaatgtaaactgttgcttcatgatatttttcagagttatatattaaagtcagctactggattggccaggctatactcagagccataattctgttctggtttgtttttatttttgttttaaatgaacatacgagataactttttatgaagagcaacaaagggtcattgtcatgacacacatttgagaggagagagttacacagagatggctgttatagcagagtactgtagttatgtttcccttttctcaagcccttacgatccagctatcatgccatgatgttggaacgtgactgtagctttccaagtgacttattagcataactgacaaccaagaaactctacaccattacagatttctctgctttttgaaatgatctgtggcttctaattagagtaagttatgacctattttgttactgcatgtgtgttgattagttctaggctctatctagctattttacttttttctctctttttgacattttatttgaaaattttttattatggaaatttttaaacatagctaataactagagaaa

SEQ ID NO: 131218 - DNA, 1089 bp, Homo sapiens
tctatttggtaacaggatgtaaagatatttccacagagtgaacgggcctgaaatttctaatgtttgctttggtgtgcagttcttgttgtgaaaatgtcagtttagttgtttagcataagtgtcacacgtggctcatttgcaactgcaagcttgcatactttttctcttctctcttccactcccccactggaagaaccactggccctatttgcagagctttcccagaatatgtagcctggaatctttattatatttatgtttacactttaacacacactagctcaaaaacatatgccatacctcattttacctactcctaggctaaactctgaaccagactaatccagaaagaaagcttttgcccaaacaccactttttgaaagttgctagttctagataagataatagcagaggttttttttccctcctttgttcttaggtgaaggttcaatcaatattaattttaaattttataacaccacataaaaatagattctgtttttccattaggagcaacattttactttgaatttttttaaaattagggattcattgtctgataaattctgaatttgatcacaaatttggtataattttggatgtctaaaaatgtatggccatatacatcatcatttatgctgtaagtcacataaaatgctcataaatacagaacctgagagtcataagtagggtcctagagtgctgtagaaaatacacataaaatttaaaatacaacattttcttttacaaataacaatatactaatcataatttaaacattaagcaaatgtttaaaagctttttttgttaccttagaacttgttgtgctttatggcgtggtttgggaaagtatctggggatgtttgagttcatattgccttgttctttcagtaaattttccttatggctagaggaattttgaatacttgtgtttagatggagtcttatctcattgttttatcaactactgcttttccacatactgtatcccatgttaatgttgatcaagatctgcctcgaaaaaaggttgggagtatattttctggtgaaaaaaagctatggatactattgttctttatcaattagtat

SEQ ID NO: 131219 - DNA, 1480 bp, Homo sapiens
ttaaatgatataaaggaaatatcctgcagttaatgtactcttctgaactggggttttcaagcggcctttcttaatacattagagtgctgaaggaaagtagaatgtcagtaacatatttgtgattccaagactttcagtcataagataaatctgctgtaccattgtccctgatttaatatttaaattataagtagataaatgctttgtaagttcttaagttaagaaaactatatatataattctttaccttttttgaacttcgatttttctaaactacccacctgtaaaatggggccagcccatctgcttagctttgcttggtggaatatgaaatgcttagtacagtacttttcgtgtagtagcaattttacagataatttatcccagaatcgcgatttttaatggcattctaaaaatggaaatttccacagatttttatctgtgcctgagtatctttcttcatagattttcttttcttgccatgaaaaatatattctctagctcttggccagtaaacagactatttctactgtcaatcaagatagaaatgaaacaaggcatgaaagcaatttgactcttgtcccttttactttcagctcttagtattttggggtctatttttttttcctctctcaaaattaaaacaatagatttgttttaaatctgttgtttttaaaatacatattaaacatttactcaagcattttatagttttcatattaaagagagaagaaaaattttaaatttcttatgtcttgataagtatttaaattgtcagatgatgtttacattaacttttttttcccctcttaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtatgtttgatgttgacatttttattcactttgttgattgtttattgatatgtgaaatagaacttctaaaacagtttttttaggtaggggcattggagtgcaaggaaaatccttagaaatgtttctttattatgtgaagtccttatcacctctagatagacttgatatgattacagattagattttaaaaaaaatctctaagtgcatatattttgatttgcctatttttaatggcaaataagcatcagtcagggcaatgcccaaatattgtttactgatctgttcctcagaggagcttttatttgagaccctgtctcaaaaaaaaaaaaaaccgacgtggaagtgctgtaaatgcgtattacttagtataataagccaatctaaaaaggctacatattatatgattgcagctataggacactctggaaaagccaaaactatacaaatgagacagtaaaaagatggtaggttggggagagaatggagggttg

SEQ ID NO: 131220 - DNA, 1049 bp, Homo sapiens
taatcactccagcaccatttgttgaaaaatgtatcatttctccattagatagcttttgcatctttgtaaaaaaaaaaaaaaattagttgaacttagttgtgcgggctatttctgggttctcagttctgttacattgactgtgtttcctctgctaataccaatcttgagtattatagctatatagtaagtcttgaaatcaaatagactaatttttctcactatttttcaaaatagttttagcttttttagtttatttgcttttctatataaatttgataatcttgcctataaatataaaaaaactcattttgataattgtattaaagattctttaaaaactaaacatatacttaacaatacttgtcagcagtcacattcgggacagttgtcctagagaaatgaaaacttaatgttcaccaaaagtctgtacatgaatatttatagcaggtttatttgtaatagccaaaaactggaagcaactaaatgtccttctataggtgaatgtccaagcatatggtggtatatgaatctcacggaatgctgtccaacagtaaaagggaatatactattgataaacgtaacaacttggatcacagaagcattgtgctagatccaaaaagccatttcaagaagtcacataccatatgattcatttatataattttctcaaaacaacaaaattaagtccagtgtggtgactcaatgcctgtagttccaactacttgagaggctgagggaggaggattgcttgagcctaggagttcaaggctgcagtgagctgtgatcacatcactgcacttcagcctgggagacagaatgagaccccatctcttaaaagaaaaaaagtgacaaaattagaaatgtagaacaggtggtgtttgtcaagacttagaaatggcagagagagagggatgaatgtgatgagttttgtagtgatggaatagctgtgtatctttttgcagtggtgattatacacatctgcatatgtgacaaaatggtataaaagtctgtagacacattgaatcaatgtcagtgccctggttttgata

SEQ ID NO: 131221 - DNA, 1054 bp, Homo sapiens
taatcgacttttttaaagattggatgaagtttggtattatcaaggaaaaaaaaataggcttaaaaggcaattataattacactttctccttattcagatatacaccaggagtcgatccaccactgctcctttggcttcctttagttattagagtgatttcctcttgctaattgtttcccacattaattttagcatcactctgccttccttagccccatcctatgccaaacaggcttctgtttaggaatctctgcctctgcatagctgggatattttaggcacggtgctctgaccagcagctgaagtgctggccaggagctactgacacctgttgaaaaatgccagtagttttaatttttaaaacgtctaaaattttttacatatgccaattatgagatcacttggtggatcttacttacttattcattaagcacatatttagtaattgtcatgccacagatagtattctagaagcttaatattaaggagttttttgtttaggatacagttgcttgcttccatagtggaacttggggcttgtcctgtacaacagcgattatatttctcagaacatgctgctatgttggatttctgtaaagttctctagattttatttataacatagtaggagcagcttaagttttgtgataacattttaaggcttgaagtaggcactgatttgaaacataggaggctctcttccggtatgggaagcatgttttaatctataaaataacaaatggcaaataaagcacctttgaggtgttatttaatgctcgtaccttaagaatattttgtctgagttcttagtatagaatatagtatttcttcattctttaatttcttttttttaaaaaataaacacggggtcttgctatattgaccagggtggtctggaactcctgccctcaagcattcctcttaccttggcctcccaaagggctgggatggcaggcgtgagccaccaccgctagccaatttcttccttccttaactccaaatttgggaggaagagtttacaacattagacagttgacaaagcctggtttttttt

SEQ ID NO: 131222 - DNA, 1877 bp, Homo sapiens
ccgcatcatcgcttgttcggtaacaaatgattctgatccattctgagatctacaaaggctgttaccctgcaggtccatctcacgtcccccaggaggccggggaaaccctgggctgcggagggaggggaggaggtttgaacgagcccgctctggggaccgggccgcctactccgcgggtaaaaatggctgtctgggaggaggcggtggcgggcccggcgcccgcggtgccagccccgggagcagcaaccttccgccgaactcgggtgcggggctcaagaaagtgcggagctggtggggctgggcggggtggggcggggggtcggcgggtgcccctcggccagtgactgctgctgccctcccgttttaaaaagataatttttacgttgggaatgctgaatatttcacagacgcgtggaaaaagagacggagggaagttgcttctttttccaaggatatttgcataattggttttcccctgaacttttctgatcattctttaaagtgattaaggatatcgggtgttgtagagacgctctgggggaggtgtgtgtttctgataaatgcttgatgcccttttcgtcgctgaaaaaggctttttgcgaatgatccgctttgatagtgtggggtgacactgtcgggttgtgctgccagacttagcggccttcttcaaatttgtaagagggaaaccctgggggatttacttggtcactctgatttgttagtgtcttcagcgtgaaaaaaaaaacagcgtttgtgcgaagagtttctgggaaaggcttgtgtttatcggcttctttttgcaagggaaagttaatctttgttgtcattatactggttagaagagtaattggttttcaggcaaaaatttctattttcttaaattgggtgtaaatgccagcgggcagtgcgagtctatagaattttggagacaggcaggagaaggtttctcaaatcgtgaagtcattaaatacctttgttaatgtcggaggcaactaattatttttggaaaggcattgatgaggacatacgccatatctgatcttcaaataagttaacagtttgtatagttgaggtgacagcagtgcataactaatagacatagtgcttttttttatacacaagtcagaattacaaaagaatttctggtgaattattttgtgaaacatacaaattctaagaaacgcttttacagtttggtacagaatggaaattttctaattcttgagaaataaggttgtgtttttagtttaaatgtcaaaccagagttgttaggcatgattatactggctggttaatgttttgctgcaagattgtcttcagagttacttttcgcatcagcagtggcactatgttaggtgtgcccttgtatttaattttcataatcttttttgatgaatattatcccagtttatagttgagaagtaacttattcaccgttacaaaacaactgagcaaagagggagcttaatttgaacctacgactgtctgattgtaaaactcttggtcaaaggatgttagaaccaaaacagaggagatttctagtgtgcagggttagaaatatcttcagagatccttccccctactcccctgaagaggtagctccgttctgatctgagttaggtattgacgttttcaaaggttaggtaaaccaccagatttcaacctttcaggttttcatagtagggaaactgaactgcataaaggttaggcagcttaactgctagttaatgacaatagcaggattatgtctttacttctgagatagtagtttttactttgaataggtggtgtacatttatgtcccgagttaaaatatgtgtgtgtgtgtgtgtgtgtgtgtgtatgtatatatatatatcaaacagtacaaaaaggta

SEQ ID NO: 131223 - DNA, 1078 bp, Homo sapiens
aaattagccagacgtggtggcaggcacctgtagtccctgctactcaggagtctgaggcaggagaatggcgtgaacccaggagacagagcttgcagtgagccgaaatcctgccactgcactccagcctgggtgacagagcaagactccatctcaaaaaaaaaaaaaaaaaaaaaagcacacgcgaagctctggatcctaaaactaacgcatacaaccctgaaacaattctgatgaacacattatgctttgcataagttttgaggggcaatttatagacccaaaacaaatgacaggggaaggtgacagaaaaacatctaagagaggggagagaaaaatgatgtattaccaagttttaaagttatttatttgttatttttactgggacatagaagtaaaatataactatagataaatctctctctgtctctctcactcaaagaatgctttaatgccaactttcggtattcaaccttgtgtcacctgacctttctggcattgcctgagctttcagagtttgtgcttgttttgttttacttgattattctcagtttgtctgtccagcagcctgccctgcttcttgtggagaattgtttctacttggattctaaccatgccctttaggtggtctgtgactaagggtattccatcttcctggatatagtcatgcagctcaaggcaggcagatgggtttgtccttaggatttttgaatgggcactaaaagagtagatgactatttctgccagtagaagctgtggatcaggggcttggaagctgctggtggtcaccatgtgagaaagcccacaccctaatggaggtgactgaaacggaaccactaaaagcacaaaaggggagggagggagggagggtgcttcgcttccttgttcctggggtcaagctgtataagactccaggccttgctcttgtttatgtacatgaaatattctgatatccttctcataaaatctctttttgcctaagtaaattcaagctggagtttcatgacttgtatctagtgttcataactaatacagttgttcagttttaggagttaaaatggttcttactgttgaattggac

SEQ ID NO: 131224 - DNA, 1028 bp, Homo sapiens
tcttatcagagttaaggcattttgagaatatttttgcaataccagccatatattcttcattttcttccactaaaatatcatcagattcacttttttttttaaactgtactttgtttttaacttcttggttgaggtcagcagcatgctgcatttatataatagtaatattaaaattgtaaatttttttttaaagttacacttcaaaaattaaaggggaaaaagtatttcaagtcagagggtttatcacaaagtttttctaggtctgttttatagcagtgaaacaggtatgccaagttgttaataaatgggcatgcattgctcttaaattcttaaaattaaacttgatcagttgtgagggacagcttatgtctatgcattgcctaaaaattgtttctgtttgttggctttacttatagaaaatcttgatttttttttcattacttgatatttttattctttgtttttcctgataagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgaggtaattttttgtgatagagggaggatgaatataaggtgtgaactagtgtcaagacagttgttaatctttttcctctctctcctgttttagcaatatttccaggtttcgaattttattggttttacttttgaccagagaagatgaaaatgtgatatatatgcataaaatactactatatttttacattaacaatttcttgtagactttgacaggcttatagtaatttttgttgttgttaggaagaaatgttttcctatggcaatttttattgctgtcagtgtctccttttaattaagtcagggatatttttagtaggaattttaatagtatcatatacttttaaggtggttttcatgaagtactttacagataaaatattatttttattattatta

SEQ ID NO: 131225 - DNA, 1028 bp, Homo sapiens
gggtctaagacaagactgataccatgctcttacaatgctgtaaacctattagattataagattctattgactcttgtaacaattaatattaagtagataggaattatgtcaataatgtgtatgaataaacttattaagatacataaaggaagctttgaatgattaaaagaacatataaagttcttggatgagcaatacatattataaaaataccagtcttgatttaatactcacagttttaatacagtaacaatccaaatcctaataagaaagcatgcaaaaacaataggattttagtgcaataccaatcaataaacaaatccaaataaaacccaaatggaatttttttcttgaaagtatacaaaaatatcaaagaaaatgttgataaatacgactaataaagcagaattcttagcttcaaaaattaaactgtaatatgaagcatattataaaaatggtaattaggtgtataatactggcacaagaataggcagattagtaaaataatctagccagaaaaacagccttcttattgtacatgagaatttaatatgacagaagagggcttgtgtggaaaattagtctttagaaatagaaactttgggggcgaaattaagctagcttttacattacaccataaatcaaaatgaatttcagagttgaaaataagacctgcaaaacaaaatattggataattttttaagtattttaaaactcggaagaaaggaaaaagatggatagattttataaaataaaattttgtaacttttttaaaaggtgaaacacacatttagaaaactatttccaaaaaatctgattgtaatacatgacaatcataataaaaaactcacagtaaaaaattggtagagggtgaggaggagaatgggaacttttagtttagatcttgaaaaataactggtgtttggtagtctagatgtatgagacattcacttattaagacgtgttatatgtttctgttgataaatatgtattacctcaataaatgtgttctgcttatgtttctctaa

SEQ ID NO: 131226 - DNA, 1072 bp, Homo sapiens
agggaatgtggaaattgtattattttggccttagttctataaataatatttctactgtagaacaataatcaatgcagctacactctgctacggagctgtagcaagttctgaaaggttatattcacaattcagaactgacatgggtttacccagttattcacaagtctacttggggccaattatgaacgtggcagggtttattaaatacatgaacctcacaaattctcaaagtttcaactttttcttgaaggagagcatactaatagattgaggagtaaagaaaggtgaattaagttgttgtaatgtgttcccttgggcaagtaaatctctgttttctgtaaaatgatgggtgagactagataatctcatattctatgttagaattttggtcgcaaatattagaacccaattctaaatggcttaagccaaaagggatttcttagttcctgtagtgagaaaagatgctagagaagagctcacagaataaaagaaaatggcaggaaacagggcttcaggtattggaatcaagtttcagtgccctcaggattctgtgtccacccctaattttagtctgtctctgtttgctccattctctctcattgcagatcggttttttccaagtggtggggaaaatggccttccactgtcctttcaccttgctgtatcctgagcccagagctaggttgcttctccaactctaaattgagaaatcctagaatgaattctaaaaagtttgggttatataaccaacccatggaccaatgatagtataaatgggtagtatgattagactaatccaggttataagctcattcttgtggccaggaatcgggtatgggagttatggaagagtgtactgtgcaaggaacaaatattcgaaaaagagggggtcaaccaggaaaatttgcaaaaaaaaaaaaaaaatccacaaacaacagcaaccacagtccactgttgttctttcttggttataatactatctcagatataatactagttatccaatctttcagaagcccaagaaaagtttacagaaaatcaaatgcatcattgactgtcatgggaattacta

SEQ ID NO: 131227 - DNA, 1050 bp, Homo sapiens
aattgttaaagttggcttattgcaactactgtttctaaaaaataagaatgcagacagtgaatggaggggtactcagttctagaagcttttgagtatatacaatgtgtgtagtttgatgtaaaatgtcagctggatctagatttccataatttatctactttttataggtgcctacaagccccagaatattattgcattaacctgcattttttgttaagaatagcttatgtgaagcaatttgagcccttaagtaggcagactttgagtaggggaaatgctaattcatttaagagacagcatacaaataacccttcttaggtttatccaagcccagactgatttgctgattctgggtccttggcttctgttttccactggaggaagagagctcagtctttatattgattggttaaggacgagcttgagtcagctgatatgcagcaatggcagtattgagttgttgagttgtatttgtggcttgcctagaaatgaaagctttttattgtattattgtaagaatgggtaatgaaagcaagtagtcatcgaagttattgatggctttgtgttttgaatcagttactagggtacacagggctagttgatttgctagatttagccataaagtataaataagaattaattggtgaaatgcttgttaatagatcataataatgcattctttccttgtctgttggagaacatttcagcctttgaaaaggaatttaggaagatcaatactgtttgaagcacattcttacaaaaaaaatccatcagggtcagagaaactatggagttacatgacatctactgacggtagagaatatcacaattcaggctgcactgagagattatctcccccacctataaatatttgtaacaaatatctgcgtgtggaaatattgtggctctggtctgtgaaactggaaacctagtgcccgaaattccctagtcagctcttactcatgctggggattggatgggaagtggttgggcccaggagctagtgttcaatttaacttctttcatgctgaaggatgatgctagcagcct

SEQ ID NO: 131228 - DNA, 1003 bp, Homo sapiens
caggtgcatagatggtgagacttggtggccgggccagaccccaagctttgctgcttgctcatttgcctgactccattttctgcaatgtttccatctcaccttgcacttctctcatcattatccttgtttctctccttctccctagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaggccaatgagaactcaactcctggctcctgggactgcaccagactgctccaaactcacctcactggcttctgtgtcccaagactaggttgtgtacagtttaattatggaacattaaataattatttttgaaatgattgctatgcaggtttaaacttttttaatgatcaaaactattaaaaaccagagttctttgtttaatcaaaattgtgttggttgtgaatatttcaaagctgctattccttttcccacagacatcattgtcatggccatgtagggtgccctgcagtttcaaaagctcaaacttcgtggaaaacacaataagtcactctacccattatcaagaaataactgagcataagttgtaacttcattattcaactttgccagtgcaaattgttttccacttcgaatcttcaaatccacttgaacttttatctctaaaatgtcgctgcatgaaagaaagtattacgacttccaggtaggcagttctaactgaaatctctatgtttgagatagatatatatgat

SEQ ID NO: 131229 - DNA, 1075 bp, Homo sapiens
aatgtctgtatgtctgtatctctgtgccttgtttcctcatctgtaaaatgggagtaataatagaacctgccttgtaggctccttatgaagactaaatgaagcatttcttgtaaaacactttagaacaatatctggtatataacaagtaccatagaagtgatagttatcgtcatcatcatcatcattatcattaccattcatgacatgtttagggattcaaagaatgggtatgtgttttctgtctcagaagtccacttgtcatcatgtgataatggccccctgtgaaacccatctttgatttttacagatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacaggtaagtatagaagagccctcttcccttgcttcactcactggtggttcagccccaggtaatgaggactcacgttcctctagctgttccacccaggagcatataatgaggagaaaccaggaatgaactacatctgaaagctagaaaagagtgtatgattggtgcagggataattaggaagacacaagttaagagtatctttatgccaaggatgtaaagctctcctataatctttaaggtgacatgagaaagatatgtctttagagtttgtcttagtccatttgggctgctatgacaaaaataccattgactgggtgacttaaataacagacatttatttttcatagttctagaggctggagagtcccagatcaaggcaccagcagatttggtgcctgacaagagactgtttcctgattcatagatagccctctgctcattgtgtcttcacatggcagaaagaagggcaagagagttctctagggtcctttttataagagcactgctcccatttgtgaggactccaccctcatgacctaatcatcccacagagacctcacctgcaaatatcatcacattaagaattaagcttcaacata

SEQ ID NO: 131230 - DNA, 1040 bp, Homo sapiens
taagagggtgcttttattttaggcactttggctttgatatatgctgggtatgatatatgttgtatattcattctttggatatacatgggaaatttctcatttataaaacagatgtgtttgtgtctcacgtgaatcaaggcacgtgcacctttgaggaagggggaaaagaagctttttcaacttatgttttagcttgaacagactggatttttaaagggcatatcagcaaatttttttcttcctttcatttccatactactctgaagtttctttaacagaaaacattaaaatgtgcataattatggggcaaaatgtcaagcagtcagtttaatttgctgatgaatacatagaattaatgtttcgccacagtccccggattttgcattatgaattagtggggagaaggtaatgttttgttgacatttgttaacactgttgattgcttgtttggcttgtgttctgcctgcaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaagtgaggaatctggacatgtctcttacagactttacatagctttttatattggctgctgcataaataggaactaaggccaaatcttgttaacagcattgaggaaaattagtctgtatccccgcttaagttttgctgatgtgtcaaatgtgtgtttttgaaaccagtgaaacctcttggcatgtttcatttccagaaattatggtagagtaacattttcagttggtctgaagtgtgaaaatactctcagggcatattaggtaactgaatatttagaataacaacaacaaaagtaaatacctaagtcagcacccaagggcactgttctaggtgcttgggattcatcactgagtaaagcagaaaaaattccttgccaatgcaggtcttatattctaacaaagaaagactgtcta

SEQ ID NO: 131231 - DNA, 1022 bp, Homo sapiens
aaaaaaaattccatagatgctttcaaggtgccatcagatagagttgcatagatgttatgtcaaagggcaacctaaataatcccaggacaaaatgtcctggacctcaccttgttaaaatgctttctatgcagccgaagctctataaatacttgttgaatgagtggttgggccagggtggggggatgcatgctttggggattaaaggtggacacaccgccaattgtgtcatgtgtaggttggcaggaggaagggatgttgataagcttaacattcatagggaaagacagctatggaatacagggtacaggtcactctggcttgcatttttctgccactttctgcaagggaagctggaacacattcattcaacaagtatttattgagagatttctttgtcctggtctccatgccaggtacttcagttacacagttccaggctatatccatctgagtcctggcaacaaactgaattcaaatcagatgattcaaatgaaggaactttggattccttagggaggtgtagatggggttaaaagaccccataagagagaatgaggcacctggtgagtaatgacagcaggaagcagctcctccctttggcctgaaggagttagagaaggaactccttctttcaaaggccctgagagatggcactaggatggagaggctgctctacaagtgctatgatcatggaaggacgtggctactgccagaactctaatggcaaaggagagagggagcagagaagagatacactgacctctctctctatcctgcctcgattttcctgccggtgactcccattgacctaacccaaccaggtgatgcagtccataggggtccattatctgagggcacagggcaggacaagaagagtggatagtggattttggagggcaaacacaggcaaagcagcacaccgccatggtgcaacaaatggtcaagacaactacagcatgtaccttaatcatcatcctatgacctgaagtattgattcatcctctatctttccctgggcacaa

SEQ ID NO: 131232 - DNA, 1050 bp, Homo sapiens
gtgccatctaaaaaactttccttgtcagtccccaaggggtcaggtcataagagagtggctcacacctttgcgccagaatgacaaaatcagtttattaggctgaaccatttgatatcatcatcgactcaccaaaagtggcaatttcatatggtttgacataatgcaattgtaactgtcacaaggacaagatgatcagtgcattatctattcagttccatttatgagtgcctactgtgtgctgagctccttgtaacaggcttggaacacagtggggaatgtgacaaatatagccatggctctcataaggctggagtcaaacaacctgtttgttagagagctgcttggtaagcatttaatgagaaaaggtggatgttggaataatcacatgcctctctcacaaatcaatctcaccataagcacagtttcatgcaggcccttatatccatcccccccatagaatagcccatcataggaatggcagtgttccaattccaatgcctgaagccatgaacagtactcagaggcaggcagttaatgttgaactttgggattctttgttttgtatgcttccatgggtcaaggagaccagctctgcttctggtggataatgtctttctttggatatgtcaggatattcagacacaatccagtctgtctgggagccattctgatttctttaggtagtatagcattttcatgctctgactcactgattgattttatattttcattctcagtgaaaagaaactccccgtttctttctttataaaatggtggtgataataatagtacctttctcgtgggctttatcagatgtctcttacaagatgcctcagatcctcccagctgcatctatattcaggcccctggcatttgttcagtccttgcctccaccttgggcactgaatccagtgggctgggttcttcctatgtcttttccctgactctcagtgccctgggattgcacctcagagtgaagcgtttgcacttaagtcttgcttcaggctcagtattctagaaaacctgggctatgacatgggcccattttga

SEQ ID NO: 131233 - DNA, 1011 bp, Homo sapiens
aagtatgcatttttgaactaaatgcctttattggaaattataaagtcacataaaatcagcaaccattctagagcatgcaaaacatgagctcatcttagttctagcttgaatttttttatttctcccacattgcctggtgtagtgcaagttcagagcagatgttcagatgctcagtatacatttttatttaatttgatcagagttgttatctcacacaccatcataagatatcagaatttaggaaaccactttattaagctccagccaccgtaattctttttcctgcagctttcccctattcccggacacagttggttttgtttgtttgtttgtttgtttatttgtttgctctttctgtcctctctccagttgttggggtgataatgttctgaggttgtgtgggaatggactcactttaaaactcagttttgatgtctgccgttttgtcttgctgagatttccagctcctctttctctttctgtctctgagaagaggctttgggttggaggcatacataaatacatcctaccccagccatctaatgagccccatccctttcagatcatagttctatggaattgtgacaagcccctaccagccaaacaccgctggcctgccactgctgtgcctgtcgtcgtcattgaaggagagagcaaggtaagactcgaaggggacctatatgtggaaccactgtggagccttggtttctccatggggcactttgggtcttggccctagatatcttctccctgttcctggattattttttctaaaactgtacttttctcagaatattctcagatttgaccacaataggctttcaaatcagggaaatctgggtcttgataccaactcttttatagctttgtgaccttgtgtgtatacttaacctctatgagcctcagtttcctcatctacaaagtggaaacaataatatataccttgtagggttgctgttaggattaaataaagtcaggagctggcaatagttatctttctgtaaatgacaa

SEQ ID NO: 131234 - DNA, 1023 bp, Homo sapiens
tgtacttaaaatcacattgcattaaatggagacctggaaaatggtgatttgggtcttaaatgtcttaaaacttacggcaggatttttttcttttttttttttaatgtaaaaaaaattgctgaaaacataaaattctgtaccaagttaattatttgccaaatcatattctaatgagtggatggtataattgtaagagtttgaaagtcacagagagaaagctataaagtggactaatcacattcaactgacaaatgattcgggatgggaggatgtttgactctaaatgtagaatttaatgatctgcaaggtcccaaagtccaaagaaactaatgaactagcttggctattattagtcttcatatgccatggttcttgtcctattatgtaggatgttttaagcaattgttaactcactacttttcaagatgaaatatagaaaaacttcagtaaccagcacccaaagtcctccaattgactttgaaaggaaaatgaaatatgacaagtatacacatctacctcttgaattaaaggaacagctgaaaacctcaatagcttctagaatgtgtcatgtcttgaatatgctttccgtttagcatctacaggtctacattgacctctcttgttctctgagaacagatcttcttgataggggcctggaacctatcttagttcttagaagtttaaccatcagggaaagactaactgctccacacagtctattttggaatgagcatggactcattattatacaaagacaagatagaacttatggtttaactgaagtttaattaggaaatttgattggctataattcatatgtttctctcactctttttcattgctccattactctctctgtcttgcagacatttttatccggagaattaaagtgggagggagggtagagtcactactctgactgccaccatctttcgaatttggattgagcatcatcctttccaaatatcatcaggatctcatcctcactgtgtgctatgttttattttctagattattcaggac

SEQ ID NO: 131235 - DNA, 1030 bp, Homo sapiens
aaattagccaggcatggtggcacacgcttgtaatcccagctactcgggaggctgaggcaggagaatatcttgaacctgggaggtggaggttgcagtcagctgagattgcaccattatactccagcctgggcaacaagagcaaaactccacctcaaaaaaaaaaaaaaaaaaaaagaaaaatatatataatggccaagtaagggcaaatcctctaccattccaaaaatatgagtagttttctgggcaccacagtccaatggcattgcgggacagcagaattctcaagacttaggcaagccagccaaccagcgtcaatgtggcaaagttgtgttaagaggagaatcaggatcatacccatgtggcacagaaagtgttaaatttgtgaaagcagaaaatcttttaggcagatgggcgcccgtcctcaagttgctttttttttaaggcaggacggaaaaagaaaaaggaagcatggagatgattaaaacctttggaaatagagcagatagcattggcctgaggctacaccgaagtagcacaaagagctaggaaaagattcaggaaactgcacacgcatgcattacaagcttgaagaaaggagagcagagatcttcgttgaggtgattctgaggtgtcccaaaatgaggtgggggcattgtggccttccttttggagaattcactctggaagagtgatgactgctctaaaagctaatgtaatatggaacctacactgagaaatctgagtaataccaagaaactgaagtcaccctacttggtccacatcgctgttttcttgccatcctgactatcagagccagtgctggtcatgctccaggcacaccagggcatttatccaccccatgctgagcttgggctcctgctcccaccctagggcgagctctggtcagtgttctcttaggcatagtgtgtatttttttcatcctggaactgggtaaaaggggctgtttaagacccaggcccattcccatgaaggggacaggatcataatgacttccaagggcttccttcct

SEQ ID NO: 131236 - DNA, 1469 bp, Homo sapiens
acccataattttccttttatataccaatgctcccatgaatttgatgtgaacaaattgaaagtttgtctttggtatggagcgcattttaggatacttaattgtggttgtgcagtttctttcttttttttttttgagatggagtctcgctctgtcactcaagctggagtgccatggcatgatctcagctcactgcaacctccacctcccgggtttaagcgattcttctgcctcagcctcccgagtagctgggattacaagtgcctgccaccacactcagctaatttttgtatttttagtagagatggtgtttcaccatgttggccaggctggtcttgaactcctgacctcgtgatccacctgcctcagcctcccaaagtgctgggattacaggcgtgagccagcgcgcccagccacttgtccagtttctaccatttcaccaaacttgatgggcatttcaccttctgaagcaactttttggcttgactctaaagattttgatttttgtcacccccacccacccagacttgctggtgtttttcccctctcatattcagtctgtctttgcacagctgcctccatattgagcagcaactgtgtactatcattaacaatggttttaaagagttggcacccagcccaaatgtctgctctgggaaatgtttttttgttatgttacaattttttatttcctgttttagaacagctgggatgtttttatttgcatatattcttgtcatcatgtcaccaagagagcttaatgtgactttcttgtatctattctggtgcattccatttgttttgctaccatacatgaccttttattaagacttcattgagctcggcaacttccaaaacaatccagccaaattggaattaatttatcactttcccatacctgtctctcaggacaagcagattaataaccaatagccaagtgccattaaaacttggaactctgtcttttcaatcaattggagttgtcttccagagcactttgcagagtgctgtcagacacttgtatcatatcacaagccggtagaatacattgcacttgatgtagtaagatgaagatgcatgttatttaagagaggggaacagcattggtaggtgagtctgtgatattccttttctcctttcataaccacagcagactcaattttctggagactatatagcaatgacagctttaggcatttttcttttcttttcttttcttttttttttttaagacagtcttgctctgtcacccaggctggagtgcagcggtgcaatctcagctcactgcaacttctgcctcccagttcaagcaattcttctgcctcagccttccgagtagctgggcctataggtgcacaccaccatgcccagctaatttttgtatttttagtagagatggggtttcaccatattggccaggccggtcttgaactcctgaactcgtgatccgcctgcctcggcctcccaaagtg

SEQ ID NO: 131237 - DNA, 1033 bp, Homo sapiens
tttcccaagttttcttaaactcataatgtacttgaaactgcctgtgtaggaatgtgtttgtggtaatcactttaaaagtgacagtcctaaacaaaatgaaatgctttttatctttcttaaacttcactggcataaagaaacaggtaacactcatattttgtatgttttttcgaaaagcaaaagcaatgtaatatcattaaatggtatttgagtaaaataaattcatctcttctgtagaccagtttcctgtaccccctcctagttcaggttttttttttttcttttcttttctcgttattctttctttccctttcttaggctagcatccttctctctcacctcctctttctcctgtgagttatgtcagccattcttaaacaggaatatttttcctgggtaactgaacgttcttggttaagtgtagaaactccatcttgaaagagaagacaaatgttgttttgtgcctgtgattgaggttttctgaatagtttttaatagcatggttttgaaggggtggggaacaagaacagtcttagttttgctgaatgccgtattgttaaaggagaaggagaagcaccagtaattttctcttcttctttttaagactatggggcaacatattttatcaagacttaaaaatctgattttggaagcaaagactgggcaaaccaaattgttgccagaacgatcagacttgtctttatatatactgcttgcaaaagggatcctaattgctttgtccaacatgatgattcatgtttactcttcatgcagcaacccaacctccttcctcaaaatggaaaagtgagagctgcctgctggtggctttcccgagttgctttgcgtaaattcatgcacatgggcgcccacctatggtcaatatccccacattcgcaatgagtcttcatttgctgtttactcctcttctctttctaggtatgattatcgggaaatgctgcacaatgccactttctgtctggttcctcgtggtcgcaggcttgggtccttcagattcctggaggctttgcaggta

SEQ ID NO: 131238 - DNA, 1051 bp, Homo sapiens
cctccccaaactgggtggtttctctcaccttggtgcctttgttcctgctatgctatctctacccccaggaattcccatcacctcctcttacccctgtgcctggttgcttcttgtacatcctttaagatttagctcagggtctcacttcctccaggaggcctccctgcctacatgtggccattgcttctcttctctgtataacacccacctctacctcatgtccaatcctagcactcctctcgctgactaatcatcatttgataacacatgttgtttattctggacagtgagctccctgaagagtgcctgacacatggtagacattcaactaatgcttggtgaatgaatgaaaaaggcgcaaggaggtgctcaaaggatgttaatttcatttctctcatccccatgcactttagagaactacaacagtcataaattatttttattttctttctttctttttttcttaagggatattattcaaacttgtgtataaggaaagattaattacttatgaggatggggactggagggagtagatcagctgtagatgttaagttactttatgaataaatacttgagacaaactgtgacaacatcatggggaggctagaattgtgtgagtacagagatgagaggctggatcacttgtttcttccctatcgtctttggttagcaaaaagcaggttcacttggcaaatatgcgtgctacagagggattgtgggagccacaggaggacctgtgagcacagtgcaccagcaacatccttgtctatgtagcttttgataataaggcaaaagccttcaattagaagctgctgttctgttgtgattcacagcttctgtttccattttactttaaagggtctgttccacatttgtctcttggctctgtctttgggatactggtgtagttttcattctttttaattgttactaggggttttaaaaatgtttatatccctcttattctgatataatttaccataataacttgcaattgcatagtgctttgccatttatattcaatgtacatgatttcatttgatcttca

SEQ ID NO: 131239 - DNA, 1042 bp, Homo sapiens
tatttgtcagggctggtgaaacacaaattttctaccctcatcagcgtgcagggagaaaatgacatttttaacaagctgccagacctgtagaaataaaaacagagaagggattttaaaatgtacaaaaggaagactaaataaataacacgatttttcattccccaagtaaattgggcttggtgtaagcataggaatgaactcattcttggaagaacccagcataaatcaagagttgggcatgtgtttgttaaagtggacattgttgtaatgaagggcttgcatcttatctttgttatcttcttgcttccatagcccctgtacactttaatgcaaattggtggacactgagcaccttacattcatttaacaactctttttttgagtagttacagtaggccggcccttaaggtagttgttgggtcaacagaaagtaggaccaaggtcctgtgtcccggaatccaggggaaggaaatgagaaaaatgggcaacttaatacagagtgagcaatagagagttagcacagggttcccaaactccagggatcagggaagccttcctctaggcagcaggagtggaagttaagaaaaagaaggaaagaggggcatgtagggaagaagtgctccctccacagccagcctcctgggactcagattgtcctaggtggggagctgacacccttagaacagacacactgcgctgcccacccctatcctggtcttctcgggctgctgtccatacttcctggctccattccacttaaccagtcccattggcttagagcctggcgaaaggtagttaatggtaagataatgacctcaggcttccccatcaccattgggcctgtgtgtgactcttctggacccatttatccatctgagttcactgttgctgctggctcttttattgttaatcccctcttttccccctgcaccccctccctgccactgtactcaggtagccctttatttagcattttcaaaaacgttttgttttgaaccagagaatttaggcccatgtgtcttggaattgcatttctctgaga

SEQ ID NO: 131240 - DNA, 1525 bp, Homo sapiens
ggaaaactgggactcatggccagccattcagccccacagtatcatgtgtgtttaatcaccggctttggtaacaaattagctattccagatgcttcttttggaaaatgatctatacttctgaagcagtagatggattttgggtatatgccataataatttgggacgcaaagaaaaggcaaaagaaacataacaatgccaggcctttgacatcttctgcattttacctcatatgtacaaaaactgttccaagaaaatttttggcctcatcctttctaatattcataaatgctttagttattaatttgtgcagggtttcattgtatcactttacataaacatctctaaagatgttctttaagaaatttcttctgcagacatttttattgggctcttgctttcatagcagatggcatttggagaacttgacgaatcataccattaactagagagagaaagctagcgtcgtataaaacaaagatgaaagaaaacttctctatatccttttagaaacttgtcatatgaattatccctgcaaacattgccagcagttcagacactttatgacctaggctttataaacccatgaggaatggggtgagtgttgaataatctgacataggttcaacaaatatttcctaaaagattactgtgggccaggcatagtacagggtctggggtcacagtggtgaataagaacaggaacactcccttctctcatgcagtatacattacatttggggagaaagaaggtaagccagtaaaacaaatacatgtgtgaattctgaccttggtaaatgccaggatggagatgaaacagggcaacagaaagagagtgccaggagcacaggttggtctgtgctggcctctctgagaaggggctatttgaatgcttataggcagcttgagagacatcctggagaagaattccaggcagagggcacagcaagtgcaagtgcaagagatagaagttagcattctctgtcaagaaattgagagccggactttgtagctgtagatggtgactgaggatggggcagtcagagatgtgggcagaggccagttctcatgggacccagtcggccaaggtgtagggcatgattattattctaagtgccaggaggagccactggagggtgttcagactgggggggtgacatttgaaagttgtctttggctgctctatagactatggactgcaggaagatacgattgaactcattctgtttaaaactagtaagaaccagagtatggtttctgttgctctgttcatgcacgcttgagctgaaggaggaatgggattaaggaggtataggaagaagggtgtgaggagactctggctgtcactgaattgcaaaatccatgaatgggcagctcctggagtactcttgcttcatggcgtcccagtgctcagagtgctacctgacatgtagggcctgctcaatactcctttgtccagtgagtaaatatcagggcatgaaggcatcctttgggccatctggtccacctctcctcaatccagtgctta

SEQ ID NO: 131241 - DNA, 1418 bp, Homo sapiens
ggcaccaattatactgcatattgctgtatattattttatccagcactgtgaaggccaacctgaactgcctgaaaaatctttgtcatttagtggtttagggtatgtgcaccctccatacaaatgcattaaataaattaaataatggtgtgtgtgtgtgtgtgtgtgtgtgtgtgtgtgtccagctaaattgcactgctttcttagatcatttaagcacacttaatctaatggaacatggtaggatttcagcagcttctgaatagaagttggagagaaaaaaaaaaatccgaaacgtggcaccaactaaaacccccatgtagttatttaaggcagcttaagcacttctgtggaaactgggctccgttgaagaaatagccactcctcttacagaatgaaacctcactttttttttttttgtctttttaaaaattcttccttgtatttttagattttgggtgagaatgggactctaaatctattttcaagctttcttttcctttctctgctcactcagaattattctttttatcttggttctgcccctggtgatatcttgggtaagttacttgacctctcctggctgctttttttcatctggatatttggactggatgatctttgtggtgccttccagctgttaacatttgtttgattttatgattccctcccttgttattacagaaagcacaagtgttgtgccttaagcataagataggaaagtatcccttgatcaagttgaaacatctccactttctaagttccaggactcttagtttgagcttagagagttacagttgtttccaggcagttttttgtgctaagggtggtttgggttttatttctgtttttctgtagaccttattggatatatgaccatttggtcttggtagataatattgtgtcctgacacacaccaatggtctacccttggggtgttttggaagcctgcaggcagggtcctgaggctgcctgagtcactgttaatgaaccaaactgcctgaaatgctccaatggttgacttttggcacttggcagaaaaatccttttcatgttagtttcaaggttgtcagatatcattatccccaagtattaaaaatttcaaagaaaggaggcagtgtgtttgatttatagaatagttatctagctttagctctgacttggctttggaaatggttttgcaagcactagaaaattaaatccattttttatggcactacaaggtattatctcacagcaaatgataattaaacacctgtgaaatcaattagccctttaagcagggaaaaaaagttttccaattatgttttcacacctccaaaacttttataattccaaaaccaacacttgtggagagggatatggtcgactggccgttgctgggttaactttccataaagattatccctaaattttgctta

SEQ ID NO: 131242 - DNA, 1201 bp, Homo sapiens
cacggaaataattgaatagtttggtcatctttagatgaagttttttcattttcctaattttttttttaaagtaaggagcaaagtcttaaaactacagaaacaacattttcatttgaaatcaatagtgcttcaaggttgggggacattgattctcgcaacaggggtagcaacatcacctcattgttttcttcctttgtctctcatagaaaaatgagtatttttctgaatcttacaaagtaattcatgatccaaaggactatttgatttgattttttggaactacatttattaaaagtactactcacctaacattaccttatttcaaggagatatatatgtgtgagtgtgtgtgtgtatgtaaatataaatatgagggaaaatgaatgtttatggctaaggaatttgaactccacccttccttttcaagtagaatccattaaaatgtagcttaatgaaataggattattttaaaatcaggaatagcatttatatgctagagattattgcgtttgacattaagatgtagatagtataaagtgataagttatattgagaatgaactttgttcctgctacatcatccttcaataaaagccagtattgccagaaaaagaaggaaatttactaagtgtgttttatttgaatttccagtcatagtttaggacaaggaggtagatactttggaggatttaaaaaacttctggtaattgacttcatcatgcacttgagaccagaacattcctgtgcatcctggactcagagagttgacctgtctgccagccccttagccagctctgagttgaagctgagcttacagtttgtccttccaatcctctgcgccaaacaaataaatcactatttatgggcaagattgagcttcaccacctattggaacttctgttccagtattagagattggcacattggttttctttcattaaattcttcctcatggtggatatggaggcaggcttgggcaggctcactggggttcacagagcaaactggaggacatgggtctggagagaagcctcatccgccaaagtggggcagacactgggtgggggcctgtgggcgctggcgggaagtccagcccgccaggcagaacacacacagcagggaacatagagttgtgcaaaaagtgagatttttggcaggcacttggctccggggaggtcctgggggccccaggccaggttagt

SEQ ID NO: 131243 - DNA, 1924 bp, Homo sapiens
tgaaggcagtaggaaaacctgtcatgaacttcagaaatctaacaattttaagaacactccatcccattatatacaaactactgcaaactccataaataatttaaaggaacaagttcataaacctggtgaatttagaaaattggtcattcagcacgctgtctttggtgaattgaccatttgttgatttggtagcttggcatgttgcttgaagcaaatgaatctagaactggtaagcagagttctacacacatgttgtaacttaaaatgctctttggatgaatggccgaatacatgcctgggaccaaacttgcttgtagaatggtatttattgtttaggttatagaggttgtcaaaaattcccacatggtaagggaatttcattcatgattatgcatagagaattattgctcctggggttcaaaggctaactcattattttcaggcttactgaaggtccaggcttactcattatttccccctaatgttttatttataaattaacataaatgtttaaacatgtagaaaagttgaaagactcatccaaagcacaccttatatggtgtatggattttgaatcataagtggtaggctgtttccaaagtggctgaaataataccaactcaaatctgttttaggaccacatctttttaggagtgaccagagactgatctgaactatttctagttctcttttgtgttttggggggaaaatgcataaaatactccttaactctagattgtgcatgttcttgtagttgcttggtcactcttttgaaacaaaggccagtgatgcccattgcaattgctaaggtatgtctttcctgtattctaatttcatctaattgatgcataacaaaaattcaagaggttagtgtcaccataacctgtctccttcctcctgcctgtataaagtaccatgtggatctcaggaagaatttactagctacaaaataaaatatagaatgtagtcttccacattatagagttcctttttttttttcatgtggaaaggaatgattgagggggaaaatgaattgtttgacatctaaccatagaaagaaaaattagttttctctaacttctccaggctctgtttttgtttcactttacgttctgtgtgctactggtctggggagaaattatgacatgaaagggagtagtttcccttcagaagattcactcacaatttaatagtaatcacatgtctgggaaaatggaagggttagaaatattttccacatcttttttggtagtcacctgcattctgataaatgctacaacctattcatcactgagtgttttgtttgctgttgctgcctgtaggatgatatattcttgagctgttgacatctagctgtattatctgctttggccaatgaaatgagagctcaagtcacctgtgccacctaggaggaaaagctttaagcgccattttatggcttcaccattctcatgtttccttctgccatgaaaacagtaacgtctcagaggccaggtgctctacagcgtgggtctcaccatgaagaagtggagcatagcccacagccaaccctcaatggatgtgttgttgaaagccattgaagtgatggggtcatttgttactgcaacacagcccactggcatgacatcctcatcatactgttgtgcctgtttatagttctcaggttctagaatggaatcactggaagattctaaacctggacttgtggtgatgatgagaataagaaagggcattgaggtagttgcatttacagcactggatattcttatctgcagagattggttgttctagaaatctttctccttctttaatgctcctcacttcagccctttgagagattttaagctgaatcacaaacaacttggccaaccttatgccaggtcatctaatttctacaacatggtttgtgtgtttaatgataaaa

SEQ ID NO: 131244 - DNA, 1034 bp, Homo sapiens
actactcaggaggctgaggtgggagaattgcttgaacccaggaagcggagctgcagtgagctgagatcatgccactgcactccagtctgggcgacagagtgagaacctgtctaaataaataaattaaattaaacaacaataaaattctagctcacttggttttgtctggttacaggttccttaacaggtgttaaatggcagaaaattcccaatagattgatcagcacttgactttttcgtagtatttcccaccagaataacgtctgtagaagctactctatccaggatagtcctgggggatctctggcagaatataaatatttctgctgtgtgcagcagcagctgtagcttaggaggagcaatgggcgtgggttttgtggtttccttctgacttttcagggtagctcatcacttcgaccacaaaatcactgccaaccttcagaagagggaagaaggattggccaacctacattttcttttctttttagggacaaacagtgacttgagtttttgcagaccagccggcttagttgtgtttggagtttcccaatatagtctttgcagaaatgtgagttggtttttacgttgccgcaaaccaatcatctgcattacaattggccttagtcctggaaccacagaggtggtttgctttaccccttgactcaagttgcctaatttctgtgtcactaggaagaaccaacacctctcaccagcccatgagttgtgagacagtaagcactgaaatgagtgatgaatgcggggtagccatttgttaaaaaccaggagtcatttattcattcattcaactggtatttatgtagccctcctaaatgagtcaggcattgctccaggagctgtggatactgtaataaactagatccctagtcccaaatattcttttttttgaagttccagatagtaaatatgttaggctttgtaggcctcaccatttctattgcaaccattaaacggtgacattttttctttttctgtagtagcagccacagaaatacataaaacaagttcaagctgcg

SEQ ID NO: 131245 - DNA, 1347 bp, Homo sapiens
gcagactttttgcttttactatgttcttaaaaattagtggtctgagaagaggcattatatttatttatttattattaattattattattattattatttttgagatggagtttcatcttgttgcccaggctggagtgcaatggcgtgatctcagcttaccgcaacctccaccacctgggttcaagcaattatcctgcctcagcctcccgagtagctgggattacaggcatgcaccaccacacccggctaattttgtatttttagtagaggcagggtttctccatgttggtcaggcaggtctcaaactcccgagctcaggtgatacgcccgcctcagactcccaaagtgctgggattacaggcgtgagtcaccgtgccaggcccgagaagaggcattatatttaaatataatagtcttattgtattttatcagtttcttgataataatcctttaaattatggatatttgatcaaaaagagaggtcagataagcaatgagaaagagagaaactaatgaatagaaagagtaagaaagggggctgggcatgttggctcacacctgtaatcccagcactttgggagaccaagctgggcagatcacgaggtcaagagatcgagaccatcctggccaacatggtgaaaccctgtctctactaaaaatacaaaaattatctgggcgtggtggcacgcacctgtagtcccagctactcaggaggccgaggcaggaggatcgcttgaacctgggaggcggaggttgcagtgaaatgagatcgtgccactgcactccagcctggcgacaaagtgagactgtgtctcaaggcaaaagaaaaaagggttgaagatgttcctggaaacatgttttgcttgatgcaaactccttacaaaatatttttggaaaatttctcctgccttagtcaaggagaaggaaatatctcagagtcacgtaaatactattctgaaagacctacctaaaaaaataattggccaatagatatcttagaaaattaaggtatggtctagaacataaacataacaatatttgttatatattacaaataaaagacaaaggtgatcccattttatgacaagaaagctttcttggttgaactgttaaacagaggctatatcgtcaatggcatgcctactatgatttatttcattcctgttatatagatgcatattaaggtacagaaagatcagttatcctgccaaaagtcacctagctgggaactcataaaactgggattcaaactctggccatctgacttcagattctaagctttttttctttttttaaatcttaagcttttaacctctgtcctatattatttgggttttccagctagga

SEQ ID NO: 131246 - DNA, 1034 bp, Homo sapiens
gtcccctaggatatgaaatcacatgagaaataactctagctttttaaggaaaatatggtctagtgcttatagattaaaaaaatgctaacaccgttacaggctatagagcagagagtccctgagctaaatttgttgaatgtgttttaactcacggtgtatattttaaaaacttgaattagttacggtgtggattagggtgataaatagctaggagtgacagaaaactcaaggaaatagtggctcaaacaaaatagaagtgtatttttcactcacctgaatttaggtagctcaggcctggtaacgaggctccgtgatcatcagggacccaggctccttctgctttgttgctccaccattttaaacacatatcttacatgctggagtccaagatagctgccccagctccagctatcacaactgcattccatctcatagcaaaggaatggagaagggcctctcccttggaaataacactttctataccctcttacgtggctgcaggagctcctggtgaaccaccatcagggcttggaatgtgcttggttgaccgtaggaatatcatcagattaggtttttgcatcagcgagaaagattgagtacattaatagcagaaagagcacaggcatgggcaggctgaggtttgaagataggcagcattacttactataatagttaagggagcagaaggtaagtgctaaatgacaacatgtattagcagaattcagacaaaggatgatagcaggggctggagatgatatggaaggcaaatggggaggaggtggaactcgaacagatcttgaataagcagagaaatagggaatcccaagagagtccaccgtaaagagaaacatcagcttctggcttccttagatgccatgttttaagggcatttagctaaaatctgagatcagaaaatggtgaggttcctgggtgtccagcaagcattcagctttctctaggccatttatagaacacttaactaacccatgttgtcctttctaggatatatatatatatagtggtgtgactctatg

SEQ ID NO: 131247 - DNA, 1051 bp, Homo sapiens
cagagcaagcctccgtctcaaaaaaaaaaaaaaaaaaagcaagaaaaaagaaaacctttcttgccctcactcctgcttaggatgctgcctttaaccttggtccttagagtgggtaaagctcttctgaatattttttatgtgaggagggataaaaaggttcaataaacgcaatgacaagtggtgctgcccctgcatacaactgtgttcagtgacttcttttgagttcataggaaaagcatatttacatatattgaatccagggccatgattttgatcacacccactctgtcttcctgacttagagcatttttttttcactcaagggcattctcaacaaaggagtatagctttcagatttgtaaactgccaccttattatcctattagtcaattacagctgctcaagagcagggtaagtgacagtatggcagattacagcaatttatttgccattctcatagtcttgtttggcatatcatcaggctgtttaaatttaatgataggagttttacatgtgttttagagcagttaaagttgtaatcaaaatgtttaggaaaacccctactgacctgcataaatgctcccttcttcaacgttgcttgtaaagcctcattgtaatcttgattagtaaaactgactccaattaggaaaaggaacttattttccaaagaaagaaaggccttttggtgttcttgtgtacaaagctcaggaaagatggggctgatggaaattattttccttgagttggcccttgtgggcaaatcagttgcatttaaataagtcaccataaatcccctgagaaacttggtagagtctgtgggaacagaagggcctgcaggcctggtcacaggatgggggtgtatagcatggcactgggagtagtttggaggaaggaggaaggagagctgtgggtaaaagaggagaaaataattgccctccattatgtctggttctctttcaagctaacggtgatagttattgtagtagcggctgcactgaaacgaaaaacatctctaaaaagaaaagttgagtgcttttatagaatctttaga

SEQ ID NO: 131248 - DNA, 1023 bp, Homo sapiens
gcggcagaaggattgcttgaactcagttgttcaagaccagcctggacaatatagcgagacctcatctcaacaacaacaaaaaaagtaaaagaaaagagaaaagaaaagaaaagaaagaaaaaccaaaaccagagagtgattagagtagtaaaaacagattttagtcaggaactattgcagtaggggcccaattctgaacatacttgaacaagtggggatatgtagccaaaaggcagggttaggggtcagtgggtagatagcccctaaaagggagcatcagaagtaaggaagattcttgctaaacagacctaacaggagtcgtgctgaaggcaggccagggtgatcagatctcacctggggaatggtgagagatgatgaatttggtgagataaccagcgtggggattctttctcaagtgatgtaacaagatttttgctaaaactaggtgataacgggtctggcaaggatggacttgtaagatcgagaccttgaggacttagaggaacctgatttcatttaatcaaggagggagtcttgttactggtcactgtctcatctcagtgactcagaagtacagcaacagtggcaagcgtttcacttgctcaaagcgtggttagtccaggctgcagcgaaaggcggaaggcaccagggattgggacaagctcaagtgttcagcatcacgggggtttagcagcctgcttgagtgcaaatatcttgaattgatgttactgtgccctatggaggtcagcctggatccttcttgcctcactgcccaaattccattttcacccagcaatcctcagaggtttccaaaggccttttgtttcttcgtgccattctccctgtaagctttccatatggccttggcatggaacaggtttatccaaccctgtggtattaacagtgtggcttttgttgttcttggagacctttgcttctgtccaaatggcttttctgtgcctcatctgttgatagattggaaaatgctcatgtttttcttttacttgattgtacttagaatat

SEQ ID NO: 131249 - DNA, 1017 bp, Homo sapiens
accagctggcttcctccttttgctccatatacactccctcctcccttatcttcattgttttttgctttcttttttggctgatttttaactccttctctgaatctgaaagagagagttgtatgtatatgatgatttgtgttaaagatgcttagaaattaatatactaaaggaagctcgtaataaaatacaaaagatgatgatttgcattgtaaagtaatctggatttttttggtgcaagttgtctttaaatagaaactcttcttgatttgtgcatgcatgtgcacacatgcacacacatccatagacaggcataagcatgtgtgcctgaatgtgagttttcaagtttaaacccttagaatatgtgttttctgtgtaggtagaaatgaaatcccacaaatgttatcaattcttgtgaggttccaggtaaaatatacatgcatgaccttctctacgttttacaacattactgctttccccaagtgcccgtttatctgtatttcagaaacccatgtgatctgtaaatcaggtaggccaatgtggaatgatatatctgtgtgctgggatctgcatgtgggctgctggaagtttgagtttgcaggtaatgagcgttactttggatgcgaacggaggcactaggcagggagcaaaaaggagggtaacttactccagcaaaggaggacatgattagtgtttccagcatgaaacctttgaagtgggtcagcaggaaaggaagaaaaagcaaaaacatccagacatgggagaatcagaacatttcttgttgcctaggttattctggtagactttgaaatgccagtccctattagtttggtgggtaaacattctcattattttctgtaattggcattattattggaaggtaattaacgacagtaacattttcgtataacactcagacctggatgggtcttaatgacttcccttcagtcttgcgtgaagttgttttctgtttgatttttgagtgcttgaaactacttagggttctggctgtgagtggac

SEQ ID NO: 131250 - DNA, 1009 bp, Homo sapiens
gagaattgcttgaacccaggaggcagaggttgaagtgaaccgagatcgggccgttggactccagcctggtcgacagagcgagactctgtctcaaaaaaaaaaaaaaaaaaaaagagaaaagaagcccggcaatgggctacaaagacactcttggaaagtgctgaatctgagattgaaaacaaggcctgctttagatccagagctcaagtccttagccaatatgacctttcagattgctacaagtgttcattgaaataaagcaggaacagtgcctagcacagattccagcacacaggagacctgcagtaaagataaacccactttggcacttccactcgtgggggagagcagtcagcccttagcttgtcccttaacagtaagactgccacaccatctgatgcatgactaccagctccttttgaatctactcggaaggacaatgtgcacgctctgtgccctgctggatatggtttaattttctcatttctacaagctctaggttacaggggataaagccacatgcagctagtatggacagaacaactagttctggttgaattattcagttcttaactggctgcagctttgggatcttagaaacacagtccttaaccttgcattctttccacttgaaaaataaaatgtaggtgcccagcagggaaattccatggacagaatagctgtcaagtaggggcacttcttagagcagggaggaagctgagcaagtgggggtgaagggaaacatggaggcagaggctggggggctgggaccctgggtggcaagaagctgagcacagatcatcattctcccttagggctagaacctgtgaacctgaacccttcattgaggggcactgaatttagaaggcagctcttctgtttgtcgcttgttctttctctcaatgtaattaagaagactttgaagaaggaatattgtgctaaagcctagataagaacctgttctccatccacctccccaaatccctaaagccttgtttgattttaatat

SEQ ID NO: 131251 - DNA, 1760 bp, Homo sapiens
cgttcttagtcatgaattggaatgaactcaggaagcattcatgcccaggtgttctctggcagacaataatcatataataagattgttttgaacttgctgttaaaaacaatgtgaggagcttcctcatgagttttctatatgaaaagcaggtggtgtgtataaaatcccatgcctttggggagaaacagtaccgacgttgccttagcaaacatcattgctcttcttcgctgggtgcttccagaccatcagtcagctcaggcgtcatttctggtcatctttcctgacctctaggcaggacttttctgctctgggctcccacagaacacttctctttaagtacccaccacattgtgtggaagcgaactgttttctcattggatttcccaccatgacacatgcccctggaaggcagggacctccgtgtagtcacctcggcaaatccgtctcttagaccaacacctggcatgtgatgggagctcagtccattttgctgtagttgaacggagaacttcaccagctcatcagggggctcttttgctcatgtaactacagtttgagtttagatccactcttatgagcacacggtaagatattttgatgcccagtggcaaacagtgctcaagttgccacatatggtcatttttctcagacatgtactttcctgactccccagccctgaaaggtagcatcatctaaaacaccaacaactgataagctttattttatattggttgcatttatcttgctactccttgaaacacaggccttgagggcctttgagatgtaatcttcagtttcccccacccctctagttggattaatagatttatgtagctgttgaacacaagctgcctccgaatgcttgtgttttaactcagtaggaacccagctgatcgttccgaaagcagcttttaagagaagctgatgtcctgtgaacacgttagcaagctgtcattgtgactttgtcagcaggcttatctcagagcatctgcagactcattttgagattgcctaattatttatacacgagatttctctcctttctggtgatgggctgagatgaagctggttcttaagtacggggaagatatattatgaatgctttgtcattaaaataggtcacttttctgttttcctcctatagctagtattaggaaattatatttctcccaacttctagagttgtaaaactgtatttttaaaaactcacctttccagtgtttgcaaaatgtgagcacaacatatactactgccagtctaaaatgtgtgtgcatttagacagataatgtaaatttaatcctagtaagtgcttattctgaagaccatcttctctctagcgtaaatgtgtgcttatcagtatagaataaatgtattcaaagaataggagagtaaatggccctttattcaaattgctttcatttatttttttcttttggaagtagtgaaagctttattatcaatcacttcatttttcaccagcttcagatttagagggtaaaaaaaggaagcatttgggggtcagtgttttgaatcaaaacaaatcaggaattgataaaaccgtagtttcctgactatttactgacctgattggagtcatattcttagcttggaagagctgtgttcattcatttttttttttttcctgccgtctgggtttagtaggtaatgtggaaaccatctaccataaatacattgctgcaagataacaaatagaattggaatctatgcttgcatttccctgagtttctgtttttttttcc

SEQ ID NO: 131252 - DNA, 1509 bp, Homo sapiens
cttcacacttttttttttccaatttctctgtccttctttctctctctctcctacttccctctccccaaccttctccccaccaccccactttttccagctaaagcattctcttggacttcttgataatataatttagtcccaagaattttcatgaagccacctggtgttggggggcaggtagtaccctgaggtgtacccctcttctgggaatcacttgagttataagagggtaaatgtaagagtgacatgaatcatgagtgtcaatttaattctatattaagtcacatcctagcatttatcatatataactacaaagtaccggctcctatgatattttaaagaacatacccatttcaatcttcacaaatattctcattttacacataaagcaataggtatgtttatgccttaaagtgacttacctaaagtaatatacaatctagtaaatggtagacttccttatactcatccatttttccttaaaatacaccatagctgcctgcgtttaccttcattctttgttaaacataagtttgcatgcttaaaaataaaactaaactaagaaggacataggcacatcaggtttgttataggaactgctttttatttccctttcttttttagaaaaagaaattggattccagataattgtagtcctggaaataggacaaagtttcatatttgagaagttattctcacgtttccagttatccttaagagctggtctttgcagccatgtttagtatcactgttagcttgaagctgttgcaactgattttcttagcagaaccagaagttcctgaagataagacacattctttatgttctagttaattaaagaacaaattttaagaacttcaggtcagttactgtctcttgagtaacgcgtgttcctaagaaatactttacaaattctctgagaattggcacaaatgaagttcaagagaagtgcatctaagaatttgactgttcccagcttctgccattagaacatcctttatagttcggattttttggctgaaggcctgattcattatttttagttatttctcatgttttttcaaacccagtaacactaacatgttggtattgagcctgtccgtacattcctgattagaggcgccatttaatttgatattttgataaagactgtctgtggcaagttgttgtaggactaatttctctgggcaagcaagactgaagaaaaaggaggaaaatgggagtttaatcattggagactgaaaataatttttaatactgtctgactcctttctggaatgccatattaattcatgtttagttgaatccatgataaatctttaaatgtacgtgtgttttattttaagagttgattctaactcaggggtgatctgccactttgggaaacttatacaatgttctaatacattaacaataaacatagagtttttaagtggaaaatgagagtattttcttttctcccttcatttacctgggtgttttggctcaccaaagagttgtgttctgcaa

SEQ ID NO: 131253 - DNA, 1026 bp, Homo sapiens
gttagaagaattctaagggttcctaaattgaatgggaaataaatctattactttagtctgtcacaggcatcagtcttattatcattattgctattcctggtttgtatattctccttacatgaaactagttgggtagagacttaacataagctagtatttagatgggttccgaacttgtgttccaagaattaaatcaatcaaaattaaatttgagcatttgccttgtgagagatgctgtgaaagtaacacatgttcaaagttaaagtgttaagtgaaataagaccttgaatggtgaggaatggtcaaacaactgctgtaagaaatacgagggatagaataccaagccaagagtcatgcaaatcagggatactaaagaatgaggaagcagagttggttttatgtaagcaaaagcaaatagcaggaagtgtagcctttttaaagaaatctcagtaccacagcctgttgggagagattatttgtgattgggagaaatgggagccatcagcaagcggaggggcttggaagtgatggatttttttcatggtctttttcttctgactccgttcgagattataggtccctagaaggtaaaaatctggtctttcattccacaaagtgttttttgttttgtttttttgagacggagtctcgctcttctcccaggttggactgcagtggcgcgatctcggctcactgcaagctccgcctcccgggttcacgccattgtcctgcctcagcctcccgagtagctgggactgcaggcgcccgccaccacgcccggctaattttttgtgtttttagtacagacgggctttcaccgtgttagccaggatgatctcgatctcctgacctcgtgatccacccgcctcggcctcccaaagtgctgggattacaggcgtgagccaccacgcctggcctgttttggtttttttgagacagtctcgctctgtcaccaggctggagtgcagtggtacgatttcaggtcactgcaacctccgcctcccccttctacaaagttttatcaag

SEQ ID NO: 131254 - DNA, 2951 bp, Homo sapiens
tttagttcttatgcaccaattacctggaacctagctcatggtttccagcatagcctccctactgttatgagaaataattcataaattgtgggaagaaatttttcttcagattgctcttgactttgggacattatatgtatatgctttctggtggtcatgttgtaaaattgtagatgattcactattaggggatcaggatccactctagccagaataaactcatcacactttgtcgctcctccttggcctctgccacccagtgctctgagactgttgatgtgatccaggaagctgaatgaacactggcccccaagttaggaagcctgcatcccagactcagcttgatctcttgtaagcccatggttttctctccaacaaagaagaccactgaaattaattattttcaagatctcttctagttctgaagggagataattagtttttaaatactaaattggtacctacccattgtaataaataaataaaggaataagaaaagggataaagtaaaaagtgaaagttctcctacctgccccttaggtcctaaaatagaaaattgtaaagggtaaatctcagggcttgaaaattgttgaggcaatctctaatgatggcaagatctagctctgttaggacttctaagcagtattctttagtatactctgctataggacagaaccatttgcaaggaaaggatgttaatttgggtctctctctccctcttgcaatatggtgccatttttgatctcagagccatcgtgcctcatttctaacaccttgtcttcaatagtctttttttcttcttcttcttcaggtgcctaaaaattagctctcttatcctctctctctcttctactcttcttccttttcctctttttcttcttttctccctctttttgtgcatttctgcagggatatcctaaaaataactaaacatagctcccgtgagaaagaagattcatattgcagattgtgtcagtgttttttaaaaataaaataattctgttggtgtaatcaacaaatatttactgagtgcttgctctgcagaaggcatcaagctaagtactagaataaagtgtcatgatgtgatattgaaacaatatttgcagcaggccagctcagttcaaagtgaaagatgagggagaattctgggtatcctcgaacctggcactttttgctgagctcagaagacccaggtgttgaagagactgctttttacaagctcgcagaataagtgtttgagaaatgtgaaatttaggtccaccgttggccttctttctgaggccagtctcaaagggttccccatttgcccttagctcttgacttgccttctcttggtgagcagggcagctctctgagcttgagtgggctgtgatgttggttgctgacttttgtcccttttgtaggcttcattgatgggatttagactcagttgctcattggatagggaatcggaactggccattcagaatgagggagtttcatctcttgggttattgcggttggagtaatcacttatcagagcctctgcttttttgtgatggttagagtaacatgcttcctgccaccctacagcataccaggagacaggaggccttttcttgtgccaaggtttatttggagcttatctgtatttatgatcttttcctgccattggcttaattacacaactggggaaatttaattatcaaagaacttaataacactaaagaacttgccgtgtgccaggcactgggctaaacacccactggcacctgaggcaagtgctgttagtccatttacagctgaggatgctgaaggttggagagcacgtgttattgtcagggtcactttgccagtgagtcttgcagtcagaaatcagccttggacagctcgactctagagttcacgcccttcaccttgatccttctggcatcatccatctctgcagcctgacatctaacagatttaggcctcattggcctgtctgtggttacattgcatgtaccagtggcacccagcagcaaagctatttctgagacacatacagagcattagttgactatattgtttctccagttcaggatcatgcggatcctgccatgattatgtggaaagagtttgcaaagtagagtcaaagcatttggtcctgttgctaggcttttctaagcttccgtcaactcatatgtgaaatgaggacaatgacacttggtgcttaaattgtataacatatgaagcagagacaggctcacatataattgattctctgttcatttaatttcctttcccttttcccagttgactcttcttcctccctcctcctatttcatgattttctctctggctgtcgcagtaattcagtgtatctgttcccaggctgtagttccaagtagcaagaataaagcaaaactagatgtgttttcggcagtctcaagctctcacaggaagtttttgttgtgtctgtaagctgtggttggatcccacaccgggtggaccatctttcctggagtggtggagaggaaggagtgcctagccaggagacagatatgtcagtatctgtaaggtgacctactagtggaaaacactcttgctcttatttgccttcctcctggcagcccggtttcttcatcatcagcagccccctttgacctcctatgcccttactcgtgtggtttaactggagcttgtgaaaatgatgactagtctattgtgcatctggctgaggcatttaatccactgtggagacacccttattagaggaaatggaatgcaagttatgcttatcatggggatagtgtattagggcccatcctggacagcttgtaaaagaattaatgctggtgcggtggcttatgcctgtaatcccaacgctttgggaggccggcacgggtggaccacttgaagtcaggagttcaaggccagtttggccaacacggtgaaaccccgtctctactaaaaatacaaaaattagctgg

SEQ ID NO: 131255 - DNA, 1023 bp, Homo sapiens
cattcagccaaaacagaatatttcagactttatcacaaagagtgacttttgttttgttttgttttgttttgttttgttttgttttgtttgagacagagtctcgctctgtcacccacgctggaatgcagtggcatgatcttggctcactgtaacctccgcctcttgggtttaagagagtctcgtgcctcagcctcctgagtagctgggaccacaggcatgcgccaccatgcccggctaactttctgtatttttagcagagacagggttttgccatgttggttaggctggtctcgaactcctcacctcaggtgatctgtctgccttggtctcccaaagtgctgggattacaggcataagccaccgtgcctgacctcaaatagtgatttgatatattgtttgttatttggttgttgaaataaatattttgatttttttataagaatgaaaaatttgaaataacttaaatttctatcagtaggagattgattaaaagcattgtggtacatccatttggtagaatattaggcaggattttagaagaatgagggagatctaaatgaatgcctattcaggtatatatatatatatatatggttatatctattaagcaaaaaacaaaaatttgaacattctatgcagaattattccactcaaacaatatcagcagaagaagactgatcaacttgtaataattagtcagcataataaaaccatattgaaatagtttcttagtggaatatcaggggaacccgcccccaatatttcaatgtagattctttctatcttccaaaagtgttggccggctgagaaataaagagaaagagtacaaagagaggaattttacagctgggctgctgggggtgacatcacatattggtaggaccgtgatgcccacctgagcctcaaaccagcaagtttttcattaagggtttcaaaaggggagagggtgtaagaacagggagtaggtacaaagatcacatgcttcaaagggcaaaaagcagaactactaataaggatctaata

SEQ ID NO: 131256 - DNA, 1037 bp, Homo sapiens
ttttacgaaagcatattatcaatgaaaatattaaaggagcagacgtgttaggatgtgttaggatgaaggttttttatttttattttttgagatggcgtctcactctgtcgtccaggctggagtgcagtggcacaatctcagctcactgcaacctccacctcctgggttcaagtgattctcttgcctcagcctcccaagtagctgggattacaggcacgcaccactacgcctggctatttttggtagagacgggattaagccatgtccgccaagctagtctctaacttctgacctcaaatgatccgcccgcctcggcctcccagagtgccaagattacaggtgtgagccacagcgcccagccaggatgaaggttttttaaaaagtctgtagttgtaagaagctatttatgaaaagatctttacattgtggtagcttatgaaaatcctttttctcatctcctttaattttctttctatcagtattattactgatattacaattttggtaagatctagagagaaaaattgattgtgataggctgtcttcaattacctatatgtttcttcttatctattaccttctgaagtagctttttcttaaacggtattgttaaactttattttttattttattattattactttttgagacagagtctcactctatcccccaggctggagtgcagtggtgctatcttggcttaaggcaacctctgccttctggattcaagtgattctcgtgcctcagtctcccgagtagctgggattacaggccaccacacccagctaatttttctatttttagtagagacggggtttcaccatgttggccagactagtctcaaactcctcacctcaagtgatcctcctgccttggtgtcccaaagtgctgggattacaggtgtgagtcactgcacccatccttaaacagtattgttaaactttaaactgaaatctgaactctctgttaaactgccttttccaactttaattcccagtcattttttaatgccttctattattctttctcattacgta

SEQ ID NO: 131257 - DNA, 1785 bp, Homo sapiens
ctcggcctcccaaagtgctgggattacaggcacaagccaccgtgcctggcagttttaaattttgggctaaatgacttttgctaaatcactttcctcttgcatcctcctgcttcttatatctataaaatgaactgcccatggacaattgctcaggatccaggcagtactagcattagaaagggttgcctctttagcccatgattagtccagtgtgggctctttgcagaaagcaatggaaactggttaactcaaccagaaaaagaagttattaaggaatattggacggtacgcagtatagacataatggttaggactgggctggagctgctgcctgagccctgtccagacagccgagatacactggatgttgggcagtgctttggctggacattgaaatgctgcatctgattggctaatttagtttccatttatatccctaacaaggcaagggaagagagaagccagcttctctcttgttctccttctataatgagagacaaaccatgcctctctcagacactcacaatggagaattcctcaatcctaagaaaggtggatcggttactgactgtgacagatgactgtcataactttcatgttcacggaaacttctttataaagtttctaaatgaaacgaaaacttggctaccaacctactctagtaacgcaacaacttgcccctctgttcttttgagttctggcttctgattgtttctcaccacattgtcaactccttgggaaagtactctgtatgttttaaagcaaattgccagggtttttgtttgtttgtttgtttgtttacttagacctcgggagataaaattaatcgacctctttaaatacatggaggtaccccctttctcgtttttgaagggagacacttgggaatttagaaattgggagtgtgagttctaagggctggtgtggtttagatagcccatgacagtttcaggaaggtcctggtttcctttcaagcaaaaggggccacctctgaaccaaagtggattatctcctgcagcagcaaatccagttggcagttgaattcctgcagttttatgggaatttcagtgaaacttttaaagctgtaatttttgtaactggagttaaaaaaaaaaaaagaaaacaaatctgaataaagcgacataatccattgcagagtctgtacagttctatttcttctatcatgaatgttttccaggcagatgaaaaaatgttttgaatgttgaatatatgcaaacattacaatcaaggataattgtgtctatgtgctttgactctcattttgcttttctcttccttcatcttctcctataccctataggaatgtgatcatagacatagaaatagaatttgcatttgtataaataatgcccaagctgtttggaaaaaagactccctgtattaggcacaagatttagagatggcattttctgcctcaaatctcagtttgatttagatcatggaaataatgccttttatctgtatggacatcagagtttactcagcccctttccctctgcccccttcatttgatctgcactctctaacctcatgaagttgtctgaactagtgttattattctcattttgccaatgagtgaatgagactcagaagaaagcatctaggttagagatttctaggcaatgtttctaatgtttccttcagtaaaattgttgttgctctatcaagtatatgagctggttgctgttttctgtctttgatgagtgacaggattcccttttatgtgtctcactgggtctgtctcctagaggcctcatgagactt

SEQ ID NO: 131258 - DNA, 1609 bp, Homo sapiens
gaccttttgttcaaaaattgttcaggatttcaagacacagcagagcattaaacgaagcatggcacccttctgagaagacagggctctagtgtcaccgtatgggtcacaggcaaacaaagtcagccctacctgtaaatggatctgattaaaggcagaagtatctttctattttgtaagcagattgagtggtatgttactgtctcacaatgtgttattatttttgctgttatgactaagattattattttaagtgacagtacccctgtgcccatcttctcttttgagagtctgaatcccttcagataaggactacagcttacctaatttgtgattttcccctcagctagactactgacatgatgtgtttgttaaatgcagtgaatgtaatagtcatttatcacaaggagaaattgtgattttttttttttcccccagaggaatctagcttaaagaagccaaaatagtacttaataaggtgtttgtgggaacagagatggaccattggatgaaatgctctgaaataaaactaggcctatgcagtgtaaaaagactaagacagtgagtttctgccttttttctttttttttccaaaaaacctttttgatgtaacacaagtcagtatttttgttgctagttggcacttcatgaaagatgatagccggctggggagagccaagaaaaatcagtgagtggaattgacagacttgcagtgtttgtaactctgcctttatcctgtgtgatattttaaataaatggttttcttatgtaggggacagttattactgtgcctatcccacacagcagagaacccaaaagaggacgacacactgaaggagtcataaattgcacatgtaaacagctggacatttgggtgttggtgaaacctctgagatgagacggatgaaatatgttgagacattcaaggcttttgttgctagtttttttgtagaatttttagcagacctttaaaccaagagacactggcagtgcagttattttcaataacctggactctccaggaaaatttagaaatccatccaaatagaaggtaaataaacatgtttataggcaaagccttttatataagcgtttttgttgggtctgaatctttgatgctgacagagttgaactgtctgccttcttgcttttccttatcctgtttgtcatccgctatgtggcttcggcttcagtgacccctctctccttccagtttcctagaagcaaattgcccttacgagcgaatgcatttgggtcatttgaatttgctcagtcattttggcaattaatgactttttgtggattcagttcttgggcacctccgctgcatcccacttctagccatgactccctgcattagtgattcagcctgaaagaaaaaatggcttttttaaaaagtgggagaaatttatctgaagagcaatcagttagatggacatggaagaggccctctctggggttttacctggtctgtcttaaaaggaactcactcgagttttaatccctaggattataggctgtaaagcaatggtcagcttagatccatttcagggccaatacatctgtctaaaatattttgaatacaagaggagaggaaggatagagaagcaaa

SEQ ID NO: 131259 - DNA, 1049 bp, Homo sapiens
gcctcccaggttcaagcaagtctgcctcagcctcccaagtagctgggattacaggcatctgccaccatgcccagctaatttttgtgtttttagtagagatggggtttcactgtgttggccagggtggtctcaaactccttacctcaggtgatacgcctgccttggcctcccaaagtgctgcgattacaggtgtgaggcaccacgcctggctgctcttacacttttctatgagacacattacagatagatgcccatattgagatacatacccatatacggatagatatccatgctgagagaagcatgttaatccggctgtgaaagctttatagttaggaatttctgggaagatcttcacctttggcatactccttcagtctcatcccctatgtccctaatagaagcagtaatggggaatctgtcatgatgacttactagaaaaatctattgagcctgcttatgattctttggttttggaggaggagggcactaattttcattggttcattcattcaaaaatattaagttcctactccatgtctaataactgcctttctggctagtctgtgagcatggcaacggacggatgatgtcttttgttttctgttgtgtctctgatgtctttcacattgaagagcagggaggaagtgctcgtatcatatttgtgccagagtgaggaggaagagggaagcactcagagctgacacttcctgtgatttagccttctgcctgtggatcatcttttcatcttttttgagctcatgttagtttctctactacctgtgcgtttctttaccttccttggagtatttcttccttgagctcagtgttgcaggcactgcttggtcaggcttagcccatagacagaaaatacttattgagtacttactgtatatatagcactcttccatgcactgtacatgtatgaactcacttgctctttccagcaacttaggagatgtgtgtcttcattatcaccccaattgaagaaactaaggatgagaaaggattcagacttaatgcaaatgatccactatctgggaagctat

SEQ ID NO: 131260 - DNA, 1021 bp, Homo sapiens
ggtggattattcatgagttttccaggaaatgggtgggcaattcctggaactgaggattcttcccctttttaggccatataagataacgtcttggcattgccatggcatctgtaaactgtcatggcattggtggaagtgtcttttagcatgctaatgcaatacaattagcatataattgagcagtgaggatgactagaggtcacctttgttgccatcttggttttggtgggatttggctggcatctttaccgcatgctgttttatcagcaaggtctttgtgacatgtatcctgctgatctcctatctcgccctatgactaaacacaactaaccttccgggaatgcagcctcctagtaggtctctgccttattttacccagcccctactcaagatggagtcactgtggttcaaacacctctgacaaatctgtctgcctgttggaaaggactttgtcaacttgtcatgttacttatataaatatagaaatatgtatttaaaacttgatggacacttcaccatcacactctcttctcctctcccacatcactctagcactgatccatttttagaaaaggtttttttggggatgggggttgaccagatgtggatatttagagataagtctataatcttccaactgtagaagtctttatgtctttgagtcttgcttgtgtgtgtaaatgtcctatttttttttttgatatatgaataaagtaattaatttgcatttagttgcttaagcctgtcttcatagcctggggagaaatgatggctgacacttgtcattctccacccttccgctccccacatttcatttggtacttcatttcttcctcttgaggtgtgaatatctcaagaaagatgttgactggtcccactggttgggatgacaatgagtgataggtagtcttgcacttcttgatcaatgacaagatcacccatttggcaaactcttcctcttctcttctgtctttatttttttttttttgagatggagtctctctctgttgcccaggctgca

SEQ ID NO: 131261 - DNA, 1938 bp, Homo sapiens
aggaatatcatcactgcctcctaaagtgcttctttcacccagcagtctactctaggcagtttccattctactgaatatacttgtataaacacattttttttgtatgtgactatatagtattcctttgcataaatatactataatttatcaaataattgtatgtcatttggttgcaatatgcattgttacaatcggtgctgtgactattataatcatagcatttctttacaagcctcctcaggtatttccataggataaattgtcaaattgccttccacaaaagacctcccaatttattttcttactagcagtttgtagtagtgtctgtttacccctactcttgccattatcaggcaatgtttacattaaagacttaaaaccattttttaaaattgcctaaataaatgcttccttagcaaatactctttaaagaagaaagtagttaggttttctggctaaacttcttagggcttctacatgaatgttttcacaaacatccatttcaaagagctactggaaaattggatatggactattttgctttattataaatgtgagtagcaacaagattctttgtattcaaaaagacgtttgagagtttctagcccaatggcttcatgtgccaataatctatgggtccaagaagctctgtatttccccaggatcactttgactgctacgtgtcagggctgggagtagaccctgggccatccaatttattcaacttgtagaattaggatcatagcgttagtatatatcaagtgtaattttcattacatatgaatgtttaaaaaaacattcaacagaacttgttggatatttgagtataatcttctttttctttttctttcgttttttggagaccgaatttcgctcttgttgctcagactggagtgcaatggcatgatctcagctcaccgcaacctccacctcccaggttcaagcgattctcctgcctcagcctcccgagtagctgggattacaggcgtgcaccaccatgcctggctaattttgtatttttagtagagatgggctttctccatgttggtcagtctggtctggaactcccgacctcaggtgatctgcccacctcggcctcccaaagtcctaggtttataggcatgagccaccgcacccgtccttgagtataattttcttatcatttactcctaccagcctctgtgctaggttctgggggtataaagacaggggccaggtctgcctttcccctacattattacagtctcataaggaagaaacccagaggagtgatgataaatgtatgcctcaagtatgtagtatataggtggtgcagttgtggtctgtgcacacaggtacaatgaggatgcagcaaaaggtctgattcatttgggttacagacttaatagaaggaatgaagcttgagctgagtttaaagagtagaagaattggattttaatatatggatgggtcctccatgttaaaattaatgaggttggacattactgaggctaagacggtagcagcaggtgatgggaaggtcatcagtgttggggcccattagacctataactccttgaacaacttactttgatcctcagttgtcccatctgaaaataggatgatactgtgcattccacttgtagaactaggattgtagcattagcacaggcagtgacagtcatggcattcacagtgtggagtgacacagcaagaggggtgaggctgcccagccatttgtacgttttgcctgtaggtcttaaactggatggcaggaggcttgaagttgtgatttctacctcatgttttcattataaaatgagtggtcacttgaagaaaagtgacagtgagttttgtgtttgaaacttttagaaggatccattctggaataaccaaagatttaacatgagggtgtgccatgtatatgaacagagctcttctgtgccaggtctcttaaga

SEQ ID NO: 131262 - DNA, 2295 bp, Homo sapiens
tttggtattcaaactaaaggctatttaactggtttcaactgccttttattttatccagcttaattttatcttccttctgaggataattttataaacaaattcctaatatacttaataaggattacaaaattgggaacttgcagaatcatctggttctgagggttagcatgagatttttggaatatttgtctcccaaggatacattaacctatctcttaaatactctcaacaaagaatattagagtcgttagacaacatttaaaattcaggcctatctgcccttccagtttcaagttggaatagagttgtcttccactggggaataatttgtctctattaattgagaacaaatgtgcatgggtgttttaattacacagtaaattaggagaatttaagatgcagaatatgtgaaagccaagaattaaaaaccaacaacccaaaacataagtagataaacaggaaaaatatctcagcataagaatgcaagcacatcccaagataaagagtgggaaaaaatgaagaccaagacaaattactagggttttggtcaagttccttcaagtggaatgatcccatttttggctacaagccattgttggctatacatggcaggaggaagaaaccacactcaaaggattactttgagatgtctggcttcaactagtgaccttttatgcattcagtgaaaatgagtattgaggatttcctatacaaatttcaactttacagagaactcccacagcaagtattcagtctaggttcatggaaccctggtactatgtgtaaagttgtatggttatgagtttatgggggaaataggtccagaacgttcttagattctgaatggagtccgtgatcctaaaatataagaatacaacctgctgcttgagcagggtgaacatttgttgaccttgttctctgtcacttaagataagtaaagttagcatctcataaattgttactactcctttttttttttttttttttttggcaagggcagtcagaatgacttctttctgcctctcacctcgctgtgcatgccagatacttccaaccaaacttggtgcttccttgcaagaccaacctgctactacttcagagcaccctcctctatctcttcttactataatgtatttagatatttcttatttttttttacattgccctaggcatatgagcctttactgtaagctaccttaaatcttttttggaaagaggtaggatataaattaaacatacacctccccaagatctcagagtgttgatggactgattacagagacggggagcaggtatttcctcattcatcactggaggcagaaaaatcacctccaaatatttgttctctgatagcagttgggaaaagtcctccttaaatgagaggcccacgaagggatgaatagggattttggctgacctccaaagtgaagctaagataatgcctgccttcccagtattacttgaggctaattactcagatataattacttgcactctgtgtttttgcttccaatagggttgtgtccttgcttttgtttatcttgtatcccccattagactttgagctctttaagaattaaggctatcacttcctttctattcatcatttgttcttgaggcaatgcttttcacagaatagtcaggaatgccatttaagttaatgattaagatgttaatctcacattgttgcaagttaggcaacttttgaccatcctttctaggaaccccaagttatccgcattgtgaaggaccctaaagtgagcctcaggagattgtggtgaaagtgtcatcaacttttggaaagtttctgaacttagtgatgatttgtgctttttcaggacaatttgtggtgccagcacttaagcgataaacatccccctttaaatagagctgatcaagtttaattcacagtagtcgatgcctaaaaattataggatgcagatgtatatttttcatgtaaacattacctcaaaagaaattaaaggaaagaaagaaaaaagtgactttggataaatgtcaagtatatataatttatgtgtttgagctctgaacaaactgctaaatcgtttggccatagttggagagacagaacattttacctgtctgtagctgggaatcaagtgtatttacccacaagagtggcttatttcctagtttatgtggattacacacatctgtgtgtaatcatgtctgccctttcctctgcctcaaatcctaaatggaattaataacttattgtggtcccttttaacaagacagaacagatctctctgcctcaggcttaggaggctcctt

SEQ ID NO: 131263 - DNA, 1061 bp, Homo sapiens
atgatagggtgatatgcccagtctagttacagaaagctcctggttaggacccagtaaaacaatcaaggtgaacttgaataacatctttgtgtacatttcatagtccatctattctaatggtccaatatacctatttttaaaaatctctttctgtgcctgtttttaaactcatttcttctcccaatgtgtttatccctggttctatcagggtaagccctaaagggacaatttggacttgaccctgatattggcagaagatagcttttctcctattgtggcctctttcctttagccctcgtgttatcctatcttgaccaagtaaaggttcattgtggcaggagtttacataaacaggaattgtactcataccccatttctaggaaaaatgggaacagcaggcattatctgatgtaaaatgtgttgaaccctgaacaaagtactcagtgtaaatccgcatttggctgttacaaccagccagctgagaatcagttacttgaaatagctgctggtcgaaaggtctgtggcctttccaaagatgtgttgttgactttatggcaagactactagaactttccttgttagtgattttattttattttatttattttgtttgtgatgggatcttgctctgtcacccaagctatagtcgaggggtgccatctcagctcaccgcaacctccacttcccaagttcaagcgattctcatgcctcagcctccccagcagctgggactacaggctcacgccaccatgcccagctaatttgtttttgtttttttgtttgtttatttagtagagtcagggttttaccatgtcggccaggctggtctcagactcctgacctcaagcgatctgcccgcctcagcctcccaaagtgctgggattacaggcgtgagtcaccacatctggcctccttgttagtaattttagaagaatgtttggatgccatctaatcctccctaagtcccagttatcttgtcttaaaaatgggcataatgtcatttgtcaaataagactgatattgggcttaaaagaagtcttttaaataaagtacttaggata

SEQ ID NO: 131264 - DNA, 1575 bp, Homo sapiens
gtggagataataatagcacttaataagattattgtgagaaccggatgagttaatacatataaagcatgcaagacagtgccaggcacataataatctttcggtaaataacagtttttttatttttatttttattttttctgttgttgttgaggtggagtcttgctctgtcccccaggctggagtgcagtggtgcgatcttggctcactgcaacctccgccacccgggttcatgtgattctcctgcctcagcctcccgagtagctgggactacaggagagtttatttgttaatacattgtatgtattattattatgacaatattgaaggcatcataatatattggttttataagaaatgttaaagaatgggagaggtgataaaacagttgcagggatgacccaactacatggctgcataacacactctaatctgaaatgggagcagaggcatcattcactctcagtaatttggcgctggttgtttggcacattgagtcataagcatttgagtcttccacggtggcactgtcaccatacatgtgacccacagattagatacgagataggtggagtggagaaagcagagtagctgagagagtacttgatgaggctgtttgcttcattggggctcacagtgctaagaaaaaccatttgcagaatcatgggagcagaatgatcatttctcctataatctggggtcccagcctttaggatgtatccctattcaatgtaaaacactaggttttattcagtgaatggcagtctagcatggttatgctagctgaatggtcttatagggaaagattatagcagatatatgtatatatatgtatatctatctatctaactatatatctctatataattggtatagttggctaagtgacagctgaggagccagctggatcagagttcaaaataaggtgacagtctacaaatccctggaagactggagcaacaaaagagggaatcgttatttggacacagtggggaaagtgaatgaaaagaagaaaggcaaattaattaagataattaaaacacagacattcttggcaatattgaaagctatttaatatttggctttctaactctactattcagtcatttacaaaatatggcttataatatgtcaattgatgaataacctttattttactataaaattcatgaacttctttggtctacacaaatccatcttccattttccatggcttacctcatttaagccaatgcaaaactgaaagtggggaaaagaatattgaggctttattatgaaatgccttctcatccacttttttttttttcagtctccctgtgttgctcaggctggagtgcattggcatgatcttggctcactgtaacctccgcctcctggttcaagcgattcttgtgcctcagcctcccaagtgactgggattacaggcatgaactactacacccagctaatttttgtgtttttagtagagacgggatttcatcatgttggccaagctgtactcttgacctcaagtgatctgcccaccttggcctcccaaagtgctgggattacaggtgtgagacactgcgcctggtgtct

SEQ ID NO: 131265 - DNA, 1114 bp, Homo sapiens
ttatttttgagatggagtctcgctctgtcacccaggctggagtgcagtggcacaatcttggctcactgcaacctctgcttcccaggttcaagcgattctcctgcctcagcctcgtgagtagctgggattacaggtgcctgccaccacacccggctaatttttgtatttttacaaaagatgggttttcaccatgttggtcaggctggtctcaattcctgaccttatgatctgcctgccttggcctcccaaagtgctgggattacaggcgtgagcaaccatgaccggcctgggtatttattatgtgccaatctgttgttctatataacgttcatgacaactctgtgaagtcacaatgaagctttgaaatgataagtaactttactatcttttagagaaagtagaggcagaagtggattatgaacttaggcagccaccctccttaacttgggttcctagatgctgacaccgggctcaagtgcctgattcactgtggtttgagcagctgtattatgaagaaatattacaatgcatttaatatgagcttgggctgtgtaatcacacaaacgtgtgtccaatataattatctcccttactgtctgtgatctccagtgtcctcatctgtgaactgaggaggttaaataagataatgcgaagtgcttatccagcatctgcctcaagcaggtgatcatgatgacagtggtaaggactgtgccgagaactgcctcagttacattgtcctcttccttagtggtatgcttcccatggttataatttgaagacgcttctggccttcaaatatagtgctagctagcaagggcacagaagaatgaaacagagttgtttgtgggaaacatgaagcagaagcgagtgatggacagaggtgaggccaggggaacaggctagagcttgatcagggccggccttgtgtgctaggctagagcttgatcagggccggccttgggtgctaggcaggagagttctgtctcctgcgggaaaagctgcctgtcccttggccagctttccctaaggcatgcagctttcacaggcactagccattcttaagccattttctctttccttcactttgtgcacaacctgttggaatttctcaggt

SEQ ID NO: 131266 - DNA, 1044 bp, Homo sapiens
aggcagtggaaagaaggaattgattgccttgctggtattttttcccctgcactgacccttcttaattaatacatgaggtaccatttacccaaacagatttttcagcactcacttatggaggacactaagtggcgagttcatagttcaggcagagagctggcagatcaagactcctttcaactatgagatctgtggttctatgcaaggcgaccatgaaaggagttgtttagaccccgtttttcaggccagcagcaggagctcagcccgccattaagagtttgttctgtgtgcatgttgtaagcacctgaagtttctcttgaatgttctctttagaaagatccatcgttagggtgcaagagcaattcttatttgctgcaagaatatttatccttaacagcatatagctgaatctcactttatatatgaattcttgaaataagtgcacgtatgtttcatgcttgcaaattgcatccaattagaatagcttattttaaaagctgttttagagaattcagaagtatagactcataaaatgtcaacttatcccctaatattccttttggtacatttagatttctaggtgctggttttgcttacattcactataaatcttaattgcaaagcatattcaagccaatgatcaatatcaaagaaaactattttttttatcctaaggcccatatgccagaatccccctgtcccccaatctttatgcttcttcctcatatctgcttccaaatcaagaaatgattggaatctgggtgcagtcacctgcaccctgtagtcccagctgttctggaggctgaggcaggaggatcactccttgagcccaggagttcaagttcagactgggcaacatagcaagactttgcctgttaaaaaaaaagaaagagagagaaagacagaagggagggaaggaaggaaggagggaaggagggaaggagggaaagaaatgctttggctaagaaaatgccctgaaatttggtcaaagttggagtttcctcaatgccaaagtaaacgaccatttgcccatttaccctctac

SEQ ID NO: 131267 - DNA, 1655 bp, Homo sapiens
aacttatttttgcttaataaacagtttggacatcaggaagagacagagctgtatacaataggtagtttacagtcaaatatttactgctttaaataaggcagaattggctgggcacagtggctcacgcctgtaatcccagcactttgggaggccgaggcgggcggatcacaaggtcaggagatcgagaccatcctggctaacctggtgaaaccccgtctctactaaaaatacaaaaaattagccgggcgtcgtggtgggcgcctatagtcccagctactcgggaggctgaggcaggagaatggcgtgaacccgggaggtggagcttgcagtgagccgagatcaagccactgcactccagcctgggtgacagagtgagactccgtctcaaaaaaaaaaaaaaaaaaaaaaaaaaaaaaaaaataaataaataaataaataaataaataaggcagaataagtagtatttaattagagcacagactttgtggtaaggcaggcctgagtttgaacctcagctgtgatacttattgcctcatttgaaaaaagtaaattttggccaggcatggtgactcacacctataatcccagaactttaggaggccaaggaaggaggattgcttgagcccaggagttcaagaccaccctgtgcaacacaacgagacctttaaaatttcaaaaaactactaaaaatttcaaaataattagctgggcacggtgttgtgtgcctgtagtcacagctactggggaggttggggtgggaggatcgcttgggcccccgagatggaggccacagtcagctatgatcatgcccctgcattccagtctgagtgacagaccctgtctcaaataaaaaaattttaaaaagtaaattttattgtttatatttaaggcatacaacatgatgttaagagatacatgtatatgtagatagtaaaatggttgatagtgaagcaagttaacatgtctatcatcttgcatggctacccatttttttgtatgtgtggcaagagcagctaaaatctattcatttagcagaaatatggaatacaatactattaactatagtcctcatgtacatcagatctttagactcgtttgttttacgtatctgccactttgttcttacacacttgtgtgatcttgggcaagtggcttcattacctctccacctttagatttctgttctgtgagttaaaagtaactctcagcactgttgtagcagaatccatgagtaagcactcaataagtggcaagtgcaatcattattagcaacaaccgtaataatagccatagttccattattaaaggggatgattgcccttgttatccaagtgctcatctcatttgactttgggcctttggaattaataaagcaggcttagttcctgggtttggttttcctttttcccccaaagtttgttttgtttagttcaaaccatattttatgtttccatttataaacacattctctcaagtgctgaacttttaagcatggaagtctgaagatacctcctcttgtgaagggaaatttaaaaaatatttaatgactgctttttaagtttttggtctgaggaaagagcagcattaccttggtcattgactaaaataaagacataataaaggtactggaaactgaacagaagtatggagtttgt

SEQ ID NO: 131268 - DNA, 1056 bp, Homo sapiens
acaaaaggaaactgtggtttagagggttgaagtaacatgttaaaattctcatggcttttttgtggtagagcagacactagaatcagttctccttcctccggtccatagctggctgcttctaatcttttaaaaatcagctaatcaaggtaacttggatccatttcaatcctgtcagtgaccctacgttcaatataaaagatgagtcctgggagaactgccgttctgattcacattcatctgaatgttgaaaaagtgcatttcttcagagtgctctgtaggaggtggaaatattcaataagcttgcgagaaaggtttccatctcaaccacaccatgtgtgcatgtgcatgcacatacacgcgtgcgcgcgcacacacacacaccactgccaccaccacatagctcagatctgtcacaacatgagggaggggactcgcaaacatgcataatttatgcaggattttcacggatttttcagtatttggaagtgatttcttaaattatacattgaaacagctccataaagatgaagctggagttagtttcacaatagccttaaaagtgagagaatttgcgtctctgggatcaatgtgcatatttcaaagtgagacgtttcactttatagaatttagagggtctcaaggctgtggttgacatttttagtttgttgggctaaacaaccatttgctatacaatactatggaaacgaatggtggaagagattgccctggaaaactctgttcaattccgttaagaaatattaaattcctgaggacaatctacttgtttattattttcaatttctcttaaaatagtataaaaggatcttcttgggtggcagtacagggatgacaaggaagggaccaaatctcagttgttcacatttttacttagtttggattccaaataatggggcttctcataaaagatttggaccctgccccgaggcttttggtaataaatgtggccgctttgtttttttccctaattatttcattcgtaaaagtcttatcttcccaataaagatggtaactcctctggactgggtctgcttttcg

SEQ ID NO: 131269 - DNA, 1084 bp, Homo sapiens
ctcttgccttagcctcctgagtagctgggattagaggcatgcgccaccacgctcggctaattttgtatttttagaagaaacagggtttctccatgttggtcaggctggtctcgaactccagacctcaggtgacccacccaccttggcctcccaaagtgctgggattacaggcgtgagccaccgcacccggtcttctgtgttattaacagcacttttggtgatcttgaatgcattggcatataactaaaaaatttccttttggaaaaatgtcaagaaaggggataccatttgcaaagagttcaacccagatgatgattaagcatctataatttacgtgaccacaattaattcatggagtgggttttttggtggagagcaggggtgctgagcattctttagcccttcatcgccaatattaatttgaatggcttctgtacctccttgtaattgaattattaataatcacaaagagcttataaacttcgaatttaatcttcattaatatataaagctcaaagagtaatgtcttttgaccatgagtagactgcttctctaatttatcttcaaagttgcttttttttcttcctgtaagtttctgtagtccccttgactcctaaaagtgagtgtcatggagtggctttgatcagggaacatacatcagtaactgttttgtgaccttagtcccggctgtgttttatggcttggccaaagtttatcatataatttccactttaggaatttgcccacttactaaggctttgagggcaggggaggtgaagtagtattgtgggagaggagtaataaatgtgttttcttttcagtttctacagtgagtggtctgttttgaaatgagtgcaggtggttgcagtccactccctccccaaacaggacaaattaagatcattttgctctttcgggaagctgagggcaagcctgcacaggtgaggtcacgagaggcaagctatgtgcacacctggtgtcctcgtgcttcttgggcaggccagctccatgcagtgcagtgcccctgaagggaatggggccaggagaagacataacagggcatgaggatcttctctgtgccaag

SEQ ID NO: 131270 - DNA, 1572 bp, Homo sapiens
atacccatgtaattaccaccaggttcattcaaaatatagaatatttctagcacccaataatacccctcatgcattctctcagtcagtaatttcttttgcatgttttttgatttcatacacatggaaccctactgtatacagtcttttgtctgtaacttctgtaacttgccattatgtctgtgaggatccatgaggttgtggttatctgtggcttattctttgctcttgctagcagtattcgttttatgaatatgccagagtgtgtttacacgttctactgtgggtgaacattatgcgtgtctccagtttgggactatttatgaataaagtttctatgaacattctcatatgtatgtattttgatggaaacaaacacttatttctgttggctatatagcctcaaaggaattgctgggcggtaggctatttgtgtggtatttttaatgcaagataatagatttacatactgagaattgtgcttcatagtaagcttttctgggtgtatttttcattgatagagaaatagctctaatatgggcctaaatagctcatgtgtacatttgcttaagttctttattctgagataaatgatttctttaagttaccaatgtcattttgaagactaattcagttatgttttcttgttaaagtcctggctcacttccgtagctcatgttactgttttgtgtattagccttctttctctaccagcatttagattattgttgaaaaactaatataagcgtcgagggtcaacactatcacaatctttcttgtaaaattactcctgggttgacattgaactgcagatgacaagtatgtcagatcatgtgaggtaaaactacagagcaaggaggttaatttttcaaatggatttatttgagcaacaagcatttctgaagcactgtatgaagccattgctctgtcaagtaaagtaaaatatagccattattttcaagtagctgacagtttggtggtgggggcagaaaatgaaaaccattgtttgcaatgtcctttaagcaagcattgccccgcatgttagaggggaggaagggagtggggggtggtgatgagagagcatgaatgagggcatcagaatcagattggagattcagagaaggcttcctagaaacatatattttgatggaagaaaacaaattagatatttggggagatagagtgagggtgagggctttgcactgtaggggaagggaccaaatagcatatttaaaggaatggaggcatgaaatagcattatccatctagtagtcaatttaggggataaaacattttttattccattgatggtgttattgccatatacatttctggaatgcctcttttggaatgacttttagagctaattttcaaaccacaccagaaaatcactcttgatactttatagctttgacccaaatggtatttcccagctggacgctcaccagatttgtctcctaaacacttttggctcattccaaagaaatacaatctgtcttcagaaggtttaaggcttaccactattgagaacattcaaaagcctgtgtgtgtcccagaactcagaaatcaattcca

SEQ ID NO: 131271 - DNA, 1442 bp, Homo sapiens
tagctgggactacaggtgcacccccccagtgcccggccaatttttgtgtttttagtagagatgggatttcaccatattggccaggctggtctcaaactcctgacctcatgatctgtctgcctcggcctcttgaagtgctaggattacaggcatgagccaccgtgcctggccgagcatttgctttttaactcaacatagtaacatcttcttcttggggccatggcctggaaactgatggtgggacaggcatgtcacttggagtcatttctaggggtccactctgaggtctgctggtttccagctctggccttctgtttcttcatgtttaacataataacaatacccatcctacctccattacaaggtcagagggaaaatttaacatgagttggcattatcagtgtggtacagcacactgtcgccacaggtagttgttaactttatttctggactattctgagagtgaacggggataccccaaaccaaagctagcctttgtggagtctatgttctggtgataatcactgctttcaaacaagtaccattaggtcaaaactaaaagcgtgagtcacgcagctgtgatacatttgtaaagaaacctttctgggctttcctgggaatttttagtttattattcctatataggtcatccagagaaggacatctcttccctactccacctcataatcctcaaacagaaatatgacccagtcttttttttttcattaatttagataagttatgaattttagggagaaaagttcagataagaagtacttttacatagttgaatgtgacctctggattccaaagagatgatgtgcttactggctgaagaaagcctgcagatggaggatggggagaaagtcatgaacttattactcagtttctattttgtaaccacttggaataaatatttgtgtaaaatatgagcgtaacaatgtggttttagttaaagccagaatgtggttgttcagaaataactgagcaaaagtttgccagacattcacatttcactgggcaccctttattgctgtatactaattctggccaccttacccaggaagcagggtatatgacatttccatttattgcatgccacctacacctttcatcagcaaagggacacctgtacatcctggggacagagcagatagaagacatgcattccattgccttctttcaaatagatacttttcaaaagattttagaccctgagttaagacaacctcactcttaattattgtggtcaggaattcttttctttgaaatgaaacctgcattagcactgtgtgtttccttatttacatttttgttaaatttctggacaatacgtagctccccttagggactttctaagtttggtggagaaagaaaccctagtggctaacttcactgtttagtccttaaatttaaattctttattatgtacccaccaggcc

SEQ ID NO: 131272 - DNA, 1024 bp, Homo sapiens
aatcctttgttcataggcagtgcaaagattagttacagccctcctactgtctgaattactgtactttctgaattagtagagttggcattgataatcttaaaaatataaacagtaaataaagcatttaaaaccccccatgctgctgacttcatataaagagatagttgtttttgaatattttgatgtccgtacacatttttctacagaggcagtatttaaatgggtttgtataaataagttctctttcttgaagcttgtgcaaagcatctttacacaagaagcttataagcacagtcaataaattcaagaaaatggcccttttgaaaggaagccactgatgcatctgtgggctgacttctgcatgaatgacagcgcagtaataagaaagcagacaacggcttcctccgccaccactgccctgccgtgctcacgctgcatgggggtgccctcgcagcgggagtgtgtgtttgtcctggtggccggggactgcggcttggcctttttgtttacaagagagaggacagcagcctctgccctccagctgctgtgaaaacagtgttggaaaaccagagcgaagtttccactgaagaactcacactggaaaaaaaaaaaaaaaaaaaaaaaaaaaaaaaaaccaccaacacccgaacaaacaaaccttccctcataaaagaccatctgggttaaagtacagaccactgggtcagaacccagatggtaatgagaatagttgttcttctgcaaactttccgagtgggatttccatatattaagttggaagagagcccaacgttgaaaaacaggaaactaactgaagggctgttagtgtagtttgtaaggaagattttagcagtgggattaattgtgtatgttggataaaggatccccatcactggaggtctccttccaagtgaaatgggtgctcctgctgatttgaattgggaggtgacagtggcgatggcagatgggtatggattagagcaatattttggaggaagtctcagctggggttggggatagattg

SEQ ID NO: 131273 - DNA, 1290 bp, Homo sapiens
tttttttttttgttttgttttgttttgtttttgagacggagtttcactctatcacccaggctggagtgcagtggcatgattgcggctcacttcagcctccacctcaccctgcaccccaggttcaagcgattctcctgcctcagcctcccaagtagctgggattataggcacccactaccacacccagctaatttttgtatttttagtaaagacagggttttgccatattcgccaggctggtctggagcttctgacctcaggtcatccacctgcctcagtctcccaaagtgctgggatgacaggtgtgagccactgtgctcggccagttgccacatctctagcccacattgccactgggttgtcatttgtctttccctgtagcatgtgggcttcctgaaagtaggatagttctctgtcttgttaatctatctagctttagcacccagaacagtgccttgcatattgtgggggctcagtcaatatttgttgcatcgtaaatagtgggtttgtgagttttccatttctcaactacaactctctgaagattccaataggagggagaaacagggtagtcagagagataataaacaaaatcagccaacgttgataaattcagagtatggaggaccaggtaggatgtgtcatcatacctaagaacgctgcctctgcttaaaaattattgttagctctagaaacaatgacatatctatttgtgtagccctttgcagtaaacacatatacattaattcattagattcccctaaaagattctattaaaatggtgtttaactttttagtgctgataatgtaagatcttctttgtaggattgcctctattttgttgttgttgttgaaggccagggagggtattgtaagtgttggatgatgtttagaacatacctgtgacattggggctgttactactgagcgtccatgttgccatttggattttctctctttttttaaaaatattatttaagaaaagatatctgtctgtctcccaggctggagtgcagtggtgtgaacactgctcactgtagcgccaacctcctgggctcaagcaatcttctcacctcagcctcttgagtaggtgggaccacagacacatgccaccacacccatctaactttaatattttttataaaggcaggatctcaccacgttgcccaggctggtctcaaactcctggactcgaacaatcctcccacctcagcctcctaaagtgttggaattacaggtgtgagtcacaatgcctggtctcatagtttttattctgatagtttatgctgt

SEQ ID NO: 131274 - DNA, 1046 bp, Homo sapiens
actttgggagcctgaggcgggtggatcactcaagattaggagtttgagaacaactcctcagttggtcaacatgtcaaaacccctctctgctaaaagtacaaaaacttagccaggcgtggtggtgcatgcctgtaatcccagctactcgggaggctgaggcaggagaatcgcttgaacccaggaggcagaggttgcagtgagctgaaatcacaccactgcactccagcctgggcgacagagcgagacttcgtctcaaaaaaaaaaaaaaaaaaaagaaaagaatagttaagcaaggtgctttttattttcacttggaaagtttctttatattttcactcagaatacttagggttacatacagtaataaaatttttagtaactctattaaaggaattgcctaacactcaggagtcaccgctttccttagtaaaaaaaagtcaagaatacactagggtttatgtaaaacaagaaatctccagtccaaaatcagtgaaataagaatacagcatcaaattatattattgaagttgaagaacagtgcacagggagaaaacaaagtgataacttaattcaatgctatagaaaagtgatttgtgagtcactttaacatttcagatttgtttaaaccataaaagtgataaattagccaaagagctaacaattgatattatcttaagttcacataaattttgatttaactgaagcaaatgaaatcaatgtagttactcccttccgattgcttcatctttgtacagtttataaagctaagaataagtagctctaatgaacagttttttttttaagcttttttgttgaggtttctctaatatgtgtcttttagtaatctcttcatttttttcctcccagttcttcatctcttgggctcagcatctccttctacttagagcaccctgaacatgtagacacagtggtaatgcacctttccttgtggctattttgccacactaggaactctttacattccaggggtcccattccagagatcccaatatgcagatattctactgtctatgctcagtgctgtg

SEQ ID NO: 131275 - DNA, 1054 bp, Homo sapiens
aatgagcacctcagactggattttagaggagagccccctagactgtctctgtgtggccacttgtccaattctgggttggaccggcaggagcctgtgctcatctgtccacagggaccacctcagtgtttggcattaccaggcagcggttgcgtccattgcctctactatccccttcttcgcattggagtagacttccctgggggcagcatgggaagaggttcctgctgcaccttgcaggcctctcttgacattggggttgggagggtgctggaggtggagggaggtgggaagctcaggcctgcactgttttcctctctgcccggccgatcctgacccctctctgttcctagcagctaccactgtctttgctgatgctgtggttacctttacagcagtggttctcaaagtgtggtctgagcgtcttttgcatcagaatcacctgagataattattaaaactgcaggctctgggccttactctagacctactcagaatcacttggactgggcccaggaatctacactttgtaatgacctccctaatttagtgagccttgtgtgctctaaattttgagaatctcttatttagaaaatttgattttccttttggagtaataataacaagtaatatttgttagaggttaattatgtgatgctactcagtgttttatatgcaataaccgaattattcctcaaaaataacagtgtgaaagagaaactaatattagccttgtttggccagtgggaaaattaaggcaaagagtatttgctctaatgttgattgaagagccaatatgtatgtatgtatttatttatttgtgacaggatctcactctgttgctcaggctggagtgcaatggcaccattacggctcaccacagcctcaactttccaggctcaggtgatcctcccacttcagtctcctgagtagctggaactacaggcacctgccaccatgctcagctaattttggtattttttgtagagacgagattttgctatgttgcccaggctggtctcaaactcctgggtccaagcgatccttccgcctaggc

SEQ ID NO: 131276 - DNA, 1057 bp, Homo sapiens
ggcatgcacctgtagtcccagctacttgggaggctgagacacaagaattgcttgaacctgggatgtggaggttgcagtgagccaagattgcgccactgtactccatctagtctgggtgacagagcgagggtccatctaaaaaaaaaaaaaagacatcgaagtctggagaactgagtttgaaaccttcttccattccgtgtatggaccttgggaaggctgttaagcctcctggtgccttgtttttctcatctgtaaacaggcataatgaacaccatttgcacatggttggtacgaagattagaaagagtgcaagtctagtacctggctgcataggctcttgtgttggagcagtggtgattattagttctgtcatcacctgtagagcctgttgacacttgaaggccaccttaattttgcagtttgcatgtaagggtcctctgtagtgatttccagagtttttcctccatgcacggtgcctagaacgatgcaaactgggcagttacttggggtttgcatctttccacaaaacaaaagatgaaaaagagagatcctgccaaatgcaagcaagatgaggaagcatgtgccaatgcccaagacttcaaggaagtcaggttgtgggcagtgtttatgcaagtgggaactgcattccccagcactggatctgtgggtcttactcttaggcttgccggccttagcattatggcagcagccactggagaggcacaagtggttcctgagcattttgctgtcagggaaggcataggttcaggtgaatatgtgtaagcactcatcttctaggatgctggaatgtgtcgagatatcgcttcagctgagttggcttttccttcttctccaactttttttgtgaaatctggttctatagatgctgtgcccagctgtcagattgtctcagttctctggaattagtttaaaatgaaagtttttccttgtctgctatagacagttctacaaacagaattactctccttttcttaattgcttctgtcttcaagggcaggaagagataactttctctataggaagagagggagaccca

SEQ ID NO: 131277 - DNA, 1724 bp, Homo sapiens
atcctgccgggccagagacttgtgtcaagtttagttcttatagttggagaaatgctagtgtttcctccatcagtaatttttttatctgttgatccccatgcagctgtgagtatgaatgcatacatatttctcctttttttttaaaacttgatcagccagcaggagatgaaatagagcagatcacagctccctgttcatttaatcatatgagttactaaaggaaggaaaaagaaagaaatgtaaaaatggagaaatgtctcctcccctttctttttctctctctttctttttaaaaattgttcaacaagttatctgcagaaaacatctgcctctcaaagaatgaatgtaatttgggttctgaactcatatgtccctctggttggaaggaagagttttttgcacatgaagtgaaatcagctaagatgctgtctgtgaagctgaaatattgagatttataagatgacagtaaagtagtgaaaagtggtgtttttctgcttgacactgtcaccactgtggaataagaattccgggaagaagagacttagatacagggtctacagctgtctgttcccatgccacggaaggttcttccagccaccttgttatggcgatcctcctggcagggaatgagagccatctccactgcctccctttgagtggttatctggcttgtgttgcttgtcttgtcgggagaccaagggccttgcaaagtaggtgcctgtgaagagtgtcagctgaggccctgcagggagctggaagcttggaaggcctgggagaaaatgcctggctaatgtatgaggcctggaagactcttctttgttaagaagattcatgggtctctgaggagtggagtaatcaggactaggagaagatgttgggccaagccttcgtatcctatatccatctgcttgaacatttttttttttttttttttttttttagctagttgaaaggaggaggtcccgttgaggcttatttgaacaaatatttgctctccctaattatatacccagagctgctctcctgaatgtttaatgcaaaccttaatatttacaatagcataaggaagagtttataatgtgtttgggaggcttccgaagttggggcagtaattcttctttgcacttatgtaatacttttcttcctaagagacctgagccatgtttaccttagccactgttcacattgagatgaagtgaagtgagggagggagatgaaaactccagagaaaggaggagcccctgtgggcagctgccaacatgttttataggtgagacacttgtctttgccaaaagttgtgtgccagccacaaacttttctttctggtcaggaataacatgtaagcctgtgcttacaattgccttctgatatggacgtggagagtgtcacagaggtgccatgctgggtttttgaccctgatggtagtagacttcttgctcagtgccctgctgtatgacaagcctgacccattcccttattagactcaagatttagtgagtcttaaaaagatatttggaggctaggtgtggtggctcatgccagtaatcccagcactttgggaggccgaggagggtggatcacttgaggtcaggagttcaagaccagcctggccaacatggtgaaacgctgtgtccactaaaaatacaaaaattagttgggtgtggtggtatgtgcctgtaatcccaactactcaggaggctgaggccggagaatcacttgagccc

SEQ ID NO: 131278 - DNA, 1111 bp, Homo sapiens
cctggggatgcctcaactctacattgcttgttcagaaaagagcactgtacagctaccctgccaaccacgtccttcattttcagtgtgtgtccccacccacgccatgcatattgaaaaccagccgcatacccagcaggtcaccaatccagaaaaatccatagcccaaggggatatcattgatgaattacagacaagttgcctatcagcaggaatcctggattggattagagaatcctcataccatgctggcttttctaaagaagatctggctctcagagaggaacaaagatgcctgaacacatggtctgcattgaaaacaaatattgattggcccctgctgggttgctgagctagagtgggttagaatctgatgtcaaaaagtgctggggtgtggaaaaccattaactctgctgattgaccagaataaaagctccatctatttttaagatcttaaaaaaatgagggtgaaatctttaagtgggcggaagggcagaattgatggtgagaacccatagttaggcaaaaacactctctctcagtttgtcttcgtgactctggacacagatcttaggccatttgtccctatcttctatatagcattttttggacctgtgactatttattaatgctgcactaaatttactcagttgcaaattaacgtccaaatagctgatgttctgtggtgttcagatttaggattcagaccgtctgctgggtgttcttattacactggtagaaaaatgctctggctgtatctgattgcatccgacagttagatatatttctgtcactgccagatgtacaagatactgtaaaaggagcattttctctagcaaattagacttgctagctccatggatctagattgactaaaacagcttgttgccccagggatgtagctggatttggcttggtcatttcttttaaatataggacttcagaaacctgatctagagtccttttcttttggagacagtatcttgctctgttgcccaggctggggtctagtggcatgatcatggctcattgcagtctcaacctcccaggctcaagtgatcctcctgcctcactctccctagtagctgggactacagacgtgtatcaccatgac

SEQ ID NO: 131279 - DNA, 2229 bp, Homo sapiens
ctgagacaggtggatcacgaggtcaggagttcaagagcagcctgaccaacatggtgaaatcccgtctctattaaaaatacaaaaattagccgggcatgttggtgggcacttgtaatcccagctactcaggaggctgaggcaggagaattgcttgaactcaggaggcggaggttgcagtgagccaagatcgagccactgcactccagcctagtgacagagcaagactccgtctcaaaaaaaaaaaaaaaaagtaaaataaaatgcagaatttctccatatgcaggaatggcagtgggtttcctctctcaaagaagatagatcctttgcaaaagcataaaactgaaccatgaaggatgttacagggaaggaaaggctgctcagtcagggtgattcactggggatgaggcatcttgggggttccttggggagcagaggtgagccccaatgaaagacagctttgtattaaaaccatgggggttcagagtacttattaacttataaaatatcatcagaatgagctcatctgagctaatgtttcagaccaagcacagagtaggctgtttactattctgtacctctactgaataatggaaattgtattttttggtttagccagtttgtttttatctttcttgatctctttctcaaagcaatttctgtttgagttagtggctttaaccacttatccctaggtatatatcaagattagtaaactatggaccaccagccaaatctggccccttagagacagaggttctcaaccctggtctatattcatgattttgggggtttattgtaccttatgtacttattgtaaataaatataaattctttctgaaagtaggtaggagtagaactctaaatatacatccatcaacatatccaagttggtcagactgaaaattgaaaattacccctttttggtgtgttatgacgatttgttaaaaaaaattatatatatataaagtatattatatataaagtatatatatataaagtgtgtatatatatatatatatagtatgacaactataccatacggggaagggccaatcaatgcctcaatttgagcatctccactttaaattgtccagacatgcagaagaagactctccctcttccctagttaatgagcttcattgcaattgaggattttgagaggggtgccacttccctcaaatggtattccctgtttaacgactgctactgctaaaggtattgtgggtgtaacatggagaaggaactcaaggcatcttgcactttatctctcattgtgtgcgagagctgggtaacattatagagaagtgttccagaattaaagtagtgctctgctggcctgtacctacaagagatagtgatggaaattttagttgtttctcctataaaaatgttagctgcttggcccagaatgggctaagatgttcaatgacagagattgagtgttcaattgtgttacaatgagccatttgaacaatttctgtttgtcctctgcctgtcacttttctctttcccctttccaatcctgctttaagaaatgtaggaatagcagttttgcaaaggatctcagcaattctaatatgaaagattatttttctggttaccgagtctgcattacaaattactccaaaatttactggcataaacagccatttattaagttgatggattctggggccaagcattaagataggacggtgcacagatgacttgtctttgttccacgatgtatagggtctctgctgaagagctcaaaggctgtggctaaaatcatctgaagcagcgttgtgtctggtagaactttctgtgtgatgaaaatatgctatatctgtactgaccaatatggcagccactagccgtacatggccatagggcaactgtaatgtaactagtgccattatagaattgaagtttttatttaattaatttagatataaatacccactagtggctaccatattggacagcacagatctgaaggcttgctcacccatatctagcagttggtgctaggtgacagtagactttagttggggctctctccattggaacacctttctgtggccgcttcctgtagtcggctgttcctcctcatatggtggctgggttccaagggcgagcgtcttaagagaaggaaccaagggaagtagccttggagccagcaatcttgcttccactgtattatatttatcctgtctggattcaaaggcaagggcagtagaccccatttct

SEQ ID NO: 131280 - DNA, 2072 bp, Homo sapiens
ggtcaggagtccaagaccagcctggctaacatggcgaaaccccgtctctactaaaaatacaaaaattagccaggcctggtggcacacgcctgtaaccagctgcatgagaggctgaggcacgagaattgcctgaacctgggaggtggaagttgcaatgagccaagatcacctcattacactccagcctgagcgacagagcgagaccgtctcaaaaaacaaaaacaaacaaaaaatgacagggtagtgtacagtagagaattgagaaaatcaccaaataagatgatattctactggtactgaagagttaataatactcatctatctttgtgttactcacctgtcaggaacctcccaggaatgggttgatcgtatattttattgtacgtgttttatgaatgaagtgcatttttattatcgaatgaagaaagcgtataggacaatggggaattatttttctcttaatctatcttttcagctctcctcgtctagcatatgttgggctccccagttttaattgtgaagactgggagattttgctacattagggatcacatcactttctttgtgtagatagaatctcagtctctcttgctcttttctttctctcgtggagataataatctaactctgacatccatgatgtgatgatttgccaggtgctctatttctagttacagctactagggaattgcaagaagacattgggaaatggtacttggcctccacttagctttattcagattggcttgtttcccaaggacccacaggatcaatgatgcgtgcagtgctaaagggcagctgcgaggtcagggcgtatttattgcttgctggggcatgttattgaccaataagaagttaaacagttcctagctacagctaagacattgcctcttaggcaggaagacaagagatcacctcgggcaactttcgtttacacagagaggtgtgtaaagtggaaccaaggcttgcaactctaggcatcccttgtgtttgtcaggatttcagcttatttggggtggctgcaaggctttgagacatgcccatgatgctatgcatttttctaaactcagcctttgtcaaggtagtcagggattgttcattttgaaacctctgtagatatctgcatgtttgctgcaaaggttttgtctaggtgagatggactggctcatgtttcctaatgctgatgcccttccctcccttccatctgtcttttatacacacagatctatttattactttcttttctttgaaaagtataacttagctttggataaaggaggaacaggatcacatttgattaaacgcaagcaacagtttacctcgcatgggcttggatgaataaggaatccaaaaggagcggtattcaggaaaaaataaactgtgtgtgtgtgtatgtgtgtgtgtatgtgtgtataaagtacagatatatatatacacacacacatatatatatatacacgcacatacatatatatatatatacactcagaaataagtagtgaaaaatctccttttagctttatgagatgttctgagctcagctctgaggtttatgttctgactatgaaaaataaaatgattttcctaagtttttaaagaatctttctttctttctaggtgtaaaaagaactttttttgtgaactattgaatgaagaggtgaggaaggagaggcaggaggaagaaaacaatacaaatcaggctgaaaggcctacagattaaaaactaacactgcctcccctgcagtgagatagtcctttcattttagctccttgcattgaaatagcattgaggattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaactaaaacacagctatatttcagatcatactgcttcatcacatcgagtgcatctacaaaggtaataaatagtatgtggctgagttagggcttgggaccattttctagaagatttgccctttctgcaattctagt

SEQ ID NO: 131281 - DNA, 4433 bp, Homo sapiens
ttcaccaagttatcaaaaatattcaagatccccttaggttgcttaggatggtggtaactgttccttgttaccttagaaaggatgcagatattcttatgtaacctgtctgtaggcatgttctctagggccatcaaatgctttttttgttttttttttgagatggtgtctcgctgtgtcccccaggttggagtgcagtggcgcgatctcagctcactgcaagctccgcctcctgggttcacgccgttctcctgcctcagcctcccgagtagctgggactacaggcgcccgccaacacgcccagctaattttttgtatttttagtagaaacggggtttcaccgtgttagccaagatggtctcgatctcctgacctcgtgatccgcctgtctcggcctcccaaagtgctgggattacaggcgtgagccaccgcgcccggccagccatcaaatgcttttaaaaaattgaattaattgccaactctaacaactgaaggatttcacatagaaatgtggattcagtgcttaggtaggaaaatggaagatttggcagccctacgcttgcatttctacatggccacggtcctccagagctaggtagaggatgcctctttcatggagagagtgttctcttttttgcctcaggccactcttacaacctgttgtagtctaaatgacactggcttggcttgagaagaagtgggtcctagtctcttttcttcctaaagcaactctttaaaaatgtgaatattttttcagatgataaaaatgagattcagacagtttagatggaatcagcctcagttgttcactgaagtgggttaggataatgtgaaacttgaactcagatcatctaactttattctaatattctttccactgaaccacagttgtcccccattattgttacgatttttgaccttcaaggcattcctagagataggtagagtattataggcatttcacagatgagtaagttgaaacttggttcagctctgaaaaaggaaagttacgttctaaaagggcagagctcatatttggtctcaggttttttgactcaaacactatactcctttagtggtactcaaaaacctcagagatccatataattctgacattttttacagcagtgatattaatgattctaacatatttgactccaaacagaagcaggaaaggtggagggacccccattgttgatgttgtctcagaactggaagaaagttcctgcggtcagtcagagaataagttatagtagactcactccttgcaaagcactgactggtctgggaccatgggctgcaaagtgggagagatgttaagaggaataaggaattgctttccagaaccctataaacttagatgggcaacctagctgagtatacctgagaggatttaacagctttataaaggccacacctcaagttcatgttaacattattttacctgcattcttacctatagagtaataagaattgtcctgttttatagtattagagctgtcctattgtataacagtagagatggctgctttgatggacacttcttgtaagccgtagtatatttgatgcatatttattagggctgtgtattggtggccaaatttgtaaagtgaagactctgtaataaatgaagaagcatacatagggtgtgttattttcctggatggtccttttcccattgcagagtttgcaatcattttgcaatcttcacctacatgtgacgtagaagaaaaagtacagagagggccaattatcataaaagacactttgcgtagtggtgaaatgctggacttgtagccagtctgccagttttaaatcctggctcaatcacttagcagcttgtgtgaccttagatcattagtttatgtaaccctttgttgcctcagttttctcctctgttaaatgaaaagattagacaattcatatccgatagagttgctgtgaaagtcagctaattgcacgtgaaacattcttaggaagagcctggcatatactaaatagtgcataggtattagctactgctgctgttttgttttgctgtttttaatcattgttgaggtgcctattcctcagttgctatgctgtagcaaatcgagctttgtaactagagctaagaaactggtgggaacctaggcatggaagttgtatatgtgtaccctttgggctgagcactataacatgaggggtttagactaatccctaatagtctgcctagctgcaagcaagtctgggatatctgtcagtcatgagaagcatcattaagcatgtgatggtctctgaggctgggccctttaacttgtatgaaaaaccccagctgtcaaaagttaggtagagagctttggacctcaagtcctgactgccactctccagctctgtgatctcatgcaaatcactttgtctcaggactttgtctccctcacccccatgtaaaagtgggatgataacatcattttccaggatcagggtggagaataaatagaccatgtttactaaatgtcctacggagtgtggtggccaagtaggtgcttagaaagtggctgcagctctcagtattattgtgaatgaaaaattctggcctcatatccggtaaatcaaaatacttcaccctaactcctaaggcaatattgttgcctagaatcatcagcatatttggagaccaataacgcagtttgcatattacatggagaatgtgggtggactaattgcatccaggcatggggtgactggcttgagattaaatcaaaaggaatttcctgagtttgtgatgtaagggaagctcaagagactggaatactcaggaagtgaaatcccagatacaaggactgaaaataatcattcaagtggtggaaaaggtgatagaaagattgatcaatggcaccgagtttagtgggacatctgcgctgtgctccctctttggtttcctccctttcgtggctgagaggtttggtgtatcagtgcttcttcctcctcagccagaaagtttcagtttttctatattctgcccaccctcttttcttgcctgtatttgtccattcattcaataaagactcatttagctccaaaatattcattgaggagctaaatgtgccaggtcctggagatgcaacagtaaaacacacatatgcatatacccacatgcacgtgcatacacaatttgcacacatacgtgcacatgcacacctccatgcatatgaacatggatgcacacatggccacgtgaatccctctcttcttggaattgacattctagttgaggaggacagaaaatttaaacaatagtagtaaggaaaatatgtagtttgtttcacttgacgattattgtaggtttccccacaattttttttttcctgcctctgctgtttgggaggttgtgtgtccaactatttctattctttgaagaacttctagcctaattgcttaagcttcacagaatctcttcaaactgtttcttaaagggctctagttattgaataagttttgattcacaatttcatgaaaaaatttgtaaacatattagaatgtggtaatatggtttttctgtttattgtgctaaaagcaaaagtgtagaaaagtacaaaaaccatgaaaatataccttgtttgaagtaaataaatatgaacatgaaatatattatttaaccatgctggaggtcaattttaaatgaattctgcttttctctgggcttaaaaagaaaacttagtaactagtgggttgctatgttttatgttaagcaacatttaaattgaaatcaaagtagagtaagtacatattttaactaaaacaggtatgtctagttatggggcaagtaaaattgtatagcaatgaaattaaataaaaaacctatgaatattttttgagtttgaaatacaattggcagaatctgagcttgctatacatctagttggcttttaagggaaactgattttttaaatttcccttctttgattttggatcttgacttaaagaatccagattcccataaacattatacagaaagttctaatggtgccaggaattagaaaaatctaatttctttttttttaatttttttttatttcaataggtttttggggaacaggtggtgtttggttacatgagtaagttctttggtggtgatttctgagatttcagtgcacccgtcatccgagcagtgtaactatacccaatgtgtagtcttttattcctcatccctctcccactctttcctctgagtccccaaagtccattttctcattcttatgccgttgcaacctcatagcttagcttccacttatgagtgagaacatatgatgtttggttttccattcctgagtttcttcacttagaataatgtcctccaatttcatccaggttccttgaatgccattatttcatttcttgttatggctgactagtattccatggtgtgtatatgtgtgtgtatatatatatataca

SEQ ID NO: 131282 - DNA, 1592 bp, Homo sapiens
ggatggtttcaggatgaaactgttccacctgagatcatcaggcagtagttagactctcataaggagcgtgcaacccagatccctcacgtgcacagttcacaatagggttcactctcctatgagattctaatgccaccagtgatctgacaggaggcagagctcaggtggtaatcctcgcttgcctgtcactcgcttcctgctttgcagcccggttcctaacaggccacggactagggtcggtctgctgcccaagggttggggccccctgctgcagacccagtgttggtatatgcaaatattgcttgcccttttggagtctggaaatgttggccactgtctggtcattcacttgctttgactcaccctttctccacgtccttttctcaactttccctctgtggattagagccacaaatctatgccctcattttccagtcctgaaaatggagacatgtgacctggcatagtttttgttgtttcttccaggactgaagtaatctgggaaatgtagtttggctgccaagaatttggcctttcctagacacattgctggttgattagaacaacagaggagaatgttagtctgggaggcgtgctcacattcccagtgtagctcaggggaccctttcaccagataggactcacagacttctcaagtccctattgcgatgtggcttctgggacaccttcaacctctgtccctggtaagccaatggctgcttcatttcccatgttggtttcccccaattttctgggacctccacattaatacctactttcccgtttccttttaaatctcctggcagttctactgcttggaatgcattctacagatatacttgcgtagataagagatgacccatttcataatagcaatcacatctaacacttgctgaggatttacctggtttctggaactaagaattttacatatttttcatgtatttcattctttaaaaaactctgtgaggtgggactgatagtatcttcattttcagataaggcaatttaagcaggaagaaagtaaaatgtaaccaaaggtgtatttttttttaattgcagctgtggttttaataagaaaagattagaaacaatgtaatcaatgtgtgtctaattaaatacataatgctttattgccaataccataggatactgtgcagccacagaaaaatggtattgaatatcttcatataatagcgtggaaatccctccataatacatgaagtgaaaacaagtaagtctgtatataaaatgcaggctgggcatggtagctcaggcctgtaatcccagcacttttggaggctgaggcgggtggatcacctagttcgagaccagcctggccaacctgctgaaaccctgtctttactaaaaatacaaaaagttagccaggcatggtggtgggcgtctataatcccagctacttggaaggctgaggcaggagaatcgcttgaaccagggaggtggaggttgcagggagctaagatcacctcactgcactccagcctgggcaacaagagcaaaactctgtctcaaataaaaaaacaaaaaaaagtataatatgcataaattagctcaaccattgtggaagacag

SEQ ID NO: 131283 - DNA, 1027 bp, Homo sapiens
gcatgttttcatttgcttaattttagagacgaaggagtgagagccagttagttgccttactaacgatagaaagaatcaggccaccattctgctacaacaaatttaggaaaaggcttttattttgggtatgattacagtcagagcaataagggtgagttagaaaatggaacaacagaacctcctggggtcttttttgtgagaaaaataataatgttttggttaatgttagattgaatgtccattatgtgccaggcaatttacatgcatcattgttgcaggctgccctgagaggtagttatttttatcagccccattttaaagatgtggaaactgatagagatgtgatgtgcacagccccaggtcaaacagcagtgagacgcagagctggaatttcagccaggtgtctccaccctggaggcctgttcttagtgcactgtgctgccaaggctaaagccttttatctgggcctggtctctgtcctagagactgccttgtcgggtggccttgtggaaatctgctctttggcttggggaggcagacactgcaccagcagcttgttccatctagccttaggaagcttcaccttcccggacaaaaagggtcaatccaaaagtggcttttgacacctgtgccaaactaggaagccgcagtggcttcttcgggaattaggccttagccccgtggaagaaactctgtcctgtgtggtcttctgtgtgcagtggaaactttcagcaaggcttctaaattcttgatgatcacaggatcgctttgcaccgaaaactggcatctggcctgcgcttcattgagggttccctacttttggcgagagcttttgaaggcctgggtctgtgagttttcctttattagtaaatgataacaaagcactttaaagaaaggagacacgtccgtggtggtagttcttgctgtgtgaagaaagggagcactggatctgagaacaaacctctcccaagttggtccctggggctcctcctgctgctgctgctgggagccccttccttgcaccagt

SEQ ID NO: 131284 - DNA, 2196 bp, Homo sapiens
tttataaggacagcagtcaactggattaagggccctccccactccaggctggggtgacagctgcaacaactgctttttcaaataaagtcatatgctgaggtgctggggtttaggaatttggcatatctttttgggagacacagttcacccataacatctgcattacccccttcttagtttagatgccgtcttttctaggaactcttctgccgtgttccttcccccaacatctggctttgatgtccctcttgacactggaactctcttgtcatgctttctagcatctctcataattgtttttttgtttttcttctctgccggactctgagcaatttgatgtcaggaataatttagggtattttagaattttttttccaaattattagaaactttagatcgtggaattttggatacatttatgcattttgatgtaacctgaaatatttgtaaccgagtcatggtcttcatgttcattttgcggggaagaagtgatacctattggtaaaagaaaaggcttgggttaaacattaccccctctctcgagtttctgtgatcatgacaaacatggattctaaatccttggcttgagagcacatgaattgccgagcagatgtggcgtcagcgcttgcaaggctgtaagcagcttactgatccagcagtttaaagactgtttactggcagtggcaacattacttctggttgcctgtcttaattcattttagattaatctgtcttgcagttcgaaggaaaatgaattgagtcagtaacttcaagagttatgtaaaatctgtacagtgctaaataattgaatggggttttatgtatggtctttaaattggaatgtcaatttgacacaaatgctccaaaacagagtgttagatgagctgatctgttcctcatataaaagctttgaaaattccattcttgtatcactctggaattcaccgttcccatcccttgcagaatattaatgttaactttggggaaggtgagtctgcttgtgtaactcttgggcctggggttgaggttttagggtaatggtacccaaacttgaacgggtttaagaaccacacgaggagtttgttaggaaggatgcttggctgggcatggtggctcctacctataatcccagcactttcggggctgaggcgaggggatcacttgagcccaggcatttaagaccagcctgggcaacatagcaagactccatctctatttaaatttaaaataaattaaaaagaaaaaagaagaaggatgctttctgggtccagctccagaaattctaatttggttgttctgtaactgggctcagggaagtcctttggcattacaggtggttctaatgctgacattctcagaccacattttaaagaaataactggttgaagggatgcacggacatgagaaggagagtatgtgaactcctgagagaaaattcaagactattttgcataaaatacatttatcacaaccaggcagaccaaaaatgacctttttgggtgggataaaggggatattttgcagacccaaagaaaataaattcttgagattttttcccagaaatccatgggaggaaggctgaagtatccttattcttatcagaaaacatatttgaattttattaccaatatctttaaccccattttgtagatgggaaatctttgaggctcaaagagcaaagaaggctaacatttgttgagcacttaataaatgaaactgtcaatattagtaattattatcgccatcatcattatctttatttaacctatagcacagccctgtgaggtgttatcactgccatttacagatatgtaaagcaagattcaggcagttcagataactagctaggattacacattgagcttgtagtgagccaggattcaatcgcagttcaacttaactccaaaatccatattctttttactgcatcaaggtagatttaagatctttacatgacaagagttgccaggtaaaatgtaggaggcccagttaaatttgattgtcatataaataatgactagtataagtatatcccatgaaatatttgaacatacttacatttaaaaatagtggaccatagtatactagaaaattcgttgtttatctgacatacaaggttaaccaggtatcctgtattttcatttgctaaaatcaagcaaccctgtatgtgggtagtgggttttcagattgtatgat

SEQ ID NO: 131285 - DNA, 1641 bp, Homo sapiens
tgcaatgaccctatttccaaataaggacatatttggaggtacttggaggctgggtcttcaacttatgaattttgcagaggacacagctcaactagtaacatacacctatagatctgtctttagtggatatgtatatatcacactgttctatacattggagaagggtgaaaattaattgtaagaaaaaattgcttgtgcaatgaatagcactataatccccttcttgacagttaagggaatcattctggaaagcgaaattgctctgagccaatgtgtggaaaattctgtgcaagagctcattccttttgttgcattttttcaaagattcttttggcagtgctgggctcggtccagatgccttccacatcaggtggtttaagcatgtgtgtacatgatcgtgtgcagggttgtgggaagccaattacggttggaaacagttgtttagctggcaattagattcctcacagtctcgaattatgttgctttaaattaagattatgcagatttgagttgctttgataatttgcaaaagccattttggggttataactaaaaatgtaatctgccaattaggagattttctacctgatatctgttttgttcattggactgtggacccattttaaatatttatcatctgctttctaaaccaatggcaagagtgtctgcataccagtgtggtgaggggagatacagtggtggaggggagatacagtggtgaggggagataagtccctgaatcagacttagctttcttgaggactcagtgctgactttgttactgtttactttagcaactcaggtaaaaacatgcgtcaaataactcttttgtttcatataaaacctgaggttttgcaagagacaaaacctcttaaaagtgagatttgttgtttaaataagaaatagtgttctattattaacccaggccagctgagacaagctttttaattagcctaaaaagagaggataatgtataaggagaatgaggtaggttttacttagtaatgtcttggagatttaaaaacttatcctatggtgatcagattcagattcaagcagactaacggatagcagtattttccgttcaagatgatggacatcttatctttataaatgattataccggtccgtctgggagaacaagatgctaaatgttacatattccttccttctttcattggaagttcattggaaattttatacacgtaccatgcatacagagaagttcgtgcatcacaaagattcaactcgataatttttcacaaagtgaacacgtctataaccagcaccaagatcaagaaatcgaatgtcaccagaactccagaggctgcttgtgtctgttccagtcactgactcagaattttgtgatggcatggaaagcttggcttgttgtctgccggcagtgagtattgatgattttgggaacacgtttccattcacagtgccttttcagttgtaggttagtttttactgggagcagtttcatgcttcttgttcattctgctagagactggggttagctccttagagttaagccttttggtgagcataatgcagagcagaagatggcctttactgcagccgggacaaagtcttccaggtgctgcctgccttcctctcttcccaccagactaaattctt

SEQ ID NO: 131286 - DNA, 1134 bp, Homo sapiens
aacattgatttatagaggattatcatagcatctataacgtgttttaaataacacaattaaaatagttatgattttacataataggacaagatcgtaatgtagtgcaaccactgaaagtgaaggtatgtaaagaccagagtcttttccctagactactagaattagtagttccttctaattctagcaaggctgaaaacttgtaaatagactctttagtagtgttagagtgaactgtttacattttatgtgtctgtaggaactgaggccagatgggtcgattgcatcctctagtaatttccaaatgaagttttattaaaatcctttccagacaagcatttttataagaatgactaataaaaccccaaacacaaattttaggttctcttattttataaaaacatgcaagttgcttctgaagttattggaagaccagtaaaataataaatcagtaaagatggaagaagagcagagactttgagcaaccccaaaataaccaggggtgagcaacattgctgggcatcttttgcacattgaactgctcagggctctgaaacatgagactatgaaagaagcattcctcatgcaatgggtttattgcttggttatttcaccaagcaccatttattgaaaggcagtgttcctggtggctaagagggcagagtctggaatctgccaccaccacttaccaagtgggtaactttggtcagagttatttaagttttgtctcagttcctccaacaataaaaaggggatgttgacaatacttaatacatagcgagtgcttaaaattgtgtgtgacacacagaaaacttcattctgttcaggtcaccctgtgagcattgttgggtatggtgggaaaagaaagacactaagatcttagagatgacttcaaggttccttttctggtccaagacgatgtacgatgaatagtcacaggaaatgactcttttctgcgatagaatctggacccaccatttaccttgtggttctgctcactgtttagtgctgagttgctaattttaatgattcttcctgttttaagaagcatggctctgagtcgtattctctctctctgcctgtctttctctctgtccacaaacacacactttttgagtacaacagcacagaagacga

SEQ ID NO: 131287 - DNA, 1124 bp, Homo sapiens
actcagggggctgaggcaggagaatcgcttgaacctgggaggtggaggttgcagtgagccgagatcgtgccactgcactccagcctgggtgacagagcaagactccatctcaaaaaaaaaaaaaaaaaaaaaaaaaaaaagaatatatatgcgcccggccaagtatatctttttttaatatattgcctccccctgcattaatttttttcttgctttcccagttatatatgcatatatataaacttcacagataccaaataggttattgctcataggtaatataatttgtacctgatgtaaaggctgcaactgaggtttcactgatggttggtttacctggaattttgtgagttggaaggcttactgaaatgaaggaaaatgcttatgtatgacccagctctctctctacgcattgaccaaaataggttgatcagggcaacagaaatgattaataggatagtgcagatttggataaagagcaaaaagattaggatttgaaagttggaggatgaagggagtcatgtaggatatagtcaggtggaattcggacttgctcacaaaatcccagaatactgtaacaaaagggcacttctttatgctagaaggagataatttcactttaaataaagggaaatggaatgtctttgcccagaggataacaagcaaatagaactcattttcccgaagaacctgtgtagtctggggtgtcagggatgtgtgttcaagaaaaatttaggcaaaacccaatgatagcttctcaagggtaagtttcaaacattcagacaatatccctaacccttgagtgaaccatcacacagggaaacgattctgttgtacagaatatgttttgatgccactgtcagacataaagtctggtgggaactggacttctactctgacccagggtgacaatttttatgtttttaaaatcggccgtcttccagaagtgttcattttacagtgcttatatctcagtacctgaacttctgcagaagagttttatttgagtcataaatttctaatgtcaaaacctccctgacaattattagccaaatgtttagcccaaaagagagattaaaaacatatatcttgtaacctagctacccaatgagttaacccagaga

SEQ ID NO: 131288 - DNA, 1187 bp, Homo sapiens
cctagtgcggtttgttttgtttttgtttttattccatgagccaacattctttggctggaatgttggctctccaggtctttggctgaggtcaaaacttagaagtctgctcctgtactttggagttctcctcctcatggtgaagcccacagcggtgagccaggagtggatctggttccttcatctgtagagttttgtttttgtttctttacctaccttagtcctgtgtctctttctaggtcagagaaaacttcttatagcaaatgactcctgtcccttcccactctgacccccagtacagtgacagggaattcctgcttctcctagcttgtcctttctcagtttctttcctcagaagcaaccactatctgcagtgccttttgtctctttctagatatacttcatgcatagataaggattcatacatacacgtacatagaaacacacatataaacacagacatgcgaatatcaagatatagtttgaaatcataattctgaactttcactctagtgtttaaaacacatcaatatttaatatctcactgctgctagttggatgaaagatgaccattttatcatgctctacaaggatcatgcctcctgtgatctgatttccctccaactctccagcctcatccagcacttttctcctctttctcagacctctaggcccacttcctgttcttctgttaattcctcaaacaagccttcccttgtttcttatattagctgtcactctgttacattctgtagtttcttgactgttcatttagggcatttagcacagtttgtaagttccatatttgtgtgattatttaaatagcatctttctgcctctactgaactgcaagttccaagaagacagaaatgaagctgtttttttttttcttttttttaaagctgttttatccctagagtctgtgcattacctggaatataataggatctccgtagatcatagttgaatgaatgaaaaacaaatggctggctggctggatgaatgaatgtatgatgtagaaacttcctttgggtagggaggaaatgctaccttttggaaaacagttgtgttttagtatccaaacacatgttttctctgtagaccttaggtattttctttttgttgtttctaaccattttctaagaagtcagttattctagaaaggctgatcataggcaccgtcaaggaaa

SEQ ID NO: 131289 - DNA, 3133 bp, Homo sapiens
tttctttgagatggaatttcgctcttgttgctcaggctggagtgcaatggcgcgatcttggctcagtgcagcttctgcctcccaggttcaagcgattctcctacctcagccttccgagtagctgggattataggcatgcaccaccacacccggctaattttgtatttttagtagagacggggttgttggtcaggctggtctctaactcctgacatcaggtgctccttccgcctcagcctcccaaagtgctgggattacaggcatgagccaccacgcccggctggcttactttttttttattttattttttcctttttataattgactcatttgtcaactactcatatataaatataatatatatgttagtcatatgtatataatttatatacactagtgtcatatgtatatctatatatgtatatcttatttcatttggaaaaattagaaactaccaggctatcagacacccacctaaataaaacaggaagattcttatattctataaaaaacacagcatctggtgaatggaacatgttggaatttctatcaagaattcttttatgcatcaattttctagaggtatctggtgtttttccaattaacctggaaatatgttttggaaagaatttatttttcctagaggccagatgcgtccttgccctttccccaacatggcccttggccaccagtggagtgttgggagctctgggaagagagcggctgccgcagacgtccaggcatgggcactttcgccatctgtcccgtgttgtaggttttcattgctttagttgttatcctcaacacaagggcctttaggggctgggaccacaactctgcctcctattctcccattacagctgcataattagttgtaaaacttttacttgtaggtgaaaactcattttggcaaccattaattcccactgtaattcatttagtaactgcagtacttctattaatgggaaagtaaggtcaagcatcaagcagcatgactaatatgtgttgataattgcatattgttgataactgtaaactctgagattgcactaataaaaggtaataattcccaaggcaaccaggaagggaactggggagcggctgcaaatttagcctttgccattttgccagttgtttagcgtcatttacgttggtgggaattctagtgctcataatgcactggaagatttttttctggactacgtaagagtaattggagattgataatgtgtcgatatgggggcatgggaagtgactgatgctggggcagatggtttctctagacaattgctaagagggtgtgcaagaaagttgcagcttagcacaagcttgtgtggtcaaaaagtaatctgcttgctctttggacccacattttatgtaagctgatactgagagcaagcacttgtagagagagggaggtgtgaagatagtccaaagacttgagctagagtctggctctgccatttaggggaatgcccttgagccagatctgttaaattcattgagcctcagtttcttccacccttgtagaatgtagttattcttgtaaagctgttgatagcattaaatgcgattgtgtgtgtgtgtgtgtgtgtgtgtgtgtgtgtgtgtgtgtgaaagaaactgatttggaaactcgaaaacccctctataaacaggaacctggaagtctgtttgtcctttcttaattttctgatgatacaaatagatatatcattgtaaaactattctgtgtacttgagtttctttcaaaacactaaccctgagtagtgcttgcaatttctctaaaaagtaaattatcacagaaagtcagtttatgacccattttctggggctagaactacctttctttttggggatggggtctcactgtgttgcccaggctgggctcaaactcctaggctcaggcaatcctcctgcctcaggctccaaagtaactgagactacaggcacatgccactgagcccagctggaagtaccatttttggtaactcagattcctatagctgtgcatggggtcattaccttggacaatctgatgcctgagaagactctgttttgtgtttccaaatggaccatcttatggaccatctttgcttggaaaaggcactgtccagaatgtgtggctaatggattgttgaaggagctggacatggcccaggcagtccggtgaatcagtgactgatggttgtttgtagtagctaatgctgttccctccccccaaagataaaagaaccaaaaaaccatcaagtggcttgatttgactatagcagcatttgtgacagaactgggaaccaaatgaaaatcaacttagtactactcttcaagagattttttttttctccagaggcttagcgtaggtcataccccagatgttgatgatgaatatattgattgctatctcagggcgaaatctcaaaagtttgtgttgcccttttaggaatttcacagtttatattgacctataaccaagaggcaggttcattatgtttaattgcattaaaagataaaagaagtagagaaattgaaaggaaaaagagcccagagattgttacctttttatcaagcaacagcatgccacaaactttgcataaataaaaaataataacctgagcctttcatcttgggaatctaatgaaataaatgtgtgctgttttccccattagccctcaccttagccagcccttacattgtggacagaggagtgatgtcattatttgtgagctagatgactggctcagtaggtgccgtgtggttcctaagaagattgtaggtcttgccattgcgtcttgtgtctcttgctgtacaggtggaaacatctgtgtgttttcattatggtgaccgctgggtaactggtcgccaacctctgtaactgaagaaacagccctcacaatagagtacactcttttcccatccagagtgtggcagtccttttctgcgtgagcctttgtctgcatttttacctcttgcaaaccctcctccagccagagattgatatgcctggatgatttatggcagtgattgtcagaaacttttgaagcccatccaatttcaggattcgggttctcatttcttgtcatttatggcacatttgatgaattctcactatcagctgacatgtttcataattgtc

SEQ ID NO: 131290 - DNA, 1327 bp, Homo sapiens
agaagggggaagggaagaatttgatcaccttaaaaggacctttagaaacgtaagagtgaaagtgaaccaagtatccctttttgtttcttcttcagtgttttcactcctcctcctctttcctttggaaggggaaaagcaggaaagaggaattacattttctagaaacagaagccaagacctcaagaagcctctaactggccaggcacggtggttcatgcctgtaatcccagcactttgggaggctgaggcgggtagatcatttgaggtcagtagttcgagaccagcctgaccaacatggtgaaaccccatctctactaagtacaaaaaaattagctgggcgtggtggcacatccctgtaatcccagctattcgggaggctaagccaggagaatcacttgaacccaggaggtggtggttgcagtgagctgagattgtgccactggactccagcctgggcaacagagtgaaactccatttaaaaaacaaacaaacaaaaaaaaccctctaatttctctttctaaactgtagacctggtatctagatgagtttattcctgataaaagcatacatgctcctaggaggtttaattactatttatatggtgtacgcacttttcttttcagaatactgttatttatttgtcacttcagtgtttcttttcccattgctcttctctcagcctcttgtgtcagccctgcccaggctggcttttatatccttagcctttttttttttttctaagtatgggaaaacatagtttagaagtaatcccttctcacaaaatcacctctctcaaccactctgtggttattttatttgagggtggtggaaagagggagatgtttgtagagcctcagagagaaaagcacggttttaaatctaatcattatcagagtgagagctaaatacttttgcaaccttcatgagagatatccctgggaattttctggataaatatcattctcaagttttggcagtgtgcagaatttaggccacccacattgtatggggcataaaactgtttagtgaagttcaaataatgtgttgcaagagtttggttgaacttgtaatttaaccttgaggaaagcaaatacttgtgggaaaatatttgtgctcaaaatcaataaggaatgtgcaagtaggatgccctcactctgagagctgtagtttgcagctgaagctagtacaaagtggcatttgtcagtagtaagtaaaacgagcaaagtggatgggtggcaagactttgacattattggcctatcacattcagatcaagttcatctgcagatgaatagtcactaagatttgttaagtgtttactttgtgc

SEQ ID NO: 131291 - DNA, 2170 bp, Homo sapiens
ctgtaggtcatcagaagctctgtgacttcagatgtgcaagtgaggccaaggcactgtcacattaatatctgtgtgatctcggtggcattgtgcttttccatcattgtcagggctgctgggctctctgtgcctaaaagctgcttcaaacaagcagctcacattccagagctctgagagatgttgtcagcctttaacagttttctcttcgagaagacattagattctgtacaggttgcagaaacgttgtcttaaggtggctggaaggaagtgtttgaaataacacatgtgcttgtgattttggtaaccaaggaaacatgtacctgatacaaagcttcctttaaaaaatgatggtacccttctgggattgcctcagaatcacccacagcaagattccaaagggatttaaaattaaagtaggtcacttccagcaactgtatcaagagttaacagagaatcacctctttaaaaatgaagaatcatctctttaaaaatgtactgtttagaagaggaacccaatacattgtggatacaatatgctaccatctgaataatctgagtcttgcttataatggatgtttaataagtcttacctggattaaattttcctctgcttctgccttattatttgtattatttttattcttagtttgccttctattccaaattaatccttagcttctcgccatctcttttctaacagtttgttattaaaattatatagtgatggttaatgcagccactacctgtactttgcaaacagattttgctaatacatccatgatatgtagaatgatagaaactggagttgacttagaagataatcatatccaaacttttcattcaataaatgagaaactgttgctgggtgtgatggctcacacctgtaatcccagcactttcagaggccgaagcagaaggattgcttgagcccaggagttggagaccaatcagggcaacacagtgagacccctcgtctctacaaaaaccaaaaaattagccaggtgtggtggtgcacacctgtagttccagctaattgagaggctgggttgggtggattgcttgagcccaggaggtcaaggctacagtgaactatgatcatgccactgcactccagcttgggcaacagagtaagaccctgtctcgaatgaatgaatgcatgaatgaataagaaactgaatctttaggaatagttacttagagtcctagaagtctgacttaagtctgacttaaatcttaagtaagttaagagtctggcttaaatctgaacacagtatgtacattttagtaatgttctggacacagagacctgagccttggtacagattgtgtggtattattaccaacaccgttttaacatttatgttacaaaagacttctgcatgttggacaacaggaaagaaatacagtacttaactcacaaacaacaaaaggattaggacagtccttctgaaagcaggggtctcaacatcaaatgtgacaacagccatacaggctttacaaatatgtagactggcctagtataagagaacagggagtgggcacatatttagcgcattgcaatgggcataaatacctgaagttacttgacccgtggaagagcccttgacagccagataggcagcaacccctttcctagtctttgttgtcatacactgtaaactgaaattgtgctgcatttttttaagtggtacatttcataagaggttgaagtgaaaagaatgtacctagaattttcacctgggagaaaattttattcctgattcttggttatctataaaattatatacctggggataaaaatttcagtttagcttaaaacttaaattgttggccaggcgcagtggctcacgtctgtaatcccagcattttgggaggctgaggcgggcagatcacctgaggtcgggagttcgagaccagcctgaccaacgtggagaaacctcgtccctactaaaaatacaaaattagctgggcgtggtggcacatgtctgtaatcccagctactcaggaggctgaggcagatgaattgcctgaacctgggaggcggaggatgcagtcagccgagatcctgccattgcactccagcctgggcaacgagagcgaaactctgtctcaaaaaaaaaaaaaaaaaaagttgttaccctctgtgaaagacactgtgaagctttgatgg

SEQ ID NO: 131292 - DNA, 1058 bp, Homo sapiens
tttaaaagtggaatctaggagtgagttggaatttaggaatatagatttggaaaccacagatacatgaaaaaaaaaaaaaaagactgagatacagagaaagggaggcaagaaacagaatagtaaaatgggtcattactgcctaagtgtttttgtttgtgaagcttaatgagctaagggctcattcttaggttacagtagtggaagagagatgagtaaattatctctgcaggtcaaagaggttatagaatctgttctcatatgaattaatcaaatttaacttctcatgttgaaaagtagacaactcataaaggagctatcatgtaaacctttttttaacttggaagaagtccaaatacagaatacttacagattgaagaaaaatgttcagtttagatttcaagtgtggtcatttccatagctatgtggtgaaagaaattgtgtttccgaaaatcgtgtttccgaagaggctatgtttttaaaggtgccactgggaaactatgactattatgagttttgcagttttgacattggatggggtgtgtgtgtgtgtgtgtgtttgaattgagttatagaacttacatgtaaaattattcatctgacttccggggaaaagtctgttttttttgaaatacctttttttttctatttattcctttaattattatacattagaaagaaatgacaaggattgcatcctagttttaaaatgctgaacttttaaaaaggcaattttatttttaagactttaaataactcttattagtaattggatttgtggcagattccaagagggtggttttggaaagcacagtggcttccggtggcttcagaccttggtttggaattgcaggcctaccgcacaccgactctggagagtgacttggagcctccaaattccaagcttcctgtgtgcgagtgaggctagcaaaccacattgagtaggacagcctgagggttaagttacaccatggatgaaaagctgatgcatggttctaacttgcccgggcttgatattcaaaaaatgtctattccttttccattttctctcttttccaaaa

SEQ ID NO: 131293 - DNA, 1888 bp, Homo sapiens
gggggtcctcatttatgcagctggccagagctcctcatccaacccggggcttagtgaggtgacagatgtgatgttggccaatgtagtcttccttttctttctttttttttttttttctgaggcagagtctcgctctgtcacccaggctggaatgcagtggcgtgatctcagctcactgcaacctctgtctcctgggttcaagcgattccccagcctcagcctcccaagtagctgggattacaggcatgtgccaccacgccgagctaatttttgtattttttagtagagacagggtttcgccatgttggccaggctggtctcaaactcttgacctcccttttctttttccttccttccttccttccttccttccttccttccttccttccttccttccttctttctctctctttctttctttttcttgtttaaaaatacatctatatttcctctagcttgtatataaactgacctctgctttaagtattagctatttattgaggaacacgatgcatgggccagacactgtgctaagggcttcacctgtaatactcggtatagacttcttataatatcctatgggtaagatactattattatccctactcctattgttttggggcaggcaccttatccatttgtttgctgctgtattccccatgcctcaaaaggtgcctggcacttactaggtgctggattttaaatggattaatcacatgcagagtaatttgaccaagtcatactggttgtatatgggagttggagatgaagactgtagggtttcaaagtctggactcgttaccctgcaccatctctgctttctgatgcctagttagagaaagaacgtcctatctgttttagacttgaggacttctttttaatgactttttcagacttgaggactcctttttaaagttgtagactgttccacctagatccttctggtcattctctactttgttgtggataaaaattttataataaattaggtaatgtttaaaagtggctttgtattttgtacatttgcaacaatgtgtgtattaacctctcctaattccatctactggcaaagcttgatttgatgagaattgggtcccctgcagtaatgtgactctgaagctgacggattagagagcttgtggttcaggcatgaaccttgtctcttgggttggacctgagtctagactgaccctagagttggaaatttagtagcttaactgacagaactgacgtgaacaattgctgctttttattaaacaagggcagttcatctcattcgcaaacattttctaagaccttgtgcaccaaatggtgagaaataagaaagttccctgcccagggagcttattgcctgctggaggagataaaacttttggaaatggggtagaatgtggtaagtgttttaatagaagctgcaggagcttagctgagggaggagatgacctttggatggtgtcccacagacatatcagtggtctttggatctagaaggaccccactgttgtctgccttgttgcaattgtagcatgggtgttcttgaaggaagcacaaaggaaatgtccactgacagagttgaagatgacactggcccagtaggtttgctatccaatttatggaagcaaggcaaaaacatagacaaagcacaggagataatgaaggtgtgaaacatgttcaaaataatcaagaacccaaacagatacctcaaatttcttcccaccccatctcccaggtaaccaaaatagctacctggttttttacaacttttcatcactttaaatacacttgggattcccatttctgagaaacaaagacagaggaagagagaattgcaaaaggcgttagtatgaatctgtggtttgcggactggtaattaggccagcaggctttt

SEQ ID NO: 131294 - DNA, 1368 bp, Homo sapiens
agaatttttgaagggccaattaagatcacaactctacacaatgagctgatgtaaataaggtatatattgacttttaatagacttaaaaagagttgatgagatcatggaaagctccacgtggccaatattgttattattctgtagatggtatttcttggaaattttgtttcattccctttctggaagtgagttggacttttacctgttttttggcatagatttggtctctcctcctcccagtagtggaggtgtaaggagtaaaaacttttcctagaaataaaacataacaagcacttactgagtgcctggtgtgtgttcacattgtgtgaggtgttatgactgcagaatgagttttccataatcactgtgtctgcattggagttggaggagaatatcttacacagagctcccaaatcccttgcaatttcctgggtgatcaactatcttttgttctaatgaggttacccttagtggacatgatgctaaggcagcatataaataagtgagggctcatgtgatgtgggctgtgtaaatgtgccaagatacttcagtgtgagaaaaaaagtcacatgtgatggcattagtctgtggaagcttcgtggagaaaactctggatagggactttggaagtgtagtttttcttggctgagtaggtctctttcctaggaaataattctgtcccattccctgcaggtatcaagtttggattttgatgaataaagtgtctcttcgttttaaaaatagggcactgaatcgccaaggcagtggcatacagggtagaacttcgtggccatggcccacgtggactgtaatggcttcaggcatttggttttgcttcacacttcaaagaactgaaaagtgaaggggatttatttattcatgaaaacctgccccacacaactgctctgtgtgcctggaattcttgttgtgggtgggcaggctgatctggtgagaacagtagtggaaagaggagaggaacatttcctccctaggatggaagtcccatagagcacgcatttgagactgctgagttcattgccatatgctagcacattaaacagagtgcgccatagagttggggctcaaaagtttctttgtaagggagtgagataataattgagctatgccttctgctcttaatttggtgttaggcatacaagcagggtaatctaatgacagaatgaacataaaacaagtgagactgattcaacagatgaggctgtgttgaatgtataggtgggcagaggtgagaaggagcaactgtccatcttggagttcaggaaggttttggacatggtgttgtacgaacttggtctttaagtatgaatggagatataagttgaatggaaatataccaggtatttcagg

SEQ ID NO: 131295 - DNA, 1044 bp, Homo sapiens
gctgagatcatgccactgcactccagcctgggtgatggagtgagactctgtctcaaaaaagaaaagaaaaaaaaaagacatccagtccatccagagagcccgggacccttatctagtaagaaggcagctgcaatagaaagaggaaggcatttggtgtgaggactcagatacgtattatgtatatgtggtggcaggtgggaggagggtggtgatggaagcttctagtcttggtggtaacattcacgatggatgacatagaagaggctgattgttaaagggaaaaggatgatgaattaggttttgggtaaagttatattgcagccttcattgcaagcaatgcagtgccacattctatgttgttaatacgcacatgccccagattgcacatttggggatgagggacctctctatatctaacttttactggtttgagagcgtgaatgaagaaaggctcacaccactgctaccatcccatctgtcttttatgttgaacttgtgctttcttcccctagtttgtttaggtctaagtagaatactttgcataggaaatcgataaatcttctattgctgtttgagtgatggggcagtttctttattaccagacagttctgcgagcaataaatatttctaatatcctgagtatatttatttctaagtgggagttagagtaatgagacatttactaacgctgggctcgactcagaattcagaaacagaaggtagatgactggcaaggactgttcctactctagagttttaaggtcattagaaagcttttgttttgttgaaagcactgtactttgtgtacgatatggttgagccttttagaaggttgctgagacttacgtcttatctttgcttatatagtatcgactagaggttggcaaactttttctgtgaagcgccagatagtaaatgctttaggttttgcacatacattctctgtcacagctagtcaacgcttgtaagaggatagcagctgtagacaatatgtaaacaaatgagctatgttccaataaaactttgtttacaaaagcatgcggt

SEQ ID NO: 131296 - DNA, 2514 bp, Homo sapiens
tatggcttgtaaagcccaaaacgtttactctctgactctacacagaaaagtttgccgacccctgctgggaggcagatcgaaaatgaataatcatcagtaatagaaagagcacagcctttagaatcaggcagtacagagtccatgttatgtcttggtttcctcagagctgcaactattacacattattattccaccttagaaggtttgggtgaggacgaaatgagataatgagtgtaaagcatctatacatgtatagcatgctgccaaatacctcacagatattcagccagtgctggtatctttccctctccaggttacaaatatttcgggttcattgccttacctcaggtcctctgttcacacagaactggagtgaaaaataccctttgcaagtctgacaatagccggagagacaaaaacccatgtctctctctctctaccttcctttatttagtgtcttttcctccataaactggtggcgtttagccctgtgaaatgtcattttaccttaaggtgaatgggtatatagaattggtcttgaccttgaataaaagaaggacacaccaggcaatcatcatttgggggaacttcagagaaattgctccatgagagtaacacagagcagtgacttctgctggaggggttcacaggtgacattttgagccctgtgcagcctgtgcctccgagacagtcagcgagggagccctggcggtcgtggggctgccttcgccagcttcagaactgtggtttttcccccattaacacacttcttgttaagctgatgtggttgctttctaaactgaatcttcccttggccagaaagaaagaaaaagcttccctgcgtgaagatgaaggtttattggcaatgtcttctttagtctcttagcaagaacagcaaacagagaactcccttctttctgacttaagttacacatattttttttctcttttttactttcaaagctggcagcctcataagagcagcattcaaatagaccgtgccagggatgcagggcaccatgaatggggcatttcttgtccttctggccccctttccctttgtgctgtctcttttccatgtgttattagccaccttgcaaagtcggagctttgccaacaaattctgggttctgtgggttgctgtctgaatctgctgcttattcaggaaaatgagttagtttctgctgtttgtagaaaaaaatcaacaaacccacttataggttacatttaggttactaatatatgtggtagcacagctaagtaaactggagattatgctgatgctatgtgcttattattgcagtgtgggttttaatgtgaattttgcacaaatccatgaatgatatgcccatttgcctttttaattttcttgctgttaaaaaattagcttattttgtagccattgaaatatatataaagaaaaaattaacttctacctgttttttttcttttaaaaatatttttatgtgatctaaccagtctgaaatagttggctgtaaatggatgtgggagtgtcatttcaaaccttttacaatttgggatttcttctggggggagtgggtatcagagctttagttcttgttattggcttatgacgatagtctggaattttatagattgtgtttggctgtcagcatggtgcttgggtgtgattaatttgtgtagcttgccattggatagataatattcattccttggatccttgttcagaagggattaaccaagtgaactggaaaacatgtctttgcaggagagctttcactgtttgtgataatcagtgaacaatctagtgctaatttaattccactcatagatctggctgactcattggctcttaatgcttcttaacttctatatttttaatcttcagttttttacacatatacaaatattatagtagacatagttcaaaacttaacatttctccagggatcttgctctgggaatgcaaagtaaataccctctaaaataggtttctggaatgttgtttttctgatgggtctgttatttctgcctttcttctaatgggaaaaaaaattgatttgaaagggtaaaataaacttagcttttttggaaagggagggttaaaataaaattaacaacaacaacaaataaacaggtgataccttagagacctatctggcataggacttttgaagcctataacatggctttgggttttggtattgatcttttatagggctaaataatttatagccaggcttttgccttgtgggatggttggagtgtgtgttccaccaggaggcaaaggtttctgttcaaatcttcctgttcacttgatttaggtgtttgataagtgactgcaaaatggagaggtcactttaggaaaggtttctctcttcttgccctctgttgcctttgagtagtttcctcctgtgttttgttcatctgaacaatgcattgacttgccctatgtaggaaggctggagagctgcttatgaattgtagtaagatgtcttatggcttccagggagcaaacctagggagttccca

SEQ ID NO: 131297 - DNA, 1038 bp, Homo sapiens
taagaattttttgacagtctttcctaaacatttcaagttgattgacaaaagataacaatccatcatattgcctactagccaatgttttgtggtgccttcacctctgagttctaggaagtggttttaatcatgtttgcgttcagctccccttcccatttattaaagattggaaaatgctaaggtttagttgacatgatgaccttaacgtaaaagggcatgaagagggcaaagactcccagcttctaagtctagttcatctgttactctcaaaggtgtctttgacacttagaaatgcttccacacccttgccgacttttactttttaggaagtgtgcagtatggtaaccccctttcaaaggccaatagcaaggccacgcctgacttcaaaatgaggttatgctttatgctggagatgcacagcagaaaacagtagtccagccaggtggggaaataaagccagaagagacagtatattttcaggagcaatttagtgcttgattgatcttacgatattgttagcgtagtgtttatagctgattgggtttacctgaagcaactgaccagcactccgtgtttggaaacagtcaagggagaaaacacattgattagttggtaagttaactctgtacctccatactctaaaattagtaaatcagcctgtcattgacagcttggaaagatgttcctgtgtctcactgatccctggccagggttgccaggactttctctttactttgtgttttccctggcccatcaattcttcttcaacttttgtgacttttttaaaactggctttattcaatttttgtttaactgaaaggcacaggatgcaaactgaatttataggatgttttatagcgagaataaaaggataaatttcaaaatcatatgctaatatgtaaactgaatttactcaaaacattccttttgttttgtttttttgagataggatcttgctctgtcacccaggctggtgtgcagtggtaccatcatggctcactgcagcctcgacctccgagctccagtgatccacccgcc

SEQ ID NO: 131298 - DNA, 2740 bp, Homo sapiens
acttatcaaaatatacagtttaccaatgtgcaatttatcgcatatcaattatagctccataaagctgttaaaaaatttatatatatatatatacatatacatacagtaagggaaggcaaggagaatgacccattaatgtgtgggagtaataaaagagaaattgtacaatgagaggctcactctcagagcggcctcggaaccccagagaggttattattgtttgatcagtcagtcaacaggtatttattgaaattcttccaggtactttgagagaatgagagatgtatgtgagcttaactgtgcctggtagtgggacccatttggaaagagctgggctctggagttagtctgatgtgggtttcaatcctggttttcccactccttgggttaaagcttttgaactcctttaccttctcttagcttctctttagtcctagggaaaaatggagatggcagtatctttattttagggtcgtttgaaggattagcaataatatgtatcaaatgcttggccaaagtgtggggcacatggtaggaatgcagtggcagcgattattatcatcactttaattgcaaaactggaagttcagattccaggaggaggatgtagttgctgtggactggccttctcaggcaaaacttcacttggaataggcttggaagactgtataggagttacatgaagtggaatggtttgactcaaagtgcagaaatgggactacataaatctgttaggtttcttgaggaagtaggggagatcaggtaggggaagggcaagaaatcctacttactaggaaagatggcttcctagctagtttggggcacaaatactcaacagaccattgctatggtgaaaatggtagaaatgagaagagcaatggagggaggaagacctgtgtcatgaaaatacttatctgactgttcagcattattgatattgtggtctggatgactctgtgtcatggagacttgccctgtacattataggatgtttaacagcatccctggcctccacccactggatgccagtaggtagcattcttcacccccatacacatgacagtcaaaaatatctcctgactgccagatgtgccttggtggggtcactgaagaccactgctttagtaattagactaagcatcagtgaagatgagattttcatttcagtgttggaagggagaaaggagtggagttcatttaaaataatagaatgaactgctctaattatagaggtgtagcagaagtaacatggttcagagcattgacagcaaggccacttataagctgtatggtctttggcaaataacctgttgtacttcagctccctcatgtgtaaaatgggggcaataattgcacctaccttaaatcagtaagttaaattgtaactgaggccaccgattatttgcttaaagaaaacagcattactcctcctttattggaaagactttgaagaaaaggggatcttcctgtctctagctctcttgagttgttttttaaaggacccatcttttgaaaagacccgttaaaaaattagtcagacatgaggctattgaaagatcaatgtggaaaatgtactttgtccctgagttgattctttttctctgggcccactgaaagatcttcagattataatgtaaaagtgaagtctttttgaacagagcagaagaaaaggatatcaagggcatgaagtggatgttactgaagggagtcgtggtgtgctgtaaaggaactcctgagagggacattggccgaagggtcatctccctcttcttggcactgaacgaccaccacagaccacaaaagggcttagaaccgacctccatttcaatgggacttttcagtgacacttgagacctcgtgtcatagccagtttgtgaccattctccaacccaagcattctgctgcttttacaacagattattttagaagctgcttaggagatgctactagggatgtgtcaggcttcaacaaattaggatttcctccccaccactctgatgatggtgagaccagcatggagactggcagagtgatgaatgcattggcttatcaaggtcatgagtggcagccggctgcattgtgtccccaattcaaacaaggatcccccaacactgcaacagtctaggattgtctcctaaattcttcacattccaagcacacaaaggaggtgtcctggagccatgtaccttggggaaggcagattatttgtaagctcttgtgttgccttcactgcagacagatgggcctcctctatcctaaacagaggctatttaataacgtttgcttcttgttaactttccttactcacctgatctaatgaacctatgctgctttggaacatcactggaaatgtttcagaacaaagcaagaatcatttggactagtacttcttttggagaggtggctattaaatggggtttaaagtttttcatttgtttgtttttttacctcttagatttggagcttcttctatggccttgcacatatcattctgtgactatgatgcccacattagcccagttgtcttacaagtatgtaaaatccttccagcagttcaggttcatttggcattcttgttaaatgtactgctgttaggactggaatgagaaaaatgatagaaatacaagtaaccataaaacaaaactagaatagaataacagacactgaagtaaaaacaaaatgtttatccatattttgtcattcaggcctattcattgaaataaagagtacaaagatttta

SEQ ID NO: 131299 - DNA, 1241 bp, Homo sapiens
gatcctcccgcctcggcctcccaaagtgctgggattacaggcgtgagccaccacgcccagcctcactttagattttttttttaaagagaccagacattttttgaacccctcaatatgttaggcactgactggagtgcttaacaatcctagctacttagtgggaagactgccttttctttcttctttttctttttctttttttttaaattaagatggagtttcgctcttgttgcccatgctggagtgccatggcctgatcttggctcactgcaacctttgcctccctcctgggttcaagtgattcccttgcctcagccctctgagtcgctgggattatggcatcagccatcacacccggctaattttttgtatttttagtagagttggggtttcaccatgttgaccaggctagtcttgaaatcctgacctcaggtgatccacctgcctcggcctcccaaagtgttgggattacagatgtgagccattgcgcctggccaagactgccttttcaaggctcttaggagacttgttatggcccaggtgtagaacataagaatggaagttgaacattcacgaattaaccaatcacaattcagcacataactgttgagcatctattatgtgatgagggttaggaaaggctttttagagagggcagtgatttggggtggaggaggagagcagtcctgtccttcgtgtctgtgttcacctatgatcatcataaggaagagcatcctggaggacgttcctgtcctgtatcccagggcctgtgtttaggaaaccaagtcacacctccatggctttttggtaatggcatagttggttgtgaggagttgttctcctaagtctgactgagtcgtcatcctgtgctcttaagctatgctttccaagcccaccaggcccttcattcccagctgtggttggaaagatacataaagttctcttccaggctctcttctctggtagaactccttgacaatttgccttgtcaaagcgttcttctgataatgtgtatgtctagttatcacacctgccatctttttgtgggaagcttactgtctaggccagaggaccccccagcactaggctccttcctagccttcctcatggatggtcacccaggcttgaattacagacctttctctccttcacccagggccaagtacttctctttcaaacggtcccttttcagacttgcccgcatgtgtgaaaatacaaggggtagatcttaggggcctgat

SEQ ID NO: 131300 - DNA, 3665 bp, Homo sapiens
tttttttttaatgaagctgtaccattgcaagccattttctctctctaagtttcctgtggaatttctttccttatcaagatagtaatactttggagttttgaatttttaagagattcagtcaaagcatcttgtcattttatccagttgctccacttcttaatctgtaaaacggagatagtgtctttgctattaatttttcttaagggacacagaatccaaatactctttgatctacaaatcttttgcaaagatgcataactgtttactgaacattttactagaagtcagcctgttgcttttaaaatctaggaatgttatttggcttaccaactaaacatattcatattttgcttagcatgccccctttcagatgacttgctgcagaataatgaggtgcaagttgaacaaagtacttttcaaattaccacaggacctcaccagttttaccacttacctccagatgtgtggaggccatcatgggagaatttacctttttatgtttggacatttttgtaaaaagcttgtggtgttgaatcaatgggttatgaaatggttttaggaatgtaacgagccatcccgtgattctacagagagagacaattttatgagcacattttctattgaatgtgtttgctggttgtacttgaaccaaaccaaacacaatctctaaatcataacacatacaacctctcaacttggagactcttgatttacaaatgtctctctgtgactgaagtggctgccaagggaatcaccttccctattttggttgaatgtgtttttaattttgcatgagctgtctttgttgataataataaaatgataacagtaatttcagcctttattgaatgggtgtgccagccactgagccacgtgttttgtgtgcagtgtttagttcacttcactatggtgccctaataaggatggattttagatgagaaaaccagtacagggagaagggaattaacttaccccaagtgcctcagtcaaagtttgcagaaacactttttgtggaattttttgtctctgtgatgcttcctcatttcagtctcaggcattttgcctgcaaatccctttcacttgagaacacccattgtgcaaccatttctgtttttggtttcaccatctcatgatgtaaagaaagggaaagtgataccaggcagtgtctttttactaataaaaggcagataagtcttcctcaaattgctcttcttggtgaagaataatacttgtgctccaaatgctttggtgatgtgatttttacacgaagcagctgagccaggtggtgttccagcttgttcctggacatgttgatacagccctaattgcttaaggtatgtgcctcttcttaatcatctctcctttaactggagaactgtgctacattatgacctggaaaatgggggcattaaaagcaaccccaaatgtaaatggcccttaccagcaagtcaccagctgaggaaatgcagacgtcacatgaagagaacctccttgatcctctaaggcccctggggactggcttcctgagagtgtacaagttggtggttgccatcttagttattttcagggcccaggtagatgttatgagtggaatgcagagtggtaactgagatggttgtcatgcaagaaagtggggccaggggactagaccttcgagtctttcagaagttggaaatgtggaattttagggaaaatctcccaatttccaaaaattgggatcagttcaaacattcgaaaaagtcggaggtccaaatcaaacacgtctgtgggccagaatcagcttgcaagaacccaatttgtgaccactggcttaagatgtgttgataaatggatctattggtccttgactaaagggaatctaggaaagatttgttttatttttggggggtaagaacataacgcataagaaagaagtcacttactcatttttacctgagagttgtttatttgtcttgtgaaatactgaaaccttagcactcattgagcgctctgtggtagcaagtgatttgtgatgatggtagtatttttggagaagatttttagaggttcagtgtggttctaagtgtgtgtatttgggtcctatgtgtggcagtaaagaaatgtgttctttggtgaacagtttttgcatccctgtgttcacctgcatggaattgcaagttgtttcataaatggatcactagtatacgcagaggctatgcattgaggtcttttctctgtattatcctatttatcaaccagctgtcagtcaaagaaacacaaacatggtgagtattatgggattaagggatttattatagaaattggtccttcctcaaatagtagaggagctggcggaagtaaaggtcttgaaggaaagtgagaggattagagaaagtttcaccagaagttcttgcgtagggttgggcaggtcagaactgcaggatgctgatgagggaccatagcagggaacggatgaaacattccaaaagctgctgctgcctctgtgtctgtggagttccaaaccctgtggtctgcagccatgtgtctggtgctgggtggagcccttgctgctcaacagggccgcttgttaggaagaaacagggatcagagcagaagaaagcaaagacaagctggaccccattgggcacctgccgttgtccatcatggtgtttccatcaaccttatgagagtggtggcctgttttcaggttcactttccaagtctcattaagctccccatatggctagccgtaccccaggaccatagcgggaagggtattccattaaatgagagttcctggcttaccaagttgacagttgtatgattcagtgtactctacaaataaggacaacatccttaggactatactgccgtgagccgctggctactctcccctgttgccctaaaaggcttgtacctgctctgaaacacagtattgaaatatcaggatttggaacctctgccttggccaggccaaagtaggtgtatttctgtttagggtcctcccagcatagtaccagcaatttacatgcacattagattaatgattttatctgatctttcttcctggaaaatttgggtctggtggggtggagaaaagggaggtactcaagaccatcatacagagaagcagaaggggagaacaagagaaattttggaggttggattgagggaagctgaactcaattttaatttgggtccagtccatgtaaatcctctacttttttgtctgcctgcctgtctgccaatcaatcaatcagtccattcattcgttaatcagttatgtatatctatatctattaatatttttctgtagatctatacctatcatatccatccatatgtttatattatatttacctaatctatttaatctatatcatgttatgcacatatatatgaaacatttttgagtggaaaattttatggaaaaagtattctatataaggtggattagtaatcctcttttgaaaaaaaattctagttcttctcaattgtgaaagatatgtctaagctttctaacaaaatgaactccaaacagtcttagatgtctgcctctttttaatcatttagtgaaataattggtttctctttttatgagaaggtgttaggataagtaagaaatcctgatacttaactcgtctgcctattgcttgactacagagttattagagttcagtctttgc

SEQ ID NO: 131301 - DNA, 1360 bp, Homo sapiens
cagttgtcatggttcacctctgtccagactgtgattgtgtgactcgcagttggcacttcagcaaagcttaggaaaatgcctcatcttcttttgtgggaggtggaaaaataagtagctgctttcaatgaacactgcaagccttgttaaagtctgtacctttcatacagaaactcctagatgaatggcaatggaaaatacgggtttgtgataactttgaatgatgtgtgattgccttgattagcactatagttactaagcagatatgcacttctttgttttaaaagagaacttgaattttttttttactataactgccagttgcttaatttctaccactttgtctatttttttaaaaaatgaatttccacctaatttgtgcttgtcagtgatgacaagttttaaaagtaactcaagttaaaaaaaaaaattctccagaaaccatcatctgtcaaaaagtttgtatttaatgttttctttcaggtagaaatgagacattttctccttcttctttccagatttgcacccttaatgttccagaaagctgagcatccatattattttgagtttaggaatttatagtgacctagtcatagttatgaggtgtttgagggaaatgaagggaaggatgagtagcaaagacacattaaacagaataaattatatagtcttgtttttggcaactagtctagcatgcagtttccttgctttgttcagtccacatatagaacaactctgtctaaaacagtgatccagttaggccagtttcctgtttaaaagctttctggaccgtcccttttcctgctggcaaaaccccaggctttgagacatagttctttctaaactgaccctaattattcttcccaggtcatctttactgccactactgttccttgtgaatatttcgcatctctgggctgttaacatatgattccttccactttgaatggcttgtgaaaaagacgggggtcttttcacaagctggtgatactcttttcagtcatgtatttagaccaaatcctctcactttgtggagtcttggaatagtgtccacgtaaggctggcctggttagtttctcctctgcttcctgagtccttgagtggtctttgtatatagcgtgaagtgcacagcattgggaagtctgtgtctgcaagcccatcaccttcactaggatacaacattttcatctttggacctctaggctaaccggagattgaaacttacttggcctctacctaaacatttcttgagcaactcagtgagctgtccatgtagtttagcagacgttccgatgattgtttcatggagtttgtgtcaacggggaaggactgctgagaggcagaaaccataatgaccagaaag

SEQ ID NO: 131302 - DNA, 1038 bp, Homo sapiens
tgtaatatattctgccgcctaaaaataggaaatatatatccaggtttaggtgttaggcaagtttttcacttctggtttctatttatcttgaatgtattgcattagccacactatttaacatggggattaaaaaaaactgctgtgcatgttctcacttacaagtgggagctgaacaatgagaacacatggacacagggaggggaacaacacacacacactggggcctgtcgggggagagcggggtggggagaacattagggaaaagagctaatgcatgctgggcttaatacctaggtgatgggttgataggtgcagcaaaccaccatggcacatgtttacctatgtaacaaacctgtgcatcccgcacaagtaccttggaacctaaaacaaacaaaaactggtgtgatctccctgtaagacaggattttaaaagcatgtctacatttttgagttttctttcaaggtgccaagaagaggctgaccacattgtttgaagaatggttaagaacttgaacttcggagtttgccagacttgcattccaggctcagctctggcactgtaagctctgtggccacacagctttgccgaaccaacctgcttagcagtaaaaatgagaataataacatttccattgaaaggtgttatgaagattaaatgaaagtgtttttctaaagctctagatatatagtgggggcccttctcaggtaatcagaaagttgtagttgcagttttgttactaatattgcaaatgctctgaaaatgtgccaccatggctatgtcttgtagatggtgacttaagcttaccttccacagtgggaaaataaatgatttatttccctttaatagccatcactctgttgatccagccctgcaaagcttacagcatggggcttatgaatcatgaatcaacacaaatgtcaccaagctaaaagagagttagcagaagtagcctatgttaagattaggtttctgatttaatgtgcagtttctaaaaaccaagtagcatgtaactggtcttatccttgctgagttaagat

SEQ ID NO: 131303 - DNA, 1151 bp, Homo sapiens
ttttaaataactgtatgtttactctaagtagatatgtgtatgcatgcattcacttatgatatgcacacacacacacacacacacacacacacacacacacacacacacacacagaaatttatgatgtcctttaagaatcttgggactatcagaaaaaagttaagtgaaataacaattttcaaaaatacatttttgtagtaaaaacgcaccatcggtgttacattactgtataaatcaaatttgctgaagtttataaatatttttatgtttactttaaacttggacataatcagatctatctgctgttgacgacatggctctcaatataaaaataatcaccttttctgcttaaagcctcattctcagaagtaaaatgtgtatgtgaggatattaactagttcataggattgttgtagaaaaccttttacatatgtggatactgaaattcttatggcctggatcagtggcctggatcatagctaatctttatgaaaagatcactgtattattacattgttactacaggtagattttcaccctggtccttgcatgaatcatttggttgtactgtccatgatgtccagtagtagattaaaaaaaaaagaaataaaaacaaaaacccaagccaatgcctacgacgttgctacaagtatcctttaacctgtggtgtgaagttatttccaaagatgaagtttgccattcaaataccatttcctggtgttcatttgatttctgtaacacctctttttctatctccgctaactctagatctgtagtccttccaaacatgctacctaccacttacactttgccaaagtgtaatttttgctctcttatctgcttcataagagaatgtttgtagtttcatgatttgtaagtgggagggggtgcttagcaggagttgagatcaccagcccagggaggaggaaatggaatcagaataagcaagaggaatagacggggtactgggctgaagagcactgtgggagggtgctattagtgattcacactgctagagtgagaccactctttgattctgtttgtagaaattttaagctaaaagtgacagattgttgcctctctttatgtaaagtattacacatgggaagttaacctctgctacaggatactgatcaagacaagtcatgggc

SEQ ID NO: 131304 - DNA, 3035 bp, Homo sapiens
ggctcaggcagttcttgtgcctcagactcctgagtacctgggattacaggcacgtgccatcatgcccagctaatttttgtattttttgtagaggtggggttttgccatgttggccaggctggtcttgaactcctggcctcaagtgatccgcccaccttggcctcccaaagtgctgggattacaggggtgagccactgcaccctgccagagctcatctatttctgatgaatgccgtccacagcatgcttcaccgatggaggtgtcatttcatttctctttgagtaacctaaaattagttagcgtatgtcactaatgtatagcatatgtcactaatgtataacatagttctaatcaactaaaaatttgtacagactcctagatgggctactaagtgaatatattttcctctgtcctctggtggacttcactacaacttttacatatttcgatactgaaattcttaatagatttggcttcaaattccagcctgatgagataatattggcatctgcccctgaagtccagtatcaggtcattcttgctccacttcaggcttctttcaaatttggtaatcgtgctcctcgtgtcttggatggctatattggcaagtcagaacccttcaattcatctctgtagacctacctgccttgggttcccgtaacccattagtaagtccctttgggtaagagttcccactaataatgtttttctctcgatttctttatcatgccttgaaactgacttgaaacattttgttaaatgcctagctaaaatcccaacacacttgtgaacagatgttagtatgatggaagaacagaaaaaagacacggccaagctaagatgttggtatgattaagttggatgaacagaaaaaatgtgcagccagatctatctccagaatcaaccaatttccacattgctttcgatctcatcctattatgttttctgtaagtaaaacttccactgcaaatattaattgatgttaagtcaaaagtactgacggtctggtcacaggggcttagggagaaacgagagaagcaaaaagggtctccccccttagggtaagctagagtcttgctgggtcagacaattaggcaacaatgtaaggcagtatataattaaatgctaaattatgtagagcagattatgtgctatggaatggagaaaatggctctcacaacatttctaatgtcctaaatcagtttcctaaatcagaatggtttcatacatccatatgtacttaaagcatgctcagtatcattggtcctttcctgcttttttgaagccatggtaatagtaaacattttctaagtatctactgtaggtcagggaactggtctaagagctttacaggtatcaactaatttcatgctcaccgtgtacctctgagataggtatgcttttctccattttgcaaaatgagggaaccaaggcggggagtctaatacctgcccaaagtgagtaatgataaattccttcctctttttgatttggtgggtctgtggtgagggtagactaggagaggcagtgttgcattctgggaagtgaacctagattttcatcctggcttcttttaacctactcacctgtgtaattaggaccttgggcaaggtgcatcatcttttggagcttctcctttgtaaaatgggacaggatgctgttttaagatttaagtgcttcttatgcaataggagctcaaagagtgggagctgttgtttattaaaaataacaatatcattatcatattctctacctaaagagacctgttgaaattggacagaaaaggaacgtttctgtcttgataagtcttaaaactccagtaccaagtgcagcattcgtttcttgtgagatatttgtagaatgggtggatagaaggatgggagaggagaggggtctgaagaattcctgtagcaagctaaagaggtatcatcttccaattgagctatttttagccttactcatcatttgtaatcaaaacaatccttttcttagccttactcctcccccacccctgcccccctactacttttgcgatggtaatcgtcattgccaacttactttctttggaatacacaaacagagctgtctctttccgtcatggagattttaacagtaaaaaactcactgcaccattacctctgccttgtattccagacaatagtaaaggacattgtaacatcactgtgtcagcgcaaacaaagaactatgtaattttatcccatattaatacagtgtcacgcaggaggtactatcattagatggcaatctataaaaatggcccctgagaccaggcactggcacaattatttattcttcaattatttattcagtcctaaggatggaaatgctgacagacactgcaaaatgctctacctaccaatttacagaaattgaatgacggaatcatttgtggactgaagtagctttttattgaccctatttttatttatttaaattctcactttcacagcttaactatgtttactacacccacttacatgatagaaatgagaggctgttttgttcataaaagctacttcaaaacaaattaatatttattctgaaagggtcagatcacaaatggaggctttaaaacggcctcaggaacattcaaatcgcatccttaatatttcatatggttttatatttagattggctattttatgtagtcttttttccctttttagtgctcatacctcttgagatcccttttctagccaggatggagggaacagttacacatagcttccatttgcagtaagtaatttcaacttaatttatgtcaggggagatttccagaaggttcccgctcctgtctgctattcttgtgattctaatatattatttgtacatgataaaatacaattcccattaattcacacttaattaagtcataaaagaatttgtttggtcttaactcctaaagtttaaaagattatttgcatttgtattaatactggagtttaaaaattatggctttctttatagatcagttccgattttccctaaatcagttattttcagttttgattttt

SEQ ID NO: 131305 - DNA, 1077 bp, Homo sapiens
gtcgttagaaacactgtgtagggtgcagcgtcccctcattacaaacatttctgtgccttagaggacactcctcctgctatgtatccttaggaggaacacatagatcagcctctcttccttttgtccagctgcagtatcgggaatggagacacaacacggtcaaggtgcctaaaactagagtggcctggggtgagtctagacttgatcttcccagatactgtcccttgtcagactccaacactgtgcacagcctggtctctctgggcccaggaatttgggcacttgcccaaagattcctttgcaggtgctcctggaaatcagagcagtgttgaagcaggatttaaagcagtaacatctgtcagatgtaaccatggcattatatctgagacaaaaaattgtaggaggaaaaatgcctgttcggagtgtggggttactgaaaacccgcttgttgactagtgttttattgtagtgatgggaaatgaatgagactggtatctacacctactggcacgggtctgaataaaacccacagccggctctcctctccctgagcttccagccttctgtggtccagattttcatattccttccaatttgcccagagcaagctgtgaccctcatccatcttttttttctcgttttgcatttaacagagttgtaaagggatttatatgctttccattagccttagcaaagctgctgtcatgaatatttaatggaaaaagcagtttgttttcttttactctttcccagccttccctccagcccccagctctccctttctcttgcctggagaaatgtaaatatctcgcccctcaccccttggccggatcccaaagccccgggctcgctcaattcaatgttctcacccgtctggtggggactttttttttttttctctcttctctctctctcgtagccccctacgaggcaactaaggtggtggccgcggtgcgcggggccggacacgcgtggggctctgcctggcccgggcctccgcgccctctgcctgcaccacagctcagcagcccggacagacggtcctttcctttgaacttcacgggagcacaatagctt

SEQ ID NO: 131306 - DNA, 1999 bp, Homo sapiens
agaataattaagacctaaatcttctgccgaattctgtttggtttccttatttcttttgccatgttctttcattccacaaatgttattgagcacttccagtgtaccaagccttgtgtttactgctttgatgataaatgcaataaggtaatgctgcttttaaggatccttcaggataggctcttgtagcagtaaggacttagtatttttgctatagaagtgtatggagagctatctatggtgcaataactgtggaaatacagtttttattctatttggttcccatatacattgagtcctcctttggtgggaatttgatcaggttggtctcagttgaatcctggctgcatatgcctcagtaaggaagaaggcctaggggactgtggaaagcctggtggtggtcctggaaggcttgagaatacctggagctggaagctccttgctcattggtgacctttttcatatgcagcagagctcttggcattcctagcatactaccttgaaaggactgtgtcttgcctcctagaaattctggacttggtagaatcatttgtttatgttattttaaaaagaaaaaaaactctgaaatgtactttttggaagaaaaatgaacttgtttttggacttttctgtgtgttgtttctttaattgaaaattctgtctggagattgattttcaacccccttcctttccctctagttttaaattgtaacattgctttccaagcatttcaaaaaaacaacaaaaaagaaatattttattattactctatttttatttgctcattaataattcttgattttctatctatatgaaatcaaagaaaaattactgtataattttcatccagttgcagtcaattctataactgaaatacaagataaaaaataagtaattgatttacttaagaaacaaaggcatctcgacctcctaaaaatttcatcaaatattcactcggcagacccttctttgtaataggagctcacttactattgtgagcactgacagtgtgagcacttgtggcagggattgggtttcctgaggaattcataagatacttgcattgcttctgggcatgagggtgaataacacagccattggccttcaaggcctttgaggaggtgttctacggggagaggggctgagacagacatattcctgaaaggaataattactgcgtgatagtggaaatatacacaaagactttgggagtaacagtgatggagggacccattgaaaacttactaacgtttacagctgttgttaaaattcatccaaaccagccaattatatctacattctctagaatgaaagtacaaaatgattacagtggatgttctaaacaccagtgttgacacaatccccttttcctactggaatggggatctaatggggaaagtgaaattctttctcaaaaccttatcggtgttgataccttacatgtacatgtaaaagcagctgactttgtgttttgtggcctttgagatcatataactcttataaagcaacttacaaattttctgggaggttcttttggaatattgctttatgttttgttttaggaatatacttccctctcccctgaattatctcagtggggatatataaatctactccctatccaaagcataaccatgtatgtatttgttttctctttatcatatgatatagtttggatatttgtcccccttaaatctcatgttgagatgtaatccccaatgttggaggtggggtccggtgggaggtgtttgggtcatgtggactgatccgtcatggcttggtgctgtcctcaggacacaatgatttcccatgagatcccattgtttcaaactgtgtgaaacctctcccctactctctcttgctccttctcttgccatgtgagatgcctgttcccccttctgccttgacttaagcttcctgaggcctcaggagaacccgagcagatgccactgccatgcttcctgtacagcctgcagaaccatggccaattaaacctcttttc

SEQ ID NO: 131307 - DNA, 1044 bp, Homo sapiens
ctgtctaacctttgaactttctgtgtttttgacatcaaaaggaactctaagctttaccaaaaaggttttattcgagtaattaatactcttcatgcacagagggaaattagcctccaacttgtggacatggtgaaaaattagtatcttcccatttgctcggcttgtttgaactatagttgattatttttaaagataaggagatcaaatttccttaatatttcagtatgttgctttttgtacccttaaaattattttttcctatgcagaattgactttgattaaaaaatgtttttgatgactattttcctgattcgtcagtatatctaattgtgttcattttactcatgaaaaatcttgtctatgagggacgtatttttagtaacatttttatagcatataagaacttttacagcaaaaacaggaatcattaagtgtgtgtgcttttatcataacttctcttttaatggaacttaaaatcttaactcgtgtttttgcagcactttttttgcacatggtaggttcttaatatttgaatggaattcagtgtgactgttctttgtgttctcaaaagtctgatctttgtaacaatttgtctttcacttgagactttttttttctttgcatatgtgcacgtctcactcttggttttccttaatcttttttaactaaacacatctatgactcatatttccctatttatgaataggagcaatttaaaatttcccaacatggtggtatgtgatgtaacataaccaaaggctacatgtttacccttgtttaattacccttcatttgtggaaagatgacgtatgtatttatgatgtaaatgtctttcagaatgacctttgggactaagcttttttttttttttcccaccaaaaaatggtcatgacctaggaagccttgttagtaaaatttaaaaaggaaaagttggctgggcatggtggctcatgcctgtaatctcaacactctgggaggctgaggtgggtgtatcaattgaggtcagagttcgagaccagcctgggtaacatggtgaaaccccgt

SEQ ID NO: 131308 - DNA, 8465 bp, Homo sapiens
actcttttgtaatttctcttattagaaaagaagattaatcatatatcaaacacgattccatgtcactccatatagatctttccctcattctgtttttacagctataagggagtctgctgtgaaaatgctccttcgattagtttataactgagtgtaaaatttggcatttcactcttgattatagtctttttctgtatattcacccccaattctttgagaatgaggagtaccctaattttgtaagcaaaattttggggggctttggggtgaaaactaatttaaatgcttattttctcagttgcctacctccatttaaaaatcagttttgagggctataaaaaaaccttatgatattaaggcctttttttctgtataaaaataacatacaatttattttttccatttattcaaaagactgaattacactagccaagaaatgatcagtctcgtgtaaaagaataacacacgttctccttgaatcaagactactctgagattcagaaatgccagtagcggaaggtggggtgtgaccccttaagtaagtgtgactagttaaaggtgtatggatattctttgtggaaagcgggctgccagatacaatttcaggctgtttcatattacttcacacggtgctttcaaactgtttattttctctcttggcactagtgagtacagctcataactggccagataatatctaagtctaggaccaggacagtgaatgggttttaccatgatttgatcaaaagtaaacaagaaaacaaaagcagaggaaaaaaaaaaaaaagagaaggcatcacatttttctcattgtggggctaaaatgctgcatgttgaattttcactttctgattagaacccacagttgaacagatctgatttatttttttggggtcaggaagaaactgtcaaattttagtttgactgttcttttctttaggtctcccccctttcttcccctaccttttttttttttttaagcattactatattaatcagatagcagccactgtttgacatgtccttctgtggtggctgcagattaagtctgaaccgtgccagaaatctcgttgcattttttgatgtagcagaaatgaacctggttcattccatcttaacagctttagccaaatggctcagaagggatctacccgatttcataaagaagagttaatgtgcagtctggtttaatacaggtgcccttaaaatacatttttgttttgttttgttttctcacttccaagtttaacatgtccatggacattggctttagtttccccaagatgagtccatgaatgaccttgttccagtatcccttgctgatttgagttcccaagtaataagcctgggaatgttttcagtgcagcagccgggagaagaagggggattcagcagttgctgttcaatgcatttactctctacctgctggcttcaaacagtattaactttatgtgctccttgtgcattgtgtttaattaaaagcagttctcttcacagaggcacttgtaggatttttttttttttttttttttgccctgaaacgaataaaacaaataggcgtctggtatttgttttgtataacacaatccccataaaatgaagagtaataaaacataattatctgtaaaggcttgttttataagcctgagaatgggcttgtttctaccaggtttttatgttcattcataggagaaagaatctctttgtacattaatatgtaacaacaataagaacaaatgcttcccaattacatgcatgaatcaaacttatcttttattaaaaaattttttttctgttgtagtaaaagtttgtcattaaattctttctgtgtaaacacattagattgaaggaaaatgttttccttcaatattctgttcaactggcataactttatgatttttttctccccagcataattaaagaaacaactttatggttggttattgacttttttaggtcagagagcactctgtggattctaaaaccgccttccagaaaagtacacatcaaacttctacgtacgtttttatagggtttgtagagctctgatccttggttaaagatccctgacaatgtctaatagctgttttgaaaactgtacctccaatctgaagctaaggttttagttttagttttagtatgtgaatatctgatgaaacgattcaatggttttgtagcattggattcaatttcagggttgggctcctttctaggaatagaggaatattcttatctcaggaaaaaaaattcagagtgtgggaagtacgaaaattattaattcaaaggtgtatttgctgtcagattggatggcagtacccacatccctaggggctcctgttcccaagactgttttcattgtttctatccagcgctgggcacgagccttgaagtggcgaattcatcctctgaagttgtgtgtccattgctgcaagaataaaagaagcagtaacagaatcatgcagcgcagtatttcatggtgacagttttatgtggttgtgtgatgttgcagagtcttgtaggtgatatctacccttttcttttgaatcaaaacacggggttttactggaggagggaagtttcagaaacaacctagtctaacacaaaattaagctcctaaatagttatcccattctgtctactacaaaactaattgcttacaggaagtagaagtacacatatctaatatttatatcctgtttgagtagtggtttctaattttagatttctaacccctttttacattatctttttgcattgaaattatactgaaacattcatattattatgaatgcaagctgaattaaatagaccaagattctcggtttctcccttcatgttgtcatctactagagaatgaacagcttaaaataagtgcatcagttcctcatccaaagggaagctgaatattccaattcaagatcactttgcgtgcttactggaaataccatttttgaacgtacttggcaacttaaagtgcccaattaaaagctctgttgaaagaggaagtctgtggatgtgcaattagtccttaggattcagagcatttcctttatgtgtggaaggccataatatgaaatcactggtcacaatagctttatgccaggtgcttagactagaaggcattttcaggatggattatttctgtactcttgctcctaaaatggtttacctaaagaggctcccaagtccataaaaatactggtgatgtcaagaaattttggaggtggcctttcacaaattttaggcagtcaataaatataactagccatgtacgtgataggcaatacacaagacttgcttatattcctagactttctattttatctgattgacagtgttcctcttcccacctttttattcatttatttatttttaaaagatgaggattgggtaccagaaaattagccagtattgtgtgcttttccttactaaaaaaatgaggcctcgctgagtagggccagatgagctgtatattctgagattatttatagtgtttatgatagagagaccaaaaacagtaagcacttaatagctttccttatttacaagtcagattcatctaagggatatttttcttttatttttctggtgcttgaaatgttcctttaaaatagattatcagaggatacacagtgacacaaaatttgttgcttgtgaaaatgcagagtggattaagcttttctttttcaaggctctgcaacaaaacaggtacatttttatttcagtaaaaacactgctttttttttttgcctccgtcacacacacgagtaacataggatagatatgtgtatgtgaacatgtggctcttgttcccagttgtgtaatggatgcattcccttaaagtttgcagtaaagtgaatgtttattaagcaaattgtttttccccagtgacttctactgtaaaaatggcattgtctttcagtaggctctgaatatagtatgttcccatattctttggtaagatgaccaatcaaccaaaaaaaaaaaaaaaacaaaaacagccccaataacaaacaaacaaaacaaccctttaggtaccataaatctataggaaatactaaccttctgatgaagctggcccgatgccacttattgttgtcccccacgcctaagctatggtatatggctttaataacaaaatggcaacacacaatagtaccacaacctggagggtgttactctttcttctgctcacccttcctcccattgttcccatgggagagaggacagacaccaaggctgtagcaaataggttattttaataacctcagcatccttgtttctatatgatatacatttgatagccaagttgaatttacccacctctctctaaacactttttcctaaccctttgtcaatttgtcacaccatctttggatgaagagtggtacctgatggtgtatgatgcttaacaatcgaaacatctgtaccttgttagccataaaggctcatcccatttccttccataaacatctattgtaatacaatatggattgtgtaaggcactgggctttaggcccccagcccgaatatctgtcatctattaagtacttactgtggataaagaaggcagtatacttaacatgcactatttcatctaatttttgcaaaagctctttgagtacattaggccagtctccattttattaatacggatgaggaaagtgagaccaagacttgagttcaatgacttgcccagagtcgtgcaaagcataaggggcggagtaggatttgaacaccgcatgaactgggctctggaatcaaacgcttccctaatgccatgccctaggtctcagcctggactgtgctcccagagtcacttaagcacttttcaaaacactgacatatgtggacccagcatttcgaggagctgggctctgggcatttgggttttgaaggttttacaagtgaccctgatgctctgtcaggcaggcttaataacgactgaattatataacatgcccagcttggtttcttgcttggttgttgaattgctgcatgaaaatctgatccctgcagtctttgagcctgcagcccagtgaaagagatggatgtgcacacaaccaagcatgaacaagatgcattatgacaagtactatggtagtacagactttgtgctctgtgataattcctatgacacgacttgcagttgatcccaggaggtagcatctgggacatagtcactttagcaagtcctatttattctagcttgggagagttccttgcatcttaactctgtatactctgtgatcaccagacagtcttggtctaggttattataaaagtcctagttgaggatcttgaatctctcccattcagtttgactgagagagcttggtgattagatcagtggtttgtatattacctcatttgtcttccaaactaatagataagttcctcaggatccactccagtgggattactaggtcaaagataaatcattaccagactggttgatggtatcacccaggctggtgtgcagtggcatgatcttggctcactacagcctctgcctcccgggttcaagcaattctcctgcctcagccttcggagtagctgggattacaggtgtccaccaccacacctggctaattttttatatttttggtagagatggggtttcaccatgttggccaggctggtctcgaactcctgaccccaagtgatctgctcgtcttggcctcccaaaatgctgggattacaggcatgagctactgcgccccgcctccctcttttcttattgagacccattgaccaatagcttggtcaatagtgcttgattcttgagtttagaaaacttctattgagcttcttactatgtcctggggactgtgctgggcagtaagaacaccagaaagggtgtggcgtcttaggagcctattaaactagattaggaagagaggtgttgaggtgtcacctagggcataggcagagaacctgtctgcctaatgatactgggtttagttcttgaattctttatattcagaatatggattagggccaggctggccttgacaacctgaatcattaaacacttatggtgactggtgggtgattagccacataagaagaagatatattcataacagatataataggagcaatggggactcgatggagagtattaaatagtacagtgtcttccataaatgttctttaattgtggagattactgttctgtagattattcactcaggcattgagtatgcgtttattaagtgctttttgtgtcctaggctcattcacaagtctaaacttcaaatttggttcttaaattcctcaagaccagagtttagctaaaagtatcattatatcctgagatggaattttatcaaattgtatgcttaaaatgaggagatatgtctgtttctccatctcgcaagccccaccagtttaactgtcaattggtcttgtcaatcaactataagaggtgtaaaaatgtcttgggctataagtacatactccagggcgtatcctggtgacagagattgagaaactgattggaagagagtgtaatcagtagtgctggccttactgttctgaaatttctggtttctttccctcgctccaaacttaattctttcttctctattttcaatttcagaagaaatttagaatgagtgagggaaattaaaatgaagtccagaagaccagcagagatttcaccgggcatgtgggtaggaaagacgtgtgagaaaaccatttgaaatggaattaaaagaaaacgtgttcagctcactatataattatagttagcttggcctggtgttttgggttgcattacctgtaagtttggaactcatttgttgtatagaaattgataccccacatttacttaaattttgcccatctgtttcttgttaaaagaaactggacatctgctaaaatatccttgttttggattactcaatcttattgtcaccttataatggttttattttgggggaggtttattcgtattagtatgatggggaaagaacagaaagatcttattggaaaataaatttagaattttccaaataataaaatcaaaagatttccagccgtaatcttaagatgccttttcatgatgtctagttttagaaactttttttcctctcagatgtgaagaacaatgctttttaggacaatagtgaaacttacatgagaattgttctttttgcattgtgttatggtgcatgatgcgaaagtttagaaataaatatatccctggatacaacaggcctcagttaagacttcagctatttttaatgcattttgttatttttggcctggcatagtatcttaggatgagaaaatccatccccttcccctagtctgaggtcacatgttgccatcagttctctgtaatggagtcaatgatgttatggttttaaaataacgggaaattaacatttcttgtccccatgattgtggccgcaggacttgatcgtttttatactgttaatcacactcctcttttacaagaactccccgactcttgtttcccccagcagttaaatgccatattttcatatatttaccttatatctggctaaaaccttgcaattttttgttttgctctcggtttttgtgacaattttaagaggaaggcaaataatgtacagactgggttgaaagaggagaaaatggagcagttgtaattccccggggcagggtaagagactgttaatacattagtggtaggagggcttctgcagaaaatacgactgcacaattaaatggggctattaaaagcacgccagcatcaattcattaaatgacagtggcaatttctttgtaatccccttttccccatctcctcctgggactcagtatatgcagggatgaaaggcagatgggcaaagatcagaaagactactgaggaagaggtacagttatttagatatctgcttcctcatcttctttgggggcagcttctgtgatgaaaacactttatgaaaggtaagacccccaaatacctgttctgtagacattggggatgaaaatgtacatcctagcagatgatctggttctgcattccagaacactgctctgactttagaagcagttatctatgcatagtatatctacttggagctaaaacaaagagagaaattgtttgattgaaaccttcttattgcaaaagtatgcagaattgacattcagcaatcttatgtaaaaatactgcaaaatgtttctttttctggaaaacagtgtattttaaaaatcagttggaatctggttacctgcatgacctagtgagaacttcaaggcttggggaaatggttgaggttagtggttatgagtatttgatatccttttgcgtgtcatttaattgtctaagcccccatttcctcatcggtaaaatggtgattctggtatctgtctttttagtgctgctctgtaaaattaaatgagatactgaatgaaaagcattttgctcagtgcctggcataagataagtgctccctaaatattaacta

SEQ ID NO: 131309 - DNA, 1085 bp, Homo sapiens
ttttttgtatttttagtagagatggggtttcatcatgttggccaggctggtcttgaactcctgaccttaggtgttctgcctgcctcggcctcccaaagtgctgggattacaggcatgagccactgcacccggccagggacatgcatggttttctacagagtggcttcagcttccacggttcatccctagacaattttgcctttttttttcaagacacggtcttgctctgttgcccaggctggatgacagtggcactgtcatggctcactgcagccttgacttcccagggtcaagcaatcctcccacctcggcctctggagtgccagcaggacgtgtgccaccacaccctgctaattttttattttatttttttagagatgggatctccctgtgttgcccgggctggtctcaaactcctggtcttaagtggtattcctgccttggcatcccaaagtgttggggttacaggcatgagccaccacttgtggcctacttggctcttttttacaggtttttggttgacacttctctgcagaatagcacctggcacctctcaccaccactgaaaaggatggaattttatacacctctttttcctaggttctctctagcagttaccaagggaccatcggaggtacttattgtggctgtttacaaaagccttgcctccagtctgagtcacctcaccctactctctgcttcttccttttagctactctttttttcagtaaccctccctctttcctctgaaggcttgtgcttgcacacacaggcagacatactcatgcacgcgcacaccacacatgcttcctgtcctctggctctcccgtatcctatgtaaaacctcctactgtcatttaagtgaaacccttctagcacataagagttttcatctcagaagctcaattttacctttcacttttcagatagagaacacccaaggtttttaataatctggcgaatgtgttaaaaaaggacatattttttaaaatctagattgcaaaagtaatactgtagcattgttgagttcagacattatagaaagtgaaagttccctatcatttgtttcccataaccaccttgaa

SEQ ID NO: 131310 - DNA, 1601 bp, Homo sapiens
tgaaagtataagatactcacttttggaactcccaggcatggtgtggcctgggagctttctcagtttgctcctattcaggacatggtgtaagaactgtcatttgaagcctgtcattttagtcccccttgggggttttacaaatggcctagtgatttttcagatagcagagaataaatcagcagtgatttggcctgcccttcagcctagggcattccctggttatcaccagcctcatcatcaggtgcttgtattacacgtttttctgtccacaccggcaggtgagatggtaatctaagagttgatttccaacacgtgcggagggactttcgaaagtccccctagtcccggtattctcttgccctgtataattttaggggtccaggcattcaggcttggatcgtcctccttatgtctttcagggccttggaaaattctggaatttagacaggggcagtaagtcagtggctgtagcccttgaatcccatttgggaccttaactcattctaccttgcattataattatttggtttttaactgtctaggtttctgtactttcaggggtaaagctgattcattctcctctgtatcccagagtccacctccaaggtggtaggttgcttgataggtgcttagtaaatatcatatttgattaactttttgtagcctcctctttagtctagaaattctagatcccaaatagaaggtaagatatggtatattctggacttttagttttctatatctccttttcaaatacagacctagggtgacagacaaaaaaatattgtgatcaaagtatatagcatttcctttcatggtggaaaaatgtgcctgataaatgttttctctgcattattttcctccaaatatattttaatgacagttatttggatatttcacactttatactcgacttgggctcagattaagtcttgtgttagttataaccttgaataacaattaggttcatgagaacagggatggtgtatatttgtttttaatctgtttcccagcacttaacccagtgctgagtttatagtgggtctccaagaaatacttgttgaatgagtggcttttggtcatggtggccttttagtgcagaaaaacttttggatctgaattgttagatttacttaatttttttgtaataacacagagaatgttgaatagaaaaagtaagtttagaagatacatatatatatagagagagagagggagagttagatttatttatttatttatttttgtgagatggagtctcgctctgtcgcccaggctggagtgcaatggtgcgatcttggctcattgcaagctccgcttcccaggttcacatcattctcctgcttcagtctcccgagtagctgggactacaggtgcccgccaccatgcccggctaatttttttttctttttatttttagtagagacggagtttcactgtgttagccaggatggtctcaatctcctgacctcgtgatccgcccgcctcggcctcccaaagtgctgggattacaggcgtgagccaccgcgcccggccgacttatttatttttttgtaataacacagagactgttgaatagaaaaagtaagtttagaaggtat

SEQ ID NO: 131311 - DNA, 1936 bp, Homo sapiens
gtcttgctctgtcgccaggccgcagtggcgtgatctcggctcactgtaaccttccactccctggttcaagtgattctcctgcctcagcctcctgagtaccaccacatccagctaatttttgtatttttagtacagatggggtttcaccatgttggccagcatggtctcgatctcccgacctcgtgatccgcctgcctcagcgtcccaaagtgctgggattacaggcgtgaaccagtgcacctggcctcttttctttctttttctatttttactattgtgtttgatataagtatcactgaagccaaattaaaatgaaccaaagggttttgctgcataacacaaatccaaataatttattggtacaggaaaaaacattatgatctttttatcatttaacagtctgtagatattgaaacttccccccctttaattgtagtttttctcccaaaagattgatagaataaaacttttggctcacattttttgctcaggttacgttcaaactctgctaactgatattgaagcattgccccagagaatgcagtaacacagggcttaattgagctatcaggctgctaatgaattcatattgagatttatcatttaattaaaaggcaaagcggggaaaagcaaagggaaggtgtacaattgttccttccgctggcctccatttcctccatttaaaatcgtggcttgtttgtttagtttgtagaatcctgtgggatattgcatagaagtactcaaggtgcataggtaaaatagagggtgtcctgtattgcaatgacttgacttcttagtgggtcttaaaaattgattcagatttggtgacaatcatatgacacttgattaagtagaaattatgttttatgatgtttttacaaaagattaggaaggccattttccaaaattattcctaggtctgtatatctgaagcaatctgaaaattcaatcagagggaatctaatactgagatgcttttgctttactgacagagagtaaatttttcttgaaaacaccatttcttatatgctacatgtgtctttaaaattcacacctgcattgaaaaagctacctttaagcaacactttttatgataactgcatttttaagtatgcaagtgcaatgttgcaaacctgtcaatgcagggcagtcagtcttttattgattcagagtggaaatgtataatattttttgtatttagattatagagttacatgtttttaaaaaagaacagtattttatgataagttaaaatttaagtacctcaatgcttagtacggttaaaaggtggagtagtgttttcctgcacttagtttagacttagctatatctaaggagtaactcaagcagggataacagagggcaaaaggattagatgtcaaaacaaatcttaggtttctatgaaaataagctaagaaatgagcccccttggatgaaaaatatgaagtgagaatatagggagtgttggtgaggtttgaacctctttgggcctcagttttcctcatctgattttcctacacagagacctctgattgaagctgtcacatctgtacatgcacatgtatgtctgcatgtgtgttgtatgtttgctcagggaggagggcatggtgttcaactgactccaaatatttgatatcagacagttttgtctggagagaagagcaataagattgtggaagtgatcctaaaatctagtttaactcttgtgtagcgtagacaaaaagtagagatccagggaggttgagcaatttgcccaaggtcatgtagttgtgaccgaatccgaaatggaacacacgtctcttgacttccagctgaggattgcttagaggttacacataagggttctggtttgaattcagatggtgactctgtcactagctacgagaccttggtcagcttccctgtttccgttcttcacttgtaaaatggagataac

SEQ ID NO: 131312 - DNA, 1958 bp, Homo sapiens
tcataaagaccacacactcacaaacaatagtatgattgatttctagagtatcacttggatttctaacctagaatttatttaatcttacgttagacaattctaacctgttaggtaatctggtttctcagcctgcagtagattagaagcagtacatttaaaaatgaaagagggattcttgcagatagtactgggaagaaaggacagctggtaacccaaatataaggaagtgggccaggaaattataaaatgtaatgcccagaagaagtaaagaaccatggcaattgaagaacagctggcccaatgcccaagaatgtgttctacaccctcctcaggaatgaatgtgcttccaagtccaacacctactgccctgcctgtcaccaagcacagcttctgtggatatttgatgaactataacatggtacagtattggctctgaaacatcatttgtgttcactgtcctttgtttaagaatgtagaaaaagaagtaatgtgttttataacttttttgaaaaccgtatgattaataaaatatactgatggtcttaagagtaagatctccatttgaaaacttgtctaccaactttagcaatttccgccaaggctccagagagacagggtctcctttcggttagcatttgatttctgctacttgttgctaactctgatttctgggttttcaagatgcatatcagtttaaacctaggtgaaatggtaagttttctgatcctgtggtgtaggcctgtagtgctagctattctttttttttttttttttgagacagagtcttgctctattgtccaggctggggtgcagtggtgcgaactcggctcactgcacgctccgcctcccgggttcatgccattctcctgcctcagcctcccaagtagctgggactacaggcacccgccaccatgcccgactaattttttttgtattttttagtagagacggggtttcaccatgttagccaggacggtcttgatctcctgacctcgtgatctgtccgcctcggcctcccaaagtgctgggattacaggtatgagcgagccactgcacctggccactgtgttagctattcttgatggactagtatctagaatgacttgggctgtgggctcaggtaaagagagtagctagcctagggctagggctggccctgcctgcctaaggcgtggcatatggatgttagggtttggagaagggaggggcccaggagggaacaagggacatctcgtctcttgtcctatggttgtcctggcaggtatgttgggcatttcacactcctagcgggggcctagcttggacgtgtagcaggcacacttcctgcacacatttcagtgtcctgacggattggtagaaatcatccacagtgccactgatagaaaatatgatcaccaccctgcttgaatgggccttgggggtgtctcatagttaattcacatgttactaaggcaggcaagctctgcctgccttctcatccccagccccagggcagagccacactcctcctccttctccccgctttccccacacacctcctttccactttctggaaagccagcacccagctgcatctgacttcttccagagtcacttccttgatgcctcagacaaggccaaattctcctggtatgtgctcatatagaacatttaacacccagctgtggttttccattcagttagctgtttgtttgtctctctccagtagattgcacagaacctgaggggaggattcatgttggtttttcattgatttactcaacagatacttattgagtgcctacggtgtgcaggcactggggattcaacagtgaataagaaggtgcacgtacctgccttctagatgctcatagcctagtggctggaggctgaggatcatggcatacacattttgtcatatattagaaggtgctggatgctgtgaagtaaagcaacgtatggaagtgggttaaggcagt

SEQ ID NO: 131313 - DNA, 1245 bp, Homo sapiens
tgtttttatttaaaacctcttccaccttgaccaggctcctgtaataaacaggattccctccagactagaagatttgctgagtacctgttatttgaatttacttttattagttcatagaacctttcaacaacagtgtgagttaggttatatccccattttacagattagaatgtaggcccctgagacagtaaagtaacaagctcagtgtcacatctagtgagaaaatggcagggttcctacctgggtacttagattccaaagtccattctcttctacaaaatgttaccatcttaaagaatcaaacagagtttctccctgttacatattaacttttaatacgtgaagcgtgagtcaggtgtttgtatatggatcttttttccattgctttactttatgaacatgtttcccgaggaaaaagtttggctcagagatgtcataaaggtggctcctaaacctgacatttaagcactgaactccttcaactcttctgttcaaggggcattggaattgtttctatgtagattctgcttgtaattctctcctagggttcttctaagaaaagtgaggaagctgattagcattctgtctgtgtgacctttcccctactgatagcatcctgcagggtgtccctctgtgattgtaagtgaaagtgaaccctggagatgtcgctgcaggtggatggggatcagagtgactgctgccccaggtagacactgtgatccaatagaatagaaatgaaaggcctatgggaatattctgtttctggaacataccacacccaatgcctccaggacctaaggctctttaaaagaaaaacagtgcttaaaaaattataagcgttatacacaggctgagcacagtggctcatgcctgtaatcccagcactttggaaggctaaggcgggaggattgcttgagcccaggagttctagatcatactagcctgggtaacacagtgagatcttatctttactaaagataaaaaaattagctgggcatggtggtgcacacctgtagtcccagctacttgggagactgaggtgggaggattgcttgagtctgggacattgaggctgcagtgactgatgatggcaccactgcactccaccctggacaatagagcaagaccttatctttctttttttttgagacagagtttccctcttgttgcccaggctggagtgcaatagggcgatctcggcttaccgcaacctcctcctcccggattcaagcgattctcctgcct

SEQ ID NO: 131314 - DNA, 5858 bp, Homo sapiens
cgtccataacggggaggacgttgtgctcctcaccacctgcaagcatggcaaagactggcaaaagcacaaggattctcgctgtgacagagacaacaccgagtatgagaagtaagtgtctgggctggcgtgtctttgggagtcagccttgggctctgccggccttggtccaggtgtgaagttgggggatggggtgagggcggatgagccctcagtcctctttcccctttgagcctggaactgagcaaatccggttcgggtgtgcagctagaggctggggacagagagttggagctcctcgggcaaactgaaaagcctggagcaccttctcgagccaagtaggtgacagtatctccctcttgcttaggaaacctgcagggcggcgtgtctcctgttaagagtcggggttagatccaagtttagtaactgcatttcaggcatgggtactggagggtgtttctgagggtatctagagacccggagaggctgtgatctacccaaagtccagagaccttccaccaagagtgatgcttttgtttgcttttctcatgagcgggggtacctactttcccaggagttttcccaacttcacattttctgtaagcctgtaattcatgttagccgtggaaatgtttaaattgtatcgaactttgtgtggccctttcctctctcccccgtggcattgacttttatgaagggagactgtaaacttgttgggcctgtggctttgcatgcatgcatgcatgcatgcattcattcattcattcatttattaattcattcatttctgtacatgtcctgtctctttcctaggataaactttttttttttttttaaatgtgggcctcagtctcactgtctaaactccagttgctaatttagatttcccgttcccttttttctttatctatttgcatgtaaattgtagactgttactctttgaatgggtgtgagatgcctccttaccctctgtagtgaggcaagttttgtccagttgctaagtaactgaattggttactttgtagaccttttcactcttcctttttccttccccgtgacagtaactgacacgggatttggagtcaaagctaaattccacaaatctgctttatcctgagcttggtggaccagtttcctagtaggtggggttgccgcccagactctcacttacatctggctgtgaaagagttagtgagttcctacagtgcatttccacgttacgccagttaaaaaccagagcagccttgtgctacccagggaaggaaggggaacctctcagctgagtacaagaggaactggcagaggttggcagattttgcaattgattcatgaaatgcagaataggggaaatgtttcgcaaacctgattggaacaggaaggggtatggtgggaaactggccttgaaatgaaaggtttgattgtcgtctgtgcattttttcagacactagggcctctataggagtgattggaagggaaattaaagtcctccaagacttgatcatagagagtgaaggagaaagtatcaagcactcagattcagctttccaacccccaataccttttgcttttcaggcataagaaaagccggagactaagatcaattatgaatccatattttcctctcatccaggggcagttatgtatgaatgtgcagttgcaatggattacagttttctcataaaagacatttaaactatggttagtaatgaactgctttgtttatacgacatttacattgacctattcctgtgggtgcttgtaagaaaaaaatgcttatagcctttcaggaatttctttgtctggtttatggtggagtaactcgagatgaagtctaacctttcagtgtcttctaaagcagtctcaaagaattctgtggaaggattctgttcttcatccttctaaaagggctaaagctgagatttcagcttaggaaatttgaattatatatattggaaaatacccttaatccaagtgaataatatctttcttacccttttattcccaaaataaatattacgtttctacgttttctgtggaatggaagcattttctagagatcagcaatgaagggaggggttggtttctttaaaactttaatttttactaaatttaactaatttttgacctctttgtgatcgggccaagaaatatgacacccacactttggtttatgtttaaagaccacaaggggtcaggacctcaggattgggtctgatcagaaaagtggcatttcgtagaaaagcaagtttgctctttctcccaagcagggatctctttagcagggacacttctggattttcattatgttcccctttggcataccttccagccctaaacttgcatgtagcccgggatggtgctgcgaaaggtttacattcactcgcctggtacacctggagttttgactcattcctctgagtgggttagcagaattatttgtctttgagaaatggtgcttacaaactttattgccatttattattggttttttggaacacatgaagatgaagcaagaactctcaaatttggagatacgctagcagagcaagcaacgtgtgtcgtgctctggcgtaagagcaactactgtgctacttatattgatgctttctggaagatggccttagatatgtgagatgcagaactcctcaagtcaagatatgccagtctctctagcgttttgggtggaggcgatattgaagttaggtctgtagacgtgatctgtgtaagtttgacttctcatactgactcatggtgtgacttttgattagtcaccttgagcattagtttgggttttgcagagtgggtttcagactgcttcaggggtgctctaagcactcatttggtaatagcttgtaaaaacacaatcagtttccatctagcttattagcaagtgtccatgggaaaaaaaaagcttcagtttaatttgctccctcaagcaatcacctgtaagtttcctttggagcaaactttatgcagcctgatgactagattgaaaatttatggtattatggtcaagttagagtatatacaaatatagagtatatacaaatgtttcaactaaaaaaaggttgcttttggtgaaatagaatattatgtgtcgataaagaatttagtgctaaaagagcaatgacttctgtctcacctgtgcctttgtgaaaattagacgttgattacaaaggtatagaaaagctgcaaggaatgaaagaaaatacttttctcttgtaatagagagaaaataaatttcttttgtcattttttgacccagacgttcaggattatattaaaatatcaatttttatgatagctgtaattattttttatcagttatatattttaacacatgtggataatgccagctaaaacaagtcattgcagtaattagatgagttgtagtgacgctttagagaaattctttgtattttatgttctttcagctacttatgcatccttatagaattattgtacttttgcatgaacttcatagttcacatccctacaaagggcattattgtgaaactttagattcagctatttgaaatagaagaaagagagggaaaggagaggtggcttctatctttgaccccctccaaggaaagcaagggtgaatatttaaagcttttctggaaacaggcaagattgtgtgcaattctttttggtatttccctttttctgtgtttgctaacactgtacctcaccatcctggtatcttcaagggtcttggaggtaagtgatcattcagcttccaacatcctgatttttacagatgtagaaactgagggacagaacgtttcaggggtttgcttaaggcaagaaaattgtttagtgacaagggtagcaccagaatgcaggcccccttaattttgccttgatctgcagtctttcatttctattctcaggcacccttgaaaattcaccagccacaaggagatccttattaatggtgtttgttatgggatttctcttagaattcttcagtaatctgatgaaaacttggaggacaacctttgcaaaaataaatgataagtaaataaataaaagcatgtacacaatttgttatatggtttcaggggctgacacacacctcccgctgagggcatcctcagacttacaaactcttgctctgggagtttacattttgcctgtttgtttagttgggtaggtctgtggagctgtttagtctaagtaggagttttttgaacctttcaatttggccctaaggggtttagggaatagactgtgcattgactgaacaataagttgaattacatgcacttacagcaaaaagaaaatatgtgcaaggcaagtaaaaatgctaaatacttttttctttttttcctcattatcccaaactgtattaacagacaccttgagcaagttcatgatccagcagtgaaccttagatgaatgttttccttctccaaaatgaaaggtgggaattgagattctcgggttttaaatgtaaaatattagcacctttctccccacagttgtacaatagcacaaaagcatttctaacataaacccaattagcacagttaaaaaataaggtagggccagccctatggaaaattatgaagttggcaagtttgtcttctgacaccgagattctgattctctccttcctttctcgcctctttctaaacctgctttctggagagcacctgagaacctcaatcacaaggaatccctgagtaaatgttggggtgttatttgctactttcagggacatttgtattattactgaattcagcctagcaaatgagggtttccagtggagtctgtgatctaagctaggggcctgcaggattttactctacgaataatggcttgttactaaggtttgggcaggtcctgcccattggaggccacctttggtcaccctgactctgacagcaactttggatggcaaaaggggagatgctacacctgcaggtggtgttagttctttctgtcagaaggcttgaggatctgccttctcagaacacagtgctagaaactcctgccaataatgacctttaatatgccaatgtcacagcagaagttgtgcttggtagggcctggctgctttgctcacaaccatcttgaaggtgtcttctcaggctatgttgctggtgtgtaaacggaggcaaacggtggtaaggtgacttgcctgaggctacgcagcctgtaagtggctgaattgaggctaaaacccaggttttatggcccgagttgtctgttcttttcacggagagaagaacattcattgctacctcactgcattcgctttgcagcactgcatattcagaatgaaccaggtgagacaaagtggtcattggcttctgcaggcttctggacatgtttcatgttcaaacatgaacacagaagcttatgtttccatgaggttaataactacaggttgagcttccctaatccaaaggtccaaaatgctccaaaatctgaaacttttgaccactgacatgagcattttggatttcggatttttgaattagggatgtccaactctaagtatacaatgcagatatctcaaaatctaaaaaaatccaaaatttgaaacacttttggtctcaagcatttcaagcattttaggccaagtccttctcagcctaaattgtgtatttgaaacaaggtattttctgaacaaggtgtttgagaagtagctattgccatgtaataattacctagcgcttccttcatactctggaagaagaaaatagtgcgttttttttctctcgaggtcataatgtgaatgttgtatgcagtggccatgtcatcagaacaggtgtgccagccccctgcatggaacatgtacatgcttcaggttgtgcggaattaactttctttagataagggataactag

SEQ ID NO: 131315 - DNA, 1129 bp, Homo sapiens
ccgcggggctcgcaccgggccgtcccgcgctccacctgcccggcagcccgccggcagcttgcaacccgggagccccggctccctgcgccccctacgcccccaacgccgcgccggcgcctcggcccgcggccgggggttatgaatgggcgcagcggaagcaccgccccccccggacgtgacgctcggccaatggcagcgcgggctgcgtggatggatgaggtcagcgctgtcgtgtcgggaatggaatgtgtaagtgtaacattcagaaccgggtaacattcggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggc

SEQ ID NO: 131316 - DNA, 1032 bp, Homo sapiens
ccacatgaacatacaggtactcaaatacaggaggcttctatttggctcctccaagggaggagttcctccaagggaaaaaaggggatggtattcttttaatcaaagaccatggtggatggatggtaagggcaacagaatgcaattcttttgtgtggtctgacgttaacacttcggaaaaaattctaagtcaagttgaaatcgccattctctcaagagagaaacatcaagagagaaacatcaagtgaccccactatgtgcctagagaaggaaaagggtcaagtcctatactaggttccttacttagggtagaacctactagtcccttgttaatcctttctgggattatacctgtgactaatttttttttttttaactatgtcttacgacaaagcacagtcctgggaaaccagtcaacttaattattgcttgtctttgagcattagagacatgttcatattgacttgctacataacactgtagcatgttttttcctgaaaatatcaagttggttgaatggaaagctcagcaaagtatgttctgtgtgcccactgtcccagcctgggactgacgggcatcagaggctttgctttaaaatatgggtaaccagttctggaagacttccaacgcaagcaagcttggtgttttagggtgtctccagatacataagcattgtctgcctccgctcagggtctcaggaaatacacagcccattggaaaccacccacgcctgagatttggaaacctgacggaaagggaggaaggtccaaatgagtcagcagcaggatgactcaccacaagcctggcaggctgcagagccagagaagggggcttccaacaaggaactcagagaagttgcagtcaccaccaagatctggcccttcggcaggtcagcaccaggactgccaggccctctgcagaccgtaattctcttcacatctataattaggaggccaaactccagctgccaacacccttggacacaatattccagtctccactgcccatctcatgtggttcagttctaatagcagg

SEQ ID NO: 131317 - DNA, 1051 bp, Homo sapiens
tgaaaattaacagggtagtgaattttgatgatctgctgcatggcaagccaccccatactggagaggctcaaaacaacaattattatttgctcatgattttgcaatttgggcaaggcttagcagggacctcttattttttccatacatactatcattggggactgaggatccacatccaagatgtttcactgaaatggctagcatgttagcacaggcagttggctgcttgttcagctgcggtggctgctgatatttggaataacctcagttgccctccatgtgggcctgtccatgttgcgtcatggcttattcacagcatggcgactaggttcaaaggaggaagaaacagaagtttccagtcctcctaaagattaagcccagaacagacacaaagaaatttctgtcatatgctgttggtccaagaagtctcaggcctgtcccagattcaaggaagcaggagggagaaaaaagaccccatctctcaatgagaggtagggagaaaggctatgacaaaatatttgcagccatctgacataggatatggagatcattcatggtttttatttcctgtaatataaattttaccctacaagattcagatttaaattcagtattttatctctttgccaaaagatgaggtccagcctccctccacccttttatgcttcatcgtattctcattctttattaaaaaggcagggatttgaggtttgttaggtatctacaggatacaagatccatgatatatgctctttcatttaccgtatttcattgcatctgagatccaacttgtctcatattttaacatttctgaattgtaccttttacaatctaggaagtcttgtaatcactgtaggtcacatggcagtgatgcacgtctgaagtggcctgtgattgtgcatatcttcattacttcactcaaattcacctgttgagtttaatcactgttgaaaaacatcttcagaaatattatactataatttggcattgaaggaaaaatgtgtcttgtatgccaaaagtcaaagaaacagtgccattagtgaggcaaatg

SEQ ID NO: 131318 - DNA, 1070 bp, Homo sapiens
ttcagcccatttcctgttctgctgcagttctcttttaaattcacagattgggaatggcccagtacattccggctcttagcacatactcacctccttttattttctccattgcaaatgcttgtgcctttcaaaggacagagagaaaggtcaagactctcagcatctgcctgacaccggtggatagaatctctggtatctctaatggtctgcttaaccaggttgttaggctatttctgtctgccgtagcaaggaatattccctcatgccagaataaagcaacctgtagtggaacattgacctgaatggtgagcaaggtcaggagaaagcattttatttaaaaatggctctgtacataataaaaaagggatcagtgtctaatatgactgaacatcgggagaagaacagcatttgatttgctgcattttttcaaggtcatgactggtcttgacagtccctattggtgacagacttccagatggtgtgattctggaccagccaggccttcccctcgagaaagaaggctaagactgatcagtttccaccacccagcagtatgaagcctgagaccatcctggtagcagatgatcctcagagttgggcccagaatgcaggctaacctgtgagtgtcccctgaattgaatgacccagggatgctgtaacttgtacttgcagattccgtatggtcatttcatacggaaggaggaggagttctgttgaagagaaatcaagacaatctgacctgaccagagtcaagaaaatagccagtccccaaagataaagaaattcttggaacacagtaaccctctattggtattttcaaaaaggcaacattagtcacaaaagatctctgtgtgtctcttggattctgccgtctcagcatttcagataggtcactggttaatgggctgggttaatggttctttttttattatggtgacttttaaccacctttctggcagaaggtgtctgattaaatcatggacagctgtgggttaaagatactacttctctagcatttagttccccttcaaacagagcaagaatgacaaggagggaatttagaacatggt

SEQ ID NO: 131319 - DNA, 1048 bp, Homo sapiens
agaaacaacagaatgttgtactatttcaattgcaatggaatacaactatgctttcacgaagtaaaggaggtctcaaattgcatgatgaaaaccatcatctcatggctaaggagaggagtgttgggtgcattagcagtttgtggaagctttataaggactgtttatgcgtttactgtcagcaccttgactgagagcaccatttccatctccactgcctgaccacagggccaattgctgtccacatcactagagctgcctatatgtgagcaagagtgattattcagcatcttctgggcacttacatatacaattcttccattgtattttcacataggctcctctcatgtttgttggagtctttcttctgtaattgctcggccttcaccatggaattcttaacattctagaagctagcagcaatgtctttttttattttttttactccccatctttcagtgacatttagggcagcagtgtgagtaaaaagccagcctgtaaatgtagatattgactcactaatagatttttttctggggtacatttgtctgtgcctctaaaccaaaatctcttatttaacttcagtaaaacgtgtgtctgaagagtttcacatttcccaatatccaatacttaaaacaatgccagacccctaaaagcacctgattttcttgttctagttttgttctactacatttgacagtgaaaaatctcatctttctctaccttctgttattgtttttatgtgtccacacataaggattaaaatgaacatttatttgaatacttcactttcgtgaggttttattcttaaaactttacaacttgtcttccaaccgtcgcctaaatgaagtagagacattttgcaaacaggaaaactaagaaagggcatttcacccaaactgctttaaaatatcaaaaaatatagctggagagggaatgagagataaaacaagggtggcaggcactgatggttgttgaagctgggcaatgggcaatgtgggttcatagtactatcctaattttgtatatgtttgagagtgtcaataaagca

SEQ ID NO: 131320 - DNA, 1032 bp, Homo sapiens
cccacccaaatttcatcttgaattgtaatcctcatgtgtcaagggacagacctggtgggaggtgattggatcatcaggcagtttactccatactcttctcgtgatagtgagtgagttctcacaagatctgatggctttataaggagctcttctactttcactcaccactctgtcttgcctgccaccatataagacatgcctctttcccctctgccatgattgtaagttccctgaggcctcctcagccctttggaattgtgagtcaattaaacctcttttctttataaattacccagtctcaggtatgtctttataacagtgtgaaaatggactaataaaaggtgatattcatgtaccttattgtcttatattgtatgatgtcgtacagtcttggatatgcagccctatggttcttcacctttttttcaatcatgtgacttttaatctcattaaacctgtaaaccttcccttcagaaaaattcctatatacaaattttacatatactttaagagaatcacaggttctcttgatgcccattcatggaccacttaagtatccatgagcctattataagtctgatccctattatttatcatactagattctaaattagtgttgaaataaatgactgaatgatccaaagagagggaatctagttccaactgatttatttggtgaaaacaaggacacacagccaatacactattttatcttacatctttgatattcctcttggaataagggtaactcattctggatcactttcctttattgcattttggattgtgtctgtgcttgtattcacctccattcatcctgaagcaatacataaagaatgtcttctctactgtttaaactcctgaatttccatcctcaacttgtaaaaaaatcaccctcaacagtatgtcttgccattctaaaataaataaataaataatgctttattatgcctcatttgttctacatattcaagactgccatatggcttcaatggatgtctagtgaaaatatatctaatatctcataaaacc

SEQ ID NO: 131321 - DNA, 1058 bp, Homo sapiens
gatgtgcagatgagatcactaggaaagattgtcttatgactgtgtcattaatttcccctgtaatatccaagcactggaaagtactaaaagcacacattatgttctgtgactccccaactccccctaaaaagcctaaataaaaatgaggaatgttttctttcaatgtgctacatgtacagcaaaagtaaaatccaaataaacatttacaagagaaggctgaaaactcaagaccatcataccctgtggggaatttacaatctaaatataacaaacatatagagtgagataggagaaaagaaacgggatggtaatgatattgctggtactaaagtctattcaggaaatggaaatatatagcaagaggactcggctacttcttgggcattgatcaaagaaaaatacacaaacatataaaaggaaagaaaagtcgttttattttataacattttccttctgattctaggtgattatatagctagtctactcttccacccccaagattctggggtattttggctaatgttatttgcaatgtccataaactcagaagaagttagtattaacagggatatgaaagaacctccagttattgtgcaagaaacctcaaatccatttagggagcagacagttcataggaattgtgaagcagctcagccatgtttctgtgataggaagtaacaattactgcagaaaactctaacttattttctcctcttccaccatcgttaaaagcaatcacattcaaaaaataaaatttattgtggcagacactaaatatgtctgctgaccccagtttgcaagcctaacaactcccattgcacagatgagatatgactatagtagtgatgatttacctagccagggttgcgcacattgggtggagatgagtcttggatccagatctgtacacaaagatggattccatctgcaactaggaaggaaggggggtgcaggtgttttatgcaaacaattcttgctaactggaataaaacaaattagatgagaagaatgtagaagttttgtaaacactaccagagtattggggtcaataaaagaga

SEQ ID NO: 131322 - DNA, 1031 bp, Homo sapiens
gcacaagaatattcatagcaactttgactttcatagctgtaaactgaaaattacccaattatcctttgacttagaattgataaatcaattgtgatgtctttataaaatggcctcctatataggaggaaagcaaatggaccatatctatgtgtttgtccacatggatgaatactgtggagcaagaaagctaatcacagaatacacatactgtaacattccatttatatgcagtttatatacaaagtttacaaataggagcattttaatgtatatttggaaagatatatgtatgtaaattgtaaagaaaagtaaatcattaacacaaaattcaaagtcttggttacatctgaggagagcatgggagggatggaatcagggaagggcttgtatacagttttctctatgttaagctcgtaatagatacacaggcatttattgttcttagctagactctacactctacattttgtattgtctgtcatttcgtaatgtataaaacaaaacatcattatgaatgtggatggaatacacattcttccttgatatgttgtcctatttctctgtcaaaagcatcatttctcgaaaattgccaaagccatatgcaggaaacctcacagagtaatgacttcagtattttccttttgtgcttatttggtcaaataagaatttgaccaaattctcctattttatttttcttcacattcttctgtgtccacacttttacttatactggaatcataggttcatgtcatgcagcactcttaactatatgctcaacttggtcatctacaaatttcttccctgagctacttccttgtctataaagcagaaaatgtaatacctgcctcatactacaggagtaaaaattaaacaaaatgatatcagcctgtaatttagtgagcaccaaataaacattaactaatattgattaagaaatgcaataccttacgttgagtgcagcgcaatgatgggcacaaagtagacactggatagatcacagccactcttagtgtcatggatccaggccttgc

SEQ ID NO: 131323 - DNA, 1011 bp, Homo sapiens
tgagccatggtgaacatggatgaaataaatgcctggctcctgaaaagcaccagtcatttgaatacatccatatggagggcttatctctacacttacctcatcatttcatagacaggcctcatagttaatatatctatattaattaatagttgtctatcagtctgcacatcaatatgccatgcaaccttaaatatgcagccatatacatcagacacttagaaatcggatcaagattgtcaactagcatgttttagaccagaatgtcattcattctaaggacttgtatctgttttgtacactgttgtatcctaggcacttagaacagtgcctagcacagagtaggtggtcaacagatgtttgttgaatacatgatgaacaaatgaatgaatgagtgagtgaatgaaccaacacttaataattaggcatcaagaccagagcttagtttgccttattttgtaggataacacaagatggcaaatgcattttgataataggtgatgaatacacaataaagataaattggcatggtagaaaggcatgtttctattccaatctcggctgtgtcagcaaatagctgctatgtcattctttccaccaatgttgactgggtacctactatgtgccttgcacttcaccaagtgctggagatatgtgaagagtgtaacacatgcaggctgtgccttcggggaatttacaatccagtgggagaaaaagatattaatcaaatattcctggaaataaatagggaattacagattttcttaagtgctaagcacataagagaagaggccaacctggcatgaatgatcaagaaaggcttccttttctgaggaggggatatttgagctgcagctagaggcagagggaacattttgaacacaagttcaagcaaaaactgaaagcattgtgcattgaagaaatcaagaacaaacaagtgtagggcatcacagagagggtttggagagcagtgagatagctggagagaaggttcttgtagctttttgttttgtg

SEQ ID NO: 131324 - DNA, 1054 bp, Homo sapiens
tttatatatcagttccctctagaccttcccatgtatcataccctatgattaaaggagtcgctagtcaaacttccttctgttatgcaaatgcattatcatcaccccttttgatgtctcccacacacagaagtggacaaaaggcaatgacttttcccagatataagaacatgtacctcctttaacccctttactgctccacactaccttatatgaaaccaaagcccaaagattatataaaaatagacaaaacagtgcttattattctgtttataagcaaacatgtaaaagataatttcagtgttaaaaagaatacaccaacaaaatgcttcaaaataccaactactgttcaaatatcatctcaatattctattacatatcaatttatagttatttattgctatgtcttttaaatatattaatatttacctgcttactctattgtacatttatgcttcatttattgaaacaattcaagcaagtgttgcttgcaatttttgttactataaataacaatgggatgaacatctctatgcctaaatctttgtgcatgtacctcatatttttaggtagattcttagcaggtgaatcccttggtaaaagtgtgtaaacaattcaaaattgtataaacaacaaactgtatttaaaaagtgtaaatgctgcaagaagtagctaaaataattagtaatggttatgtctgggtggcagttcactaggataggcagaaatcggggatcagaatcaactgggattatctagccagtctctttcacatctttttaaaaaaaattcttaaatattacagattactgataggtagtgcatgttcataacattgtatatgcctctgagcatgtatgcacttattctactggaaattcaacctacaatttatataacatgcaagggtaaacacatcttacccattttgaaataaacacaatgcataaagttgtttataagaagtgcatttttgagcattcatttatggaatcaattttatgtacttgtatttcttaaaggttaaaaggtttaaagatgtctaataacaaatgaa

SEQ ID NO: 131325 - DNA, 1043 bp, Homo sapiens
taatttttttgtatttttagtagagacggggttttgccatgttggccgggctggtctcgaactcctgacctcaggtgatctgcccaccttggcctcccaaagtgctgggattacaggcataagccaccacaccaggcctcttaaaactttttcataggaattttgtttagtgctttaagcagagagtacacaatggtgggcatgggccatttctgtgaatacgcatgtctgccacacagacggtttcagaaaatttgaattagttgccaatatttaaaaccagatttcaacaatttaaaatataaatgtttatcttctgttttaaaaatttaaactattttgacactgggcctgtcatatactgcctgtttgtgccctcccgaaattgatatgtcaaaacactaatcccaatctgatggcatttggaggtgtggcttttgggaagtgattggatcagtgcccttataaaagcggtcccagagagctctctcacttgctttccactacgcaaagacacaaggagaggttggcatctgcagccggcaccagaaactgaccacgctggcatcctgatcccagacattcagcctctagaaccatgagagataaatttctgtggtttataaactacccagtctgtctgtggtgcagcctgaacagattcagactgggccacagccacacaatgcaataatctggtgcacagaggtggtctcttagactatggcatattaaagatgtttgtaaattatttaacatttctttacttgagaggtggggtctaggtatgctcctcttggatctggaaaggcttagtgactgctcttatcagtgaaatacgagaggtgaggctaagctaggcatacactggctcattttctatctgttgggacatgtgttcagggcagtgaggcaccatgtcacaaggccagctaccctgagaccaccatgctgtgagaagaccaagccacatgaagaggccctagaggaagaaacaccatgtggagaaagacagaaaggtcaaggagcgctaaggtgccaga

SEQ ID NO: 131326 - DNA, 1072 bp, Homo sapiens
tataatgacttcttttcctctgggtagatactcagtagtgggattgctggatcaaatggtagatctacttttagttcttcaaggaatctccacactgttttccatagtggtatttttaaatgttctgctgagaaatatttatggttattatccaagtcagtatttttactaagtacctgctgggtgccaagcactctctggactcaaatgaacaaagcaaggcagactcctgttatttctggactctgcaaatgtgatttaactggaggacaatacaaggatatctgtgatttaattctcatttgagccatatataattaagtgctctggaatacctctgaccagtagaacttctgaaatgatggaaaggttctagttctgcactgttcagcatagcagccactaatgacatgtggctattgagcacttgagttgtggtcagtgtgactaggaactgactttatactttattttaatgtgaataaccagaggtggcttccagctaccatactgaagagcatagcatcagtaattctgaggagggatggtgtggactccaagaattcaggaaggaagaaacctgagcttagaaataaggaggaaactggaagaaaactccatttagggtggtagcatgagcaaaggctgggaggaaggaaaaggtatatggtttatgaaaattacggaggaaaggaaattgagggaaacaagatgagagaggctttctgaaaataggaagaaggttctagaatctagaccattcctctactttacatgtttgttgtattttactagcaccaaacctctcattatttggaatagtggttgcatagtgtttaacttttttatgccttttataaataattgttttccacagagtcatcatttgcaatgtacaagttgtttgttgaaatttttaatatcagtcagatgggaatctaaagagaattcaaagaagccattacttagcagaggttaaaggaactcaaaagggttgttaagtcacccaggaacaagcaaggcagaggcctaagtggcaaaagtgtgggagtgtgttaaagagctctgagaa

SEQ ID NO: 131327 - DNA, 1035 bp, Homo sapiens
tatggaggctgagaagtcccaagatctgcagttggcaagctggagaccaatgaaagctaatggtgtagttccagttcaaatgtaaaggcttgaggaccaggagagcagatggtgtgagtttcattccaaaagctggcatgctcaaaactcaagacgagctaatgtttaagttcaggtctaaagacaggaaaaaaaaacccagtgtctcagctcaaggcagtcaggcaaaaggagttccctcttactcttactcctgggaaggccagcctttttgttttattcaggcctttaactgattggatgaagaccattgacatggggagggaaatctgcctaactctatttaccaattctaatgttaatctcatccataaacaccctcacagatacacccagaaaaatgtttgactaaatatctgggtaccctatggcccagtcaagctgacacacaaaattaaccatcgcagtgtgtaagatgactaattgcctccaaagcccatgctctttccactcccctatctgcctgctgtgaagtatttcttatttcaaaaatacatgtttttcttttgcaagaaactcaagatgcacttaaagaaattaacacttgagactattcaaataaaagatttaatagcttgcttatcaaaacatagttatcaccctccatcttccattttgcattttttgggctgctaggaatatgtggtgtatggttttgctgagatgtttcctgcatacctgagctattgggtccctaagaaatcaaatttgtttgtttttcaacttggcatcataatgaagcagagatgtcagcatagcatttcttagtgctgccaatatcttgagtaatcttaatcttgttagatcaataatgtgaaattttgctagttgccattttaattgatttaattgaaattgatttggcataaatgagtggacagaaatttattaacagtgaccatgagggtttgaagtatctgctatgtaagaagtatgtgactttgatttatacatctaaaggctccctctttccaa

SEQ ID NO: 131328 - DNA, 1033 bp, Homo sapiens
aatttaagatggtcataaggttgcattgttatgtcaccttgaccttgtggcttgactgtggatttgaaggatcttaaattactaatgttacattgaagaaagatgagttacaggttttcaacaattgatattggttttattcttgaggataagtatagaccctacagtctaatatgtgcggtgttcaaatgtcctatgggatttttagagagtcagttgatttagaacattgacatgtggactggataagaagaaatcaaagccactttcagagatgcactgagatgttctggcttttctaagaagaaacagaaaaatatgccatctgtgtgctttaggacttctgtccctaatattgcatattaactaatttctctgtggccttttttggggggaccaccaattctcggtgtctggcaaaaacccctgtacagtgtagatgttcaagcctcccattgtatcagaatttctacatgccaattctagaaggtaccatgtgcatagactacactgtgaatggactctaaagttgtgcagccattggtccagtcttgagccccagacaagaataaagccttctatccttatccttctctgaaataatacttccattcttagtatcccccttttcattttgttcatttttattttattttattttattttattttattttattattttattttattttattttattttattttattttattttattttattttattttattttattttatttgagacagagtttcactcttgttgcccaggctggagtgcaatggcgcgatctgggttcactgcaaccttcgcctcccagtttcaagcaattttcctgcctcagcctcctgagtatctgggattacaggcatgtgccaccacgcccagctaattttgtatttttagtagagacgggatttcaccatgttggtcaggctggtcttgaactcctgacctcaggtgatccacccaccttggcctcccaaaatgctgggattacaggcatgagccaccgtgcccagccctc

SEQ ID NO: 131329 - DNA, 1029 bp, Homo sapiens
agtggcaaggacccaaaggggttttaaactttttcacactttcaaattctaggacaaaatggtttatctttcctttccattttttcccctcctttctctctccctcccttccttttctttctttgttttctggtataacttataaatagtaaagtatacaaatcttaggtacagctcaataaatttttacagatgtgcatacacttatgtaaaccttactcagatctagacataagactatttctagaaccccagcggctcccatgtgcatccttccagttgacgtcttccaaggtaaccactattctaacctctgccactgtagatcgcttttgctttttcattaactttttttatacctggtttttttccacttaacatttcgtcttcagatttatcggtgttgagtatggctgtagtttttgttgttcattgttgaaacattccattgtgtaattatattttaatttatccattctattgctgagggacattggattatttccagtaaagctgtcatgaactttcttgtacatgacttctggtgaaaatgagcactcattttcgaaatggaatcgttgggtcttgtgtatatttagcttaatagatactccaaagttttcaaaagagattatttcagtttatgctttgaccagtattgtaggatagttccagtttctccacatccttgtcaacacttgggattgtcagtgtttttacttttatccattctggtgcagttgtaagaataatccattcatgaattaaataagacagttttaagatgaatgaaagaaagtacaggttcaggaagagcttataagggtaccattagtaggctgggcatggtggttcatgcctgtagccccaacactttgggaggttatggtgggagaattacttgagcccaggagttcaagaccaggcctggcctcacatagcaagaccctgtctcttaaaaataataaaaacatgaaaagcgtattacaagtagaaaaaaaagtaatggacttgtagagctgatatttc

SEQ ID NO: 131330 - DNA, 1059 bp, Homo sapiens
gtctcaaaaaaaaaaaaaaaaattaatataccacatgctctcttcctgtcaagtcagagttcccatccttacagagcctgcatgttattgggagatcaaaaattagacctattagaggcaatcagctaagtagaccaatgactcttttcctttagatggcgtcatttatggtgaggagcctgatgtcatgtgttattgatggaggaaactgaagtccacacatgtaggattgatgatatttacaatcctgtggcactgtttcagtaaaacacaactatcttcaagagatcttggccaagatccttttaggacactacgtttgatcccccatgttccctgttgaaattcttattagagatatttttcaattcccatattaactgtagggtaatgttactcttaaatgtttagaatactcttggcaagcttcatatctttgatacctatgaaagatgagagaaagattggactgtggtgacctgcaatagaatacattccattcattattcacggtgtgtgaccttcgccaagtatgtttaacctcactgagcctcagtttccctttccctaaaattaaattatgataatacgtatcttataaagttggtattggctattattattgatccgtagttgcaggaactccacatcaaagtttgtgagaaagcactttgcaagtggtaaagaattataaacatatatgtgttacagatatacatttgtatgtaaagaattatataaatgcgtagatatacacatatacttatgtgtgtaatttttgtttttttattgtttagaagcatctcactaatctagttaaggccctaaaacctagcaattagtgataatttctccagcccatgaaaattttgccttgcccagtgtgttttttagtaataatgattattttaaatatcaacccatttcctaaacatatacttagcatcgaatactcccaagatatttctctagtaactcaaggtagaaagaattcagaagatgtgattctcgcccttccttaaattatcatcatgttggggaaaaccatatatcttaaaa

SEQ ID NO: 131331 - DNA, 1022 bp, Homo sapiens
atgggacaagaagttcatgttttttactctgagccttttgggataacttattttttaaaaccatgtgcatactttcttttatatcaacaaaagggttagaaataaacaggataaaaagtgaataatagaatgactataaaggtgtaaaaattgcttaaataattaatcaaatgagggcccattattatttattaggaatgtggttgtaaagatacatgcatggacatggattctggaaaaagtttatataaataaaagtaattatgctaatgaggcaaattctcagcaaaaattttttctaattgtatgaaacctagtatttgaagagtaaatacaaatgtataagaatatgtataaagtaaaaaatctattataattcatttacctctagcttatccccttctcactatgttggtggtgagattttcaaagctctgtcaatcttagattgccagactgttttgtctgaattgaacagtccatctgaactggagtttgctcctgtgttaatcacttctggctgccataatgaggtaccacatactgggtgccttaaacaacaaaatgtattttctcccagttcaaatgtctggcagtctgagatcatggtgccgatgtggtttgattttggtgagggtctcatcgtgtcctcttttgcacagaggccaccctccctctgtgtggtggacagagagcgagctctctgaggtctcttatgagaacactaatcctatgtatcagggaactaccctttatgaattcatttaaccttaattacttccctaaaggccctgtcttggaatacaagttgggacttagggcttcaacatgtgaattttggggagacagagatattcagtccataccagccctgtcaatttattcatcatttggctgaattaacagatagataaattgttttaacaccaagaaatcatggacctggggttgggggtggctaacttttaaagcccaagaatgctagtattggaaactttgtatagaccaccccctaccgtaat

SEQ ID NO: 131332 - DNA, 1052 bp, Homo sapiens
taaagcaagtgcatttctttacaatggttatatgaggggacttctcccagcctttgtttatttatttatttattttttgcaaggccagaaggtaaaggacagtatataattgaaggatcagctgaaatcctaatccttttagcaacactgttgctcttatgagcttctcctgtaagctgcttctaaaatattattttcattttttagttgtggaaactcagacatagtctcacagagagattaaatgacctccctaaggacattcattgcgagtcagaggttgatccagtaatctaattaaggccctataattccagcagtgttgccaaaaccatacttttccctcctcctcctgccaaacccagtaattgagtatgatgacctgcctgcccccttgtgctgaaggccgtctgatcccccccagctgaagccatttgaccacatttaaaggttccacccaggccaagcgtgtgggatgttggtcattaatcagagagaatttaagggaccctcatcaggagtcagattttgccacctgggttttttccggcttagcctttgttggagcagcctagccccattttgtaacgtggtacttgtaatttctgttccccttcatcaggattctcccattcgtcttccagttcctgcaaggctgggagagccctgccttggtgcctgtcccaccttcccagagcccaggtcctttccccaaacctgtgccaagcagtgggagcccggttttctcctgcccactcgccacctgctcaacttcccacacgatgctgaatgtcacatgtgccactgctgtgctctctgtgattcctggatgaatccttgtcttgatcctagactcctgatctcctaacacctgcctgagtcatggcgtcttaccatgcgcctagcagctatgctgcacctgcctgcctggacttctccccattccctactgctgggtcagccccaccccaacgagttcaaggttctagccccaccacctgggaagttctagtttcttggtctggaaagaagccatccattccccacaccag

SEQ ID NO: 131333 - DNA, 1100 bp, Homo sapiens
aagtagatggccttgatattataaattgtattatttcaaaacataatttcaaaaagattaatattagtaacacattagccaacatttaatgagcacctaaatgtggcaggcactttcctaaattctctctatatattatctcatttaatccttactaaaaccctaaggggtaagtgctattattatccacattttacagttgaggaaactgtgactttgggaagtatcagtcagtaaccgtggagttcatccaggcagcgggatcaaggttcccattctcttaaccaaaaattagacaaattaaagagataaggtaaaaaaaaaaaaagcctacatgaattaagtgaagattaattatcttcctgtagtatcaaaatgcattagttagccagttttcaactagtcatcacatacatatttatttattagctgaagtgattatgtaaaaatcacactcagctgaacttggaagaaaagagatgtttgacagggtcaatatatttggaactgttttttagactgggagagaaagtgaatgccatgatgtcatacttccccaaagctttggaatttgggcttctgagactcatgtgctgtggcttgcttaatgtccaagattcaagtcagtcctattttgacaggggcatatgtcccatgacaatctgatgacttcagttgacacaattgcttctcttccagtttcatacgttactgcctaagctcaccctacattctttaacaccttccactagtgaaaatagtgatggcaactaacctttcctgaaaacttactgtatgtcacacacttgtgtcatgcactttatgggcactttttcatgtgattcttgtaagtactccataatatacagactttcatatccccagcctgtagatagggaaggtgagcttagggaagtttatgaaacttgcttatgatgacacaggtgacagattcagaactgggtaacccctgttttcaccagacattatttggggtagatggaaggcattcattcatcagatttttattatactatgctttgtgtgggacactatgctgagcactcagaggaagaaaatggtttttgtcctcacaaatg

SEQ ID NO: 131334 - DNA, 1031 bp, Homo sapiens
tgttaagtcgtacagatgtgggggttgttcattactgcagcagaacctagcctattctgacagataatagcctccatcaaatttccatctagataagccagcatgtattcactggagagtgcagggggtgtaaagtgaacttggtggggagataaagcatatatggaaaatacttcatagcacaagacactatactgtctgaggaaaggttctgtgttttgactgtcctctaggtctatctaccatttctatgatatatgtcacacctaataggtgccatgtaggtatttgttgggtgaatgagtaaacatatacttttattttaatgtgaactctgtgtattctttccatcaagatatatcttggcaatatcattttttgtaatcatttctattaattttcatattttctgtgctatacaccataagccatgaaaattctaggtgtgaacactgaccttttccaggaatttagtttgggtaaagtatatctgcattattattaaacagctagcgtcatagattttagaggaagaagaaaggggtgcagtcgtgacattattagaaattcagagcagtgatttcgcattctgatttggtgatatgcctggagctatccacatacctctagcagtgttgcgaggtagtaaatgctacaggcataacatgccaacaagcagatcttaaataaaatatattcgtgtatattaactttcttattttatatttcattgcaaacacaatctcattcttctctatattttttataccataataatggacctgtcttcaagggaacagcatctcgttgtataaacaggacccttaagctgagactgttcctgtgacttggcggtcattgaaaagattaaatgggttgcaaaacaccgtctttaaaagtgaaggtaaatttgtctcagctggaatcagaagccagctgggcctaagaatgatgtctatgtctacatagcatatcctgatataacacatgccttgccttgtttcagttcgttaattatctgcttcctgttc

SEQ ID NO: 131335 - DNA, 1045 bp, Homo sapiens
caggaaataggaatagggcaaggaagtcatgtgacacaggctattactagggggcggttaatctacaaaactattacaaaatttagcctttgagataccccaaaaagaggttaaataagcaggtttgaggtatgacccctactcaatatggctgatttgtaaaatgagtgttgttgtgcccctcagactctacaaaatcacctctgcaaccgttttgtgatgggattaatttttcttttagttctgctttgagtgtttattttaactggatttcgcctgggcagaaaaagaggtggtggttctaacagaggattgacagagaaaatgcgagatggaggaagagcccaaggagggagatggaggcagagttgtaatcccttctcctgactccaggtggcgcttggtttctcaccaaggtttagcctcaaaacactttctcaatttccttagaaaggatgaaaggcagcgtaatcctgaaacaagtggccacctatctgtggattctttatgctttcaggatgcatttcagcctcatttgaagttttctagagggtcagaagggcttggcgggatgaaccttagaagtgctcttacccgtgaaaagggatccctgagcactgttcaactcttcgtgaatgtttgttaagtgaatggatgactctaatgcctttccattaaaggacctgccctattaaagaccgattcccagccccagaaataatcacttaagtttcttaatttctcttcataatgcactactggtaggagagctcattttctagtattacaccaaactgcagtgcatgatacatttcctttcacttgcaagaaagccctacagacggcattaatggatttattttaaattgctgtttgtgaactccaaataattatataaaattgttttttaatgttcgcataattttttcatcattaaaagccaccaagctctttaatactgaagcagaatcaaccattgaacataaaaaatggttaccttgatgtgtctaatatctctgcctcacacacacagacattctttgct

SEQ ID NO: 131336 - DNA, 1029 bp, Homo sapiens
tacttacccctagaaggagaataagagtcagccaaaaaaggaagattctccattttcttagaactgttttggaatatggaacttgtagaaatagcacctctgcacaaatcctgttagaaaatcaatagatttgtctgaaatagaaaactatcagctgggcacggtggctcacgcctgtaatcccagcactttgggaggccgaggcgggtggattgcctaagctcaggagttcgagaccagcctgggcaacacagtgaaaccccatctctactaaaatacagaagattagtcaggtatagtggtgtgggcctgtagtcccaggtactcgggaggctgaggcaggagaattgcttaaacccaggaggcggaggttgcagtgagccaagatcgcaccactgcactccatccagcctgggtgacagagtgagactccatctccaaaaaaaaaaaaagaaagaaagaaaaatataaacaacagcaaagagtcacaagttagatttaaggaaaagtggagtcaacaggaaaagattattggaaacaacatttacagtctaagaaaggagaaatagaaacttctgggcccttttaaggactagtctgccctgctgtacccaggatagcaatctatattcccagagctcctaggtttccctgcactgagcaactatatccatttcatatgaacattgtaaacattatacaacttctgtccaaaaaagttatacaaaattgagatatcatcacaatagccaatgccagcacaaatgaaacaactagcaaactattgtaaagcagtttttagatagtacataatactaggatataaactgtataagtaatacttgcaaagcagagggcaataactaataagtgtgtgatacaggtaaggaaaggttgaagaagtcagtggcaaaataaaagatccaacaggaggtggctctggagatgtgagttgctatgcatttgagattttctgcagggctccctagagagttctctcagcaaattcacaggccccagtgagaatgg

SEQ ID NO: 131337 - DNA, 1009 bp, Homo sapiens
cagagctaccaaagcagaatttatagaggtgaaaccaaagactctgcaattgtacaacaggtgattctgatcggtagcaaggttggggggctattcctggttttcttggtgactctttagagacctcttaatatcatgagccagatggttgaggttaaggagctctgccatttgtcattatgtgacctccggcataattatttacctgtacaaaccttgagttccataaatgtaaagggagttgatagtttctatctcatgttgttgttcagcagcttaaatgaggtaatccatgtagaacagcaggatgctaataagcttccagtaagtgttatttattatctatgggtagaattcatttaatcttcacacactcaaattttgccagctttaggacaaataagacttggagtctgtaatcagtcttgtgaaggacacagagaagtaaaacaattaacaataaaatacagttagattctttggtatttataaacttctaatttatgaactttcactgatgtcaacaaagctgggtgacattacagatgtgcaccagctctgtcctccatctatggggtatggttagcagatgcatgtacagtgttgctttaaacatagaagcaaatggatttctgaacctaacttcatagagacatgttttcttatgagctgctttaggagtacagaagaggttgggaggagcagggcaggttacagagtcatttgtgaaatgtcaaagacatttcaagcttgtctgtccattggacaaggaggcagtggaagtgtttcaatcccagggaatagcatatggggttccctgtattgtgaaaacatgcagtgactgagaatgggcagtttggtatgaggagaacacaaagttagaagcacctgatgcacttttgggccattctttccttcaactaatatttgttgagcttctatgatgggccagacactgctcagggtgctggggacatggccaagtgcaaaatagtgtctgctctgatga

SEQ ID NO: 131338 - DNA, 1008 bp, Homo sapiens
caaggttgagtgcccatgaaatagaactggcatctggaacagctgaaagtgtgagattctcatagatagaggattaatgtgtttctgggcctgtgttagttatgggtctcttgttataagaagcagagactcctgccagttaacataagcaaagaaggacaacttattttaaggatggggtggtatcctatagtactccatcatctgaaacaacatctttcacatattaagtatgtagtaaatatttgttgaataaatgcatcatctcaaccagaaagtcattagaaacccagaaagtattctgtctccaggtttttcctctgcttctatgtgcatatatcttttttcccttttcatccctgctactggcttctctgtttcccagtccacatggcagcacatggccacccatggatggcacttgagtttatactattcagttttagttgtataatgaggctgacttgacttcctcatgcccaactctaaattctgaaaaagagagaatgtgattgcctgatgagagctagtggcccacctgtgacacaaacatggtgaccagcagttcttccccaggaccctgtggctctggggtgggggtatgggcagcattctcaaatgcaaagaaattaatttcagactaggaagaaactcccaagagtgtccactatgagcccaatcagatagatgtcataaaaaattctaaagctaactctccatgtaccaagacaggattttctggggattggtggttgaagctggagtcaaaatagttcagcctcctgatcctgggtagaagtcagccatactcttcttctagggtaattatcactcatgttctatgccagccaagagaacacagaattgtctttagcgaaagtgtcaatttgaggcttcctaattttcatgatagcagctacttggtactgaataataatggaattctattcctggacttcgtgattccatctctgagcaaatgcaaagcagatcttggcaggtatatct

SEQ ID NO: 131339 - DNA, 1082 bp, Homo sapiens
gaatcatggggatggttatctccgtgctgttcttgtgatagtgaatgatttctcacaagatctgatggttttataaggaatcttcccccaccttcaccctgtacttttccttgctgctgccatgtgaagaaggacatgttttcttccccttccaccatgattgtaagtttcctgaggcctccccagccatgctgaattgtgagtcaattaaacctctttcctttttaaattactcagtctcaggtatgtctttattattgcatgagaatatgagaatggacaaatataaagaaaatgataaaggttaaagttttgtatatttataaatgcttttaatttctattttaaattaactgtacagaagatcaatgcagataaaatttaaaatatagagatgtgtttttcttaaaaatttgttttcaccaaatagatttatttgctatacattatcaaaagtttcaatttttgtaatattgtggtcaaaacagcattattaaatcattaaatgtgttcatttttagtctgtttccttctgtttttgttttgcaccctggggagagggttttgtggggtttaaagcttacatagtttgggaaattttcctacaaaatttgaaacattaaaattagtatagtgtgagtattattttagaataataacaaaaatacaaatttaaaagagctgacaaataccacaaacatcacaaaatacagaaaaataagtttttattatctgagtgacataaccctgtaaaactttttggttttcatattttgactgtttgctcattaactgtctctttctaaaacaataagtttgtattatttttctatattaagaacagataatgcagtctttcctctattgtgtttgcctaaaatttcttggtattactgatatttggatttatatcatgtgacctctcacatgcgcatattcactggttataataatgatgtaggtttgagccctaaaataggaattattatacattctacctcctactattcggtatgaaagaaaaaaaaataaggtatgtttataattgtacatgctctcttgtcaaatatgttccacatttc

SEQ ID NO: 131340 - DNA, 1382 bp, Homo sapiens
aaaggagtaaaaatctatactagcctttgaaattcgggaaggattttatgcattccagtagacacaagagtggattgaaataactgatcagttgaggtgtcaacaaaggaaaagctcattaggagaaaaaatcaaaaggatctcactctaattctgtggaacaccaaaatactgctaagttcagagcaacggctcagagcaacagcaaagatgtaggacatccattgtagaacacatctccattctaccagcatttcatgcaaacagcaccatgatgacacaagaagcatcgtggactgcatatgttcaacccaagctgtaaccacatggctagctggctaaataaatcagaggatggtgtggttggtgcactgagatccacagctccaagagccagctccacctcttactcaccaccttcatcaagtagatattcaaggaagaacactcactggaacatagatgtacagaatccgcaaagatctgagcaaaatatcctgaccaggttctggtaattgtggaaaagctctcaggctctcaggctgttaacactgacaaccagaggaagttgggtccagttgatgccactgtagctcatttaatatgaatcaccaggaaaaggattcagcttccttctgaaaaggagatcttcctgtttgtgaacaagacagtcccatagtccagcctaactatgggacagcttttcagaaggaaaaagatgaagattgattcttgtatgttctggcctacagcacttggaacattttgggcttctgagggccattagatgtgtaggtgcaccgttcctgtttgtgtatcttgtaaacagccagccattttcagttattataccagaacctattcacatagatgaacaagtgcatttgtacctggatttatttcataatattttgaaagatttgtttctttagacaaattatcatgtagagtttcattttgagtttttctttttgtgcactgtcctcatggctttattcttgagggaacttgttcttctgaaaaccatatttaaggaaattatttccagattgaagggaggtaggtgtagcattaaagtgaaagggaaggagatgatacctttattctggattatatgtgaagcattagataggtaagtattaaaagaatataattaaatccttagcaatcagaacacttgcttccccagattttgccaactgccaatcatgtcggactgagctagtctgttcttcttcctgaaattactaaggtaaataattaacaataaaactatcttttataaagtcaaaaaaaaaaagtaggggtgatgccatggcagagtcatacggagaatagatgtgtcaggaaacacatagctaacttcagctggcacaaaccct

SEQ ID NO: 131341 - DNA, 1050 bp, Homo sapiens
tttgtgttaatagtcaaatacttacctttggagaatacttacctttggaggaatgtataaaatttctcaggcagagtcctggatataggaaaaagtaatttatgaagtaaacttcagttgcttaatcaaactaatgatagtctaacaactgagcaagatcctcatctgagagtgcttaaaatgggatccccagagaccattaaccaatactggaactggtatctagctactgatgtcttactttgagtttatttatgcttcagaatacagttgtttgccctgtgcatgaatatacccatatttgtgtgtggatatgtgaagcttttccaaatagagctctcagaagaattaagtttttacttctaattattttgcattactttgagttaaatttgaatagagtattaaatataaagttgtagattcttatgtgtttttgtattagcccagacatctgtaatgtttttgcactggtgacagacaaaatctgttttaaaatcatatccagcacaaaaactatttctggctgaatagcacagaaaagtattttaacctacctgtagagatcctcgtcatggaaaggtgccaaactgttttgaatggaaggacaagtaagagtgaggccacagttcccaccacacgagggcttttgtattgttctactttttcagccctttactttctggctgaagcatccccttggagtgccatgtataagttgggctattagagttcatggaacatagaacaaccatgaatgagtggcatgatccgtgcttaatgatcaagtgttacttatctaataatcctctagaaagaaccctgttagatcttggtttgtgataaaaatataaagacagaagacatgaggaaaaacaaaaggtttgaggaaatcaggcatatgactttatacttaacatcagatcttttctataatatcctactactttggttttcctagctccataccacacacctaaacctgtattatgaattacatattacaaagtcataaatgtgccatatggatatacagtacattctagttgg

SEQ ID NO: 131342 - DNA, 1357 bp, Homo sapiens
ggcattaaattggtttctttaaaatgctttggtggcacttttgtaaacagattgcttctagattgttacaaaccaagcctaagacacatctgtgaatacttagatttgtagcttaatcacattctagacttgtgagttgaatgacaaagcagttgaacaaaaattatggcatttaagaatttaacatgtcttagctgtaaaaatgagaaagtgttggttggttttaaaatctggtaactccatgatgaaaagaaatttattttatacgtgttatgtctctaataaagtattcatttgataatctttgtggtcatcttttacaccattcactttgaaattcagttaaaggtttgatataaatttggcagagcttatagaattataatgtataaaaagttctgttttaaacatttctgtgtaaaagtctctcaggaattgtcagtaagtcttttttctttgatgaaggtgaaagaggcaagtctttggaagtaacgttgcaaaggaagtttaaatgagaattctgttttgccgagtgtgatgacttatgccagtattcccaatactttgggaagccgaggcagaaggatcacttgacactaggaattcaggaccaacctgggcaatatagcaagacctcatctctacaaaataatttaaaaattagctgggtgcatgtggcacgtgcctctagtcccagctacttgggaaactgaggtgggaggattgctttagcccaggatgttgaggctccaacctgggtgacagagtgagaccctgtctcacacacacacaaaaaaaaccactatccatgctaaaaagaattgttttatttaaaaagcattcatttataccatgttttatatgtttcaggcatttttttcacatattcatttatttctcatcataacaaccctatgaggtgtatactcttatcccattttaaaggcttggagactaaaaaaccttaagaaacacccagtgctgcctgcctagcaggtgagaaagctgggacttaaaccccaacagtctgactccgaagtgcagactcttaatttctgtttgcctcagttcacccagattttatatctatatccaaaaatgtgatcttttcttcacccagagaagttttagcagaatgtttaacatcatagttattgtaagtgtcatatcttagaacatttttgtcataaccaaggactcatgattttagctgtaagaatttaagccaaacctgcatgatggagaaaaggttaggccacttgcctctagaacggtccctgagtgcttgtctacctgagtgtttttccgctttgtcacttctggcatgaactatgggggctttggtctgctgtattac

SEQ ID NO: 131343 - DNA, 1044 bp, Homo sapiens
caggaaaggtcaggggtaaagcttaaacctgggaactagcatattgatgagatatgaaggacgagaagaaagagtaaggccttattttcattactctgaaacaccatacttcctcttttgcacattctgttccctctgcctggcgtgttctgcctgggaaacaccacctacttatccatgcttcagatctcagcttgggaggatcctttcctgacttttgaactacgttaaactcccctaccattgtttcatagctctacactgttccctttgctggtttgtaaatgacacacacactggtaatgccatagaattgattcatctcatgaatcacgacagctctcttgtctcttggcttgtgagatttggctcgtagcatgcatcctagagagaatttggctagagtaaggagttttcttcatgaataattgatttttggatttttgtctttgcacaggggtctggaattatttccaaagggtattggtgaagaaatatgcttcggaaagaaatggagttaacgtgataagtggaccaatcttcgactatgactatgatggcttacatgacacagaagacaaaataaaacagtaagcgtttcatttctactcagtgtgtgatttttaagtcccaagatctcactcaagaagtttttcaaatattcatatactagagaagagatgacaccccttaagttttttgaatttttcaatatatatatatatatatttttttgagacggcgtcttgctctgttgcccaggctggactgcagtgatgtgatctcggctcactgcaacctccgcctcctgggttcaagtgattctcctgcttcagcctcctgagtaactgggattacaggcatgcaccaccacatccagctaatttttgtatttttagcagagacggggtttcaccatgttggccaggctggtcttgaactcctgacctcaagtgttctaccctcctcggcctcccaaagttctgggattccaggtgtgagccactgtgcccagcctgaatttatcaattcttttgattaaat

SEQ ID NO: 131344 - DNA, 1083 bp, Homo sapiens
gcttactttaaatgctcattactactcactttttatgctgaaggaatgcatatttgagttgctgtatgcatataatgatcaatgtgtgccttcttcttaattaaatcattggtgtacctgataagcctcttcaggggtcaaaataattaattctacagaaatccaatcctattggctttccattcagctgaatcatttcaaaatttattacataatgtttcctttatatacaaattgtaaattctttacaactaaaaaaagcattctgtaaatacagcatttacattatggttttgataactgtaaagcttgacccatggttaggtgatcagatcaaccacaaaagtgttaggaaaactagcttgattaaattaaggagaaggtgctatattaataataagtaagctagccattttaggtaacttgactcttccaacatttctttaacatttgatgtaaaatttaatatgcacctaacacagtttattttttttcttttttagagagacacctcctctatgggcgacctgcagtgctttatcggactagatatgatatcttatatcacactgactttgaaagtggttatagtgaaatattcctaatgccactctggacatcatatactgtttccaaacaggtcattgagaaaattggattttatattttttattttattacattcctcatgttaatacaatgattccttgcttaacagaattttgtcttagaaaatattttattttttcttaatgacagaaatcctatgttggatttattgtaagatattttgaattagcctttattcaatgttctggtaattccatgggaatatgttaaactttgaaggtagatcactaattcttttattttcttttactctgcctaagtcattgcccaatagttacagaaactgccaaggtttgtttatttattttaatagactttatattttaagagcacattttatttctcagcaagattgagtgtaaagtgcagagttcccacatactcacccaccccccttcaacctcccccactatcagcatctgttttttttttttttctaatgttttgagaccg

SEQ ID NO: 131345 - DNA, 1050 bp, Homo sapiens
gaaaccccttctctactaaaaaaatacaaaaattagccgggcggcagtggcgcgtgcctgtaatcccagctacgtgggagactgaggcaggagaattgtttgaacctgggaggcagaggttgcagtgagctgagatcgcaccactgcactgcaacctgggcgacagagcgagactgtctcacaaacaaacaaacaacaacaacaacaaaaaaacacacacaatcacctcaaacttaagagcataaaaataagacacatcttcttagtgaatcactgactctcagggctataaggagctatagttagtaaggttacatctccattgctctgctctgagtggaacgtgagtttcttacttaaatccctgaagtgtctttttataccgctgaagcttaaagtttgtgtattttcatggaaacaaaccctcatggatacattcagcaagcatttgttgaatactgacactgggctggcactggttactctgacacaactgtaccactgagagtttctaattcatggcttcaaagtggtggcataaaatattaggggggaatctagaatagctcatgctattctaagtctgctcatggcctagtggcaccaacatttaatgacacaagagagccttcaaaaatatttgtcttattatgtgcaatgcatttccttgcttagatgctggaatatgtataaacctcaatgctctttctcctgttgctctctcctatcgctgtctcttgggctttgtttccttttgggctctatcttggtcatttcttcagtggcaaagcgatgttttcttggtctgagttctttcaggcctttatggtgtttcctgtgtcataaatttggcctcccatttaaaatattcagtgtctgccctactggaggagatccttgtgaatgtgaaccaccatgtatgtgagcacacatgtattatgttcagggcaattacttcccctttctaggtacctttgaatacatatgaaggcttttaaagtagtttgtaaacctaaacttctatacagatgtaaagttgtactattttta

SEQ ID NO: 131346 - DNA, 1034 bp, Homo sapiens
cccagagaagtgcaggaaaaagtgatactgacattgatcacccttgggttgtaactatcgcagatacaggcaatagttaatcaaagtcttgttccttcactctttctttctgggaatctctctctctctattcatggtcaggcaatgaacttgggtatttcagaaagctgtggcaagatgtagttagtccagaatggttcaggaggtaaggagggggtgcctgccatctacatttggttttgtccagttctgatttgtgttcacagttttcagacccatagaaggtgaagggttttaaatcttaccatatctcatcaaaaaaatataagaagcacctgcctccttttcttaattttcattagatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaaggtagaaataatctttatgtttattatggagaagtttgttgggtggctaacagtgctggcccatagaactttctgtgacaatggacatggtctataattatgctgtccaaaatggtagctactggctagtgtgactgaggaactcaaatttttatttcattactttataattaaagagccctatgtggcttgtggctaccatattgaatagcacaggtatagaccatgaaagacaaaaagtagaattcatgttgctattctgtgcagtcacagttctcaaccaaaatctttttctgttttcttcaactgtggatcacatgtctattagtcatggtcccgacgggagacaggtggcccatatagaagaggttttgaaagagagtttaggccaggtatggtggctcacgcctataatcccagcactttgggaggctgagatgggtggatgaattgaggtcaggagttccagaccagcttggtcaacatgg

SEQ ID NO: 131347 - DNA, 1026 bp, Homo sapiens
agacaggagatatattagagagttggaaaatgacattttgtaaaagagacacagaactgtatattccatttataccacccccagctgggaagagtttgatgcaacctagggtttttttttttttttttttttaaagaatagatctttttcataaagactctgtcaatagttatgtttgttgttgttgttgtttaaatcatggtgacttcctttgtcttgctattctggctgagtgacttaaaatgtaatcgaggtaatgcactttcaaccttctagtgcttgcaagatgatatggctaagtaaaagtctagagaaaagattatacagagaagccttaaaccatttaaagtcaaatacaaaaatctcaaaagtcagggctcttcccattaagttactaaaaactaactaaagagatgcctggatgttatctttcgtgtctatgttaagattttcgttttagtcttgcctgaaaatattctttttctccctccccataggaatggaagatgtcacatgtgatagaactgagttcttgagtaattacctaactaatgtggatgatattactttagtgcctggaactctaggaagaattcgatccaaatttagcaacaatgctaaatgtaagttgattcttaaaatattaagtggttagagtggtaatacaaaggaataggtaagggcttgttttctaaagctgaaatacttgggtaaaaattctggctctgctaccgcttagctgagtgaccttaaataagtcatttagactctaagcctcagttttttcatctgaaaaatggggatgataaatgctagcagctacctgtagaaattaatctatgcatattgcttagagtggttcctggcacatagtagcattatataaatatttgctcttattcttattatgtggaaattgcacttagtttgaagcatattcatgaccataaacagaagtttataagataagaattttttcaataagaagttcaggctgatcatttttatagatgaaactagagggtc

SEQ ID NO: 131348 - DNA, 1016 bp, Homo sapiens
gacatatttttatcaaacactcagccatcattgtggaagacaatctgtgaggtagtatccagtataatttcaaattcagaaggtgggaaaggaatggttagaaatgttcccacattttcagcatagatagtaaaaaatatgatggagtttgcaaatctaaccttttaaatatttttaaatatttaagtagcctagtaacccataggacactgctgactataattaagttcattgttttcagatgaattagaaatacaggtaaacatatcttggtttaaacatacttggttaaacatacttggtttaagtatttttgacaatacttaagttttttgacaatacttaagtattttgacaatacttgcagcatgtgaccaaggagtcataagtgtttctgaatgctttgacatcaattcagaggtgatttatttaagcactagtaactaatagctacgtaaaaccactcttagtcttaaatcactgaagttatataagtcagatgctctttttctgtccctttgaagtttaacccgtcttgtatgattgtgaaacacaaatgataaaatgagataaacatctgcatacatgatgccagtaaagaacaccaaagcaagaatggctgttttatttttagattgactttctttgagattaacctaaagggaacaaaaggaaccacattttatcaaaatgttcacaaaacaaaacaaaacacctaagcagttccatgttccctacttaaaagtttgacttcttgggtaatagcatcccctcaaagaacctgtggggtaggcaaaacggattggtatagccatccttttaaaagtaggactccggtactttcgcttggctgctaaggggagaacctgaagatagcactacagaacttttgactcccagagcacactcccttccatggaaccatttaaccctcctgcagtccaggagataagcaaagtggtcagttaataactatgttcaaattatacagaacattttctttatggcaaaagttt

SEQ ID NO: 131349 - DNA, 1691 bp, Homo sapiens
gacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttgatcattctgtctttgtagctttttatattttgtgttaccttcttgtgtgtgtatatataataaacctgtccacatagtttgcagagagctttgtgaataggtgggatttttagctggcctcactaggaggaatgatttcagtaggctgagatggggtaaagttctctcagcagaagaaacagtatcttcaaaggtatgtaggaaagcaagggtgtattcaggaattagaaggctgtgcagttggcctggagtataagtgcaaagggaatattatcagatgttgaagggcctaaatgacagttatttaaagtttcaattaattgaatgttgtccaactgaaattatttttggaaaataggatattttagagtgtatagtgataccatatatagaattcccaactttgaaaattcaaagcacacatttcaaaataattacttgtgttataggaagacattgataaataatag

SEQ ID NO: 131350 - DNA, 1014 bp, Homo sapiens
aaatatggatttccttttactctgatagagacattcaggaaacaaagaaaaaaagcaattctggatttctagcttttcttgaaaaagtgtgagaggctttttagtaaggcgtgtgatctcttatgccgcacccagtagtctgtttactcatttatgctgttcctcaggacaaggcttttgagtttctggcctctgctttttattttattttattcatgagctgagatgaagtcctagatggcccccttagagccaaggagcccgatgataattgagaactggaatgtgttacagaccttgtctaggagggatagaaaaagaatatgggtttaaagaagagatggaaactgttaagtagaggacacattatggtttactttttaaccttgcttccccagttttccctttccttgcatttgatagtagaatattttagggcaggatcatatgtgggtgttagattaagccattgggatgagaagggagaaatggcaagagtattttccttcattactttattatttattttccttttcctgaggtaaggaaggggatataaagaaatggcctttatggttcccacggtgatagggatgaacatacaatattctctcccttctcaccacagcagctccctgtctgttactgcagagcttgaggtgactggactgtctcccaggttactgtagggattgcagtgctggagaagagaggccgggcaaggggaacaaggagcaagggaattccctagtggtttttgtgggaaagaagcggagagtttctgcagctgcctagctagggctgcagtattatgtaatgccttcttgcataagtcagaaaaacacaattctggtaaattttttaatttaaaaaaaaaaaaaaaaaaacttctttaaagcttgagagcttgccctagaggtctttcttttgaaaccagtacaaaaaacagactttgatttttttatccttaaattataatgatataattctactttttttttacagtgatctaaa

SEQ ID NO: 131351 - DNA, 1737 bp, Homo sapiens
caagtgatccagctctttttaaatcttatgctgaatatggccactttgtggacattaggatagcagctttggaagcagttgttgattatactaaaggtaatactttagaaatacgtgctcatatcattttagaaagaactatttactttttaaagccagtgttgttggggttttcgtaatatgtataacacagatattttaattttaaattcttgacttagtgatttagaaatcatctttgataaatgtagaattcacataagagttaataaatgagggaaaggaataaaattataggtatctttagcctttccaagaagtcagttttcatcctgtagctttaattggacgttattttaggaaatagaatatttttgagaaatttctaagaaggattcaagaaaacatctcacacctgtataaaaatttgtgtctgtgaaagtagaggactagacataaacacaaacttcaggaggggaattaggcaaggcatcatgaatatagaaaaaacataaggccaaaaaagtcgctaagggaagaatacacatatttttttttaatttaggggagaaagatacagagatggaaatgttaaaaagtcgtgaagaatagagcaggtagaagacaagctgtaatccaagaaacaacagaatactctgggggggcgtaaatgaagcagacctacagtagtttctgatgaaattttaatttttaaggctaagggaaaatgtgtgagtttctaggactatcagaaccagattatggtgcaaggcaaaagaatagtgtggcctctgaattctttagaatatgtagattcaaaagacagtgaacaaatggctatgtcatttttagggaaaattatgacccaagattttctgctttgccaaagttgttgctcatgtagccttggagaattaaagctgcatctcttatgtaacattcttaaaaacataactcccaaagataattttcagctgacctggatgtgagtcaaaataataactcaagactggtgaaaatgtgaaatgaaagaactagtgatgaataattatgcctgtcaaatacttaagcctaaatatttgttaaactggttgtaaaatgtaatgcatatttcaaaaataatttttaaaaaatatgaaaatagaagaaacatggaaatataatctaagtctaaaattccagattctagcactaaaatatgagaggagtaaaaaacttaaaagtatgctaaacttttatctgactgtggaaggagaggaagggctgagagaagttcttcagtagatactggttcatttttaagtaggggaaagtatacttacatctttgtaatttttggtaaatttctgtagaaatacttgtttacagtcagaaaataaagggtaataacagcataatgtgtatattcttatgtgttgacccaacttcgaaaaggactgtcatttgtgcttcctttttattgaaggttaaaatatcctttcctgttagaaataattatttataaaaacagtgattttgttgttaaatgtattttttggcatgaaagaaaatgtaatcctatatctctctccatttctgttttgacaagttttgagatccaccaaatatgtcattgttgccagtcttctttcccaagatgtatggatagtttttaatgtctcataaatatgagtaagattttataagttagtactaccttaaatgaaatagaatactaatattaggattttcaaaaga

SEQ ID NO: 131352 - DNA, 1137 bp, Homo sapiens
gttatcacaaaatattctcagcatgctgatagaattcatttgcttgctccatgttgaatttccctggccacagcatctgatttgctgagtataaatcaagccatatccaggtcacctttcaataaattgcttctatgagaattgactgccatgtagattaggatttgtttttttttttagtggcttccttctcttttctgtttctctggctagaactcctacattaaccctccagtttctttatgctttcctcctattttctatcattagttttccatcagtaaactaatgtattgttatagtgaatctcttactgttttcagagtgaccacatgcaaagggtggagttgaatgtttaccagaggacttgcttgtgttttgggaaaatttttattttatctaaaatgtaattatacaaattttattttgttaattttgatcagaagagttaattttgttatcttcacttaatttttctttggcctagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcaggtatgattaaattccttactttaaagttatatgttcttataactgtaaaagaaatttatttttgttatagaaaattgggaaatatagtaaagtaaaatgagaaaactaaaattctgtatgattctaccacccacagataaattattagtatttggagaatgtccttctaaattttttctctctttaactacataaatttttaattacttgagattatactgtatatgtagttttgtattctgtttatatcatactttctcatgtcatcacaaattcttcataagcattgctttgatgtctgcatattcttttatttcgttggattttatataaacattctctattgttagcctttttttaagatgacttttcacttttaccagctttatatggctatcatgcagttctgccaatttaagagtttgctaaaagttgattcaaacataaacaatttta

SEQ ID NO: 131353 - DNA, 1064 bp, Homo sapiens
gttacaaaatgtattttttcctgttagctactgtcaaaaaaattggaaagtcagtgcttttataccaattcacctttctgataatacttctagtggacaggagagagagagagattggtgcctaaatgaaacttgagtctcaaagggcagaaaaggcataagacaggtatttctacggaaaagcgcctttccctcagttgttcctatagtactaaaactgactgttgttgctcttgttatctctgcttcttcaagcaagaaaatgagccattttcctttctgacctccattttagaggatatagttattttgagtaagaagaggggctagtccatatctcgccatgtgctaaagactgagatgtctatgcatctgtagtcctgcctagcatttaattagctttgttttactgatagagttaaccagtgtgtgtaagtcatgtttctacattcttaaaaatgttgcctatgaaaatttggaaagagaaaaattaggctgcatttcagataatttaccattttgtccttaggttgaggattgggtgttcatgaggattaggtgttgggacaatcaatttgttctaagactgaaggttggctccacctacttatatcgtttattgctgaaaatgattgtgaggaaatgaggctcctactcaataggcaacgagctaaaggcacctagcacagaaggtagtagagcttaggagttgaataatggtccatctaatgctaaaatctgtaccttttccactgtatcacacagaagtaattctaaaatctgtgccttttccactgtatcacatagaagtgaatttatataatttacatcacatatatttcctccagcaaatgaaggccaaggcacatagcctacagagtgatgtgcagtcatggaactcttcccttagtttcctgcccagctcttctcttatgttagaatgctttgagatatgttgtcagtgggaggggttggggtgtggaggtgttaggctccatccagatatctatgtcagcccaagagtaacccttttctatttatagttcaatgaattgtagtaacaa

SEQ ID NO: 131354 - DNA, 1017 bp, Homo sapiens
tttcttaaccttctgcacctcagtttaaaatttatcttttttggaattaagatcaagtatgtaaagtgttttatgctatgcttatattaagttttctataagtggaatttttagaaagtggtggttagagtcattgttttaggaaaggatatgggaatgacaggatggtcagcatttgagctatttggatatcatacatagaggtttttttttagtaatttcataatgaaggcagagatcagattaactagattgaactagaaaggaggagtgaagttgaagtagagagaactaatgaagcctattctttcaagattttagtcaaagatataagaacggatactatgttgaggatgaagcaaggttgagaaaaggacttcttgggtttgttttgtacaggggaagaacaaacttgaggcatgtatgacacagggaaaagagccagtgaagaggcagagatggaatagtcaggtgggagaaagtaaatagagacggctgagcaagttctggaagtgttagagggtggggcacattaaggaagtaaattttagaaaacaacattcctttttttgaggcaggtggaatgtagattaaaaacaagtgaaaagatagatgttgaggggaatgttaggcaagttgaaatttatttacgatggaaaagaagtaggttgcacagcagcactggggtgccttttgagagtggaagccagaatgtatttatagtaaatctaatcaggacagattcaggatgatccaagttttgggaaaggtaataatggtgtgatcaaagaagtctgtggcatcctgttattttgtttttaagaactgctctgtattaccatttcacgaatttatggtatagaagcaagttaatttctgtgtccacctgatatatctgtctcatgatgccactgtgctttcatgtagcttaggtcagtgtttcaaattggagttatgaaccattagtgaagggatcatgaaatcagtgtagtttttatttctatttttatttttttt

SEQ ID NO: 131355 - DNA, 1746 bp, Homo sapiens
gatgagtatcattagcttcttaatttctagtttctatataaactacaataaattataggtattatatattattcttactataattcttaatattattcagtacatcattaacattcaataatgtttatatgaagaatggttttgtattctggctgcttatatctttgcatatttctattgctagtagtctttagaataatctgtgtaataaatagtgaaattattgtcttctataattgactacaataaagttataatgcaaagtgagtattctatataattgaaaagaatctgttatatgaatttactaaatgattttatccttacaggttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtgtatccttttcaatagcagttcaacagagtggggaagggaataaggtatgtgtgcaaggggaagatggaagaagagaggtttgagggggactcaaggaagtatgaactgtttatatttctaaacaatggtagaaataatgatgaactgtgaattgtttcatctaagatgcctactagacattaaggtgcacacacatgtatgtttatatttgtaaagtttggcatattttaaagtactttctagtgagtaaagaatatgtgagtaaaaaaattggtttgatgataggataggtaagtaatctaccagacagacctgtaggattacttgtgaggtgtggtagtttagtgacttgtggatgtgattaggggttggcgcaatttgagtggtatcttggaattttgcagtttttgcatttttcactttaaaacactattaataactttgtatagtggttctgcttctttcaaaacacaaatttgtcagtgtttcagaaattttatttaaatctgggaaagcatttttcacaagtactttgaatactttgccacctggtttactgtagcgtatgctctcaaactttgaactggtgggaatgcacttgaaaattattaataccatgatggataacttactttgtttagtacatattcgtttcagtatgtaaactttcctttacaattcttcagagatcagagtggagtggtaaaattttatggaagttttgcatttaatagaaaacgaaatgtcttggaactggaaataaaacaggactatacatctcctggaactcagaaatacgtggtaagtctttttccaaaatcgcctttgtactgctatctcctcagtttcaatagaagagggacttagggatgggttactacttagaaattaatgagattttgtttgaagtggataaattgagaaaacattgactttgtcaaagaagggaagaggaagtacagagatttctggggactcagaatcttccagttgccctctttggcaccaattgcctatctaggtctccagatactcattttgtgtaatattttatatcttgatttatatttctctgtacacataagcatacatattggtattttttaaatcacatctctgaacagtacgttttttttttaaaagggaccacttaaagtgacagtgcaggagttagatggatccttcaatcatacactgcaaattgaagaaaacagccttaaacatgatataccctgccattccaaaagtagaaggtaggcat

SEQ ID NO: 131356 - DNA, 1083 bp, Homo sapiens
gagtgatgttaattgccatttttctagagaaagcaaaaaaaaatgaatgaaggaattaaactttaggttttagaatatcattggtaatggcataatgcatgggattggcaataatagcatgtagacttttagaattgaacagtatagtcctggctatgagcaagtatttccttagaggcagagacagtaagaacagagttgggcaggagggaagcagcactgtcagagtagagcatgtactctggtaatttatacctgaagcaagactgtaaagcagtctcataatgaaaggtaaaggcaggtgtgaataaggtataataaatgggcaagtagaactcagaggaagttgggaaacctgataatttgttaataattttcattttctttatgaaggcagggaaatacacactacacttattccgttatcctctttgacattatctgaggagtttttatgattaaaagtaatttatgctttgactttttgcttaggtctgatgaatgggtgctgaagggaatttcaggctatatctatggactttggatgaaaaaaacttttggtgttaatgagtaccgccattggattaaagaggtaataacagctagatcccttatccacttacaagtcttatgtcctccatttttaatgactgtaaaatacttttaaaatactgcttgaaaatccctaatttttcccagcaaaatgggaattgatttactgagaaagactaatggtctattttatctaatctccattgtcaacattggcccctaaaaacctttttttcccctaaggaagagaatatttaagtttcttaaacatcagattggtcgttaggtatgtcccagctccttatagtagtcgtttgtaactgtgcttcctaaatttgttagctttgtaaccttaatctttccaagtctctgtttaaggagggcaattgtagtgtctgcccataggcagagattattagacattatacaagtaatgtgcatgatgctttgcacatattaactgcttattatattctggctaggctttgaatgcatttatgttgtcattgtcacatctttttttttttttta

SEQ ID NO: 131357 - DNA, 1031 bp, Homo sapiens
gacaaagtttttgagataactcaaaaggctcatcttcatccagaattaactaatattagtattttccctgttttagtcttgtgttcataaattctttaaaaattgtacaaattattgtatgactagtatgaatttttttctagcactatttaaaaatgtactgatattgtcagaaatttactgatatcatcagtggaaaatgtgttctttgctttaagcaagttactaagatgatgaattttagctaaattttgaaaagattagaaaggtgggagaattttttctctatttagcttccattgttttaaaagtggaattattttattttcactgaataagtatttatttcttggttataatgagctttcttctcttttaaattccagcacaaatcttttacacagtgccatgattatagatgagacacctttgactagaaggtgtttagcccaatccttggcccagcagttttttggttgtttcatatctagaatgtcttggtgagtgacctgaaagttcatactactgagaagagaatcaagtttatttttcttttctttctctgcatttaagctgacctttgccctaattgcagatagctaatttaagagacactgttctatatgtatttaaagaaaaatgattataagtttcatcctaactttttggccatgaaatcaatatagtcacttatatttattagttaattaaattagctaatttaaaagacactgttctatatgtatttaaagaaaaatgattataagttttatcctaactttttggccgtgaaatcaatataatcacttctgcagtttataaggtaagattttggtaaaacagtgtcttaaagaactgaatgaattctataaataaaagaacttaaatgtacagaaatctgaagttagaattttaatgtcagtgttcaaagcaattggaaataactcaatatttaatgtaaaatagtactcctctgcaatattaataattatttagggatttgcctactagtgctcagctttgtaccagtt

SEQ ID NO: 131358 - DNA, 1035 bp, Homo sapiens
tttatatctaacttaaccagcactcagtttgaatttatacaatacgttacatactccaaaaaagcagttttataatttaatggaataaattctgaatgttagttatgctttataaaactttttgctgtgagccttttttagtttctagaaatgaatgctgcataaaaactgactaatatgcggatacaagttaaaattattttttaaaacactgaaagctaagaattgcttaactctttttagggtttgaactgatggtaccacataatatattttcttaatattgccaaatagtatttggaaacagattttattttatcagatttttttcaggttgtacagtaaaaagcttcagtagccaaatagctaaaggttttgtttgttcattttctagaaatgctaaaataacttgcatgtggggaaaacaatgtagagaactctttgaatacattttctatactgtcaatcttttttctagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggtaagtcagagctttcctctcttactctcctcctggccctttactgcttttaaaaagatagatattggcaaggcacggtggctcatgcctgtaatcccagcactttgggaggccaaggtgggcggatcacagggtcaggagatcgagaccatcctggctaacacagtaaaaccctgtcattactaaaaatacaaaaaattagccaggcgtggtggtgggcgcctgtagtcccagctactcgggaggctgaggcaggagaatggcttgaacccaggaggcagagcttgcagtgagctgagattgtgccactgcactccagccttga

SEQ ID NO: 131359 - DNA, 1493 bp, Homo sapiens
ttcatgctgctgataaagacatacctgagactaggaagaaaaagaggtttaatgaacttatagtttgacatggctggggagacctcacaatcttggcagaaggcaaggaagagcaagtcatgtcttatgcagatggctgccagcaaaaagagagagagagagcttgtgcagggcaactcccattttgaaaaccatcagatcttgtgacacttattcactatcacaagaacagcaagggaaagacttgcccctgtgattcagttacctcctaccaggtccctcccataccacatgggagttatgggcgctgcaagatgagatttgggtggggacacagagccaaactatatcagtaagtttggggttggatttggaaggcctaagtgtgcagtgtgggagttttggactttttaggcattgtacattgtcagaaatgttgagaggaggatatggcgtaaccaaaggtgtattttgggaaaataatacaagcaatagttataattgattggaggtagaaaaccaataggggcagcctgttgagttaatataggcagacatatggtaaaagtctaaactagggtaagtagtgtggtttttcatataaatctcagtcctcaattccatttcatgttcagcattaaatctttgtctttattatatagaccactgtaacttatgtatcaatgtgtgtatatgtttatttgttgcagagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaaggtagattatagattcttaaatatttcaattaatttttaaattgcattttttatgtataagcaagacatacatttggtgtaaaacaagaaatactagttttattcccttccaaatttagacttctttcaaattactttctgttagtcattcctcttaaaaaaaaatttttttttcttttttttttttcagacagtcttgctctgtcacccttgttggaatacactggggtgctatctctgctcactgcaacctgtgcctcctgggttcaagtgattctcatgcctcagcctcccaagtagctggtattacaggcattcaccactacacctgcctaattttttatatttttagtacagatggggttttaccatgttggccagaatggcctttaattcctgacctcaagtgatctgcctgcctcagcctcccaaagtactgggattacaggcatgagccaccatgcccgacccctcctcaatcttacatctcccttcttctctctcattttcatgtctactgttctaaaataatcatctcacttgattccttcttttttaaaaactttatattgaagtaaaacatacatacagaaaattgcacagaatgtaaagctcgatgaattttcacaagtgaacaagcct

SEQ ID NO: 131360 - DNA, 1046 bp, Homo sapiens
cgtatctttttcctgtctttcatttctttcgtatttttttaaactaatttcagtgaggaaatgtaatatgtgtatatgtacacatataagttgcttttatggagtacaatttaaaaaccagttgagaacaacattttcacgtttctgtaagacttcatcgtattgttttcatcaaatgggaaataaggtcagataactatggaacaaatatttatgtagtagtctctcctgacatagtgaatataacggtgagcctgctgaaaattctctgcttcattaagcttacattatgatgcactaatgggtggaggtaggtgctattacattttgaggaactgagtcccatcctgatttgttttaaacatcttaatttttgtcaaattataaagcttgttgaatccattcaattttttgccacattgatagggaataattatttattcagtgcttcacgtattctttacatttgtatcaaaaaaggatagtggctttggcattccaaaattaatgaagaatgtgatagtcataataatagtcatgtaacttggtgagtagaatatatattctgttgtattcatagattaatagtttttaacatggtgagtagagcaaaccattacttggctaaagagtgttcttagaaattatataagaagataaaatgcttacaaataattggtatcaaatgatatttaagaaaatgctcagaggccaggcatggtggctcatgcctgtaatcccagcactttgggaggccaaggtgaatggatcactagaggttaggagttcgagaccagcctgaccaacatggtgaaacaccatctctactaaaaatataaaaattagctggttgtggtggtgggtgcctgtaatcctagctactcgggaggctgagggatgagaatgcttgaacctggaggtggaggttgcagtgagttgagatggtgccactgacctctggcctgggcaacagagtgagacttcatctaaaaaaaaaaaaaaaaaaagaaagaaagaaaaatgcttggtaagatacatggcttatt

SEQ ID NO: 131361 - DNA, 1557 bp, Homo sapiens
ggattagagggaacataggaaagtatctagtgtaatgtctggtacctggtagcagccattataatctagtcctctgtggttgctgtctgaattttgtcttagatatttctgttatagcctctgaaatttttctcttcacgttggagtcctgaaatattgctatttcatgctgtcccttgttttatgtttgagtacatcaattttcaacccaggatattaaaatcaattaacatatattctgtgtttcatctgttcgtctttcccattgattcaatacaagagggtggtgggcagtctgtatttaactgtttttcatgtgttggatacagagacattgctaccatacagctaacatggtagaactacatatggcctctggactacttgacaggaagtgattgaacactgtgatgtatttgctgctcctggatatggcagcagatttttcctacttgccttggtatcttttgtagctcttgctgttttacctgtcctaatttactcatgagcagaaactcatacttgttagcttcagtggtataattttttacccctttttttttctgccatgttctttcactcatcacccttctgattttgattccctttctgctctgtaatttttttcttcttccctttttagggcctagtctgtttagaaattctggtttttgagagtagtgagcccttttacttttttctgactgcctaattttcactgatagtgaatatgaaccaccaggatgataaagtatacataactcacacccattcagtcactaggacaatcatgtttgaaattaagatacttggagagcatatgtatgtatgtagctattagggattttgtctctgtagtataatatgtgtacaagtggtaaaaataaaagaaatatattctgaaacataccagtctttataatgaagttgttattctctatctttacagggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagtaagttatgcactttaaaagtcactatttttaacagttttgaaaaaatgtttttaatgattggattagtttttctcaaagtattttttttttggatcgttaatgggctttgaatcccaatctttatctgttttaccactctgtacatttggttcaagtgattttgctagctgtgcccaacgtagttactaagtttcccttcttcatgttaaaactttaaggaagtgttatctgggaactttaattagattttcttagtcattttttttactttcagtgtttttcttaattatttacttcataaattttgaaagtaattttcagtgggttagatggtcactgtaatctgtagaccagaggctactttaaaatattctataaaaaagttttagaaagtagataatgaaattgactgcattaaactatcttataaacatattaggtcta

SEQ ID NO: 131362 - DNA, 1121 bp, Homo sapiens
cctggctgttcggttgtcataataacactaataggccaataatgtcattttttatgaggaaactgaggcacagtgggctggagttactagctcaatatcatacagttactaagtggtagagctaggatttgaatacagggagtctacctccagaacacctgcttttcacggtgacactacactgtccttaaccttgtagtgtacagtaaataaaatcctataagtgacccagaagtagtcgtggaaactaggagaatgcctattttccactaccctcgtttatagtgaatgggagagtaagtagcttcttgtctaggaggattcaggaaccatttcatttaaggcaagagggtagagagggagttttagaaaaggttgaaaagcacaggggaaatgtttaaaatggagtgtgggctccaggagaatggttatctgtgaagtggtggggagagagcaagaagcaaggagtgagaagctagatgacccgagaggcttgcagttatgccagtggctaagggcagcagagattgaagacttgtagaggttaatgggtccgaatgtttcaggcagctgtaggttagagccctaggtggtggcagaggcctgatggtacaaggagactgggcttttcctatcttcctgaaatacatttcatcattctattattgttaccagagtttagaaaaccagatgctgttcttatgtcccacccaagtagcagttgacagtacttctttaatcttttgttttgtagttgtcttggttctaaatcttatctttcagctgatccaagctcatttaaatttagaatggtcattggatgacagatatgctaattaaaaggaattctggtcttccttcctacagcagctcatagtttacacctttaaacacagaatctttatcaactttattttggcctttgttcttttgttctctgtgtttctagctcacagatatgtgctgattgttctaatttaagtgtatggctctcctcttacttgggaattgagaacaaaggggctacagaatctctaggctttcttgagcggttggactaaatgttacctaaaaacaattcttgcatatcatttaaaacccttgtacccacaggcattatg

SEQ ID NO: 131363 - DNA, 1834 bp, Homo sapiens
ttttgctctctggcaacttggggtgtggaacgtacaataaaaacgccttcacactaataacctccaggcctgtccccaggattctacagcatgagctttgtgggtaaagagagctcaccaaattcagcctccagcagcacacacagctcagtagcagcgccccgcccagatgtttatattttcctccatcggccccgccccccgaccatgaggggctctagccacgcccccaagctcaagtttctggggccggactagcccagcgcgtctgcctacccatagggattccctctccagccaatccagtcagagcagcggagctgccccgaacaaagatggcgcgggaagcgtctgtgagggcagactgatccgagcacccaaaccctcggcggacagcggagccagtggtagccgcacggccctaaaaccatggaggagggcggcagcactggcagtgctggcagtgacagcagcaccagcgggagtggcggggcgcagcaaagggagctggagcgcatggctgaggtcttggtcaccggggaacagctacggtaaggcaagagacacagcgggtgagctcacgatggcactgccaacgcgtgcccgctgcagtcctgcgcgcacgcgctccctggctcgtggcttgcgactcgcgtggggcgccggaacggctgcgggcgcgtggatggtcctcggtgcgcccgcgcttagctgctgcagcctcggtccctgaggactcgctcgccaagcggggctgcctggcagaagccgacgagcgggtggtgcgcgctgcgccctagcctggctgctgcagtcctgtgccgggcaaagtccctgccacccaccgcgctgtccgtcttcccgtgtacctggacgccgccaggcctcccggctgacagcctgcgcctcatccgcgaagagagcaagaggggtcgctgtggggtcccgaggcgaccccagcccctctactccttgataaaaggagcaagaccaacgatagtcttcactaggttttcctttttgctgacaagtcttccttcactcccctgagcctcggtgttttacatctgtaaaacagggctgattcaagggctttttgtgaggttaaactgagagagcatttctgaaaccctgcacctatcagttaattggcacatcgtcctcaatcatttgggtccgcaagggggcgtggaggcaccttgtcgggctgccttgaggctgtgccaactccccgggctcgcacgttttgggcagcaggatccatggggaccctggctcctgcaagaattaagacttgcggcgtctcacggaacttgggaacaaggacgacccccagaatcccccttgccattcccatccctgtatggtccttcctctagggctgtttgggaatagtacttatggtctaactggttctgcagctgcccttcgtgtggttataaatcagtttgccaggaaaaagaaaacccagctctgcagcgtttgagccacaacttgtacgcgggcccctgttacttctagttcttagcctgaattccccagcttgttttggtttctaaatgtctgtgtttcaggacctgaaagagtgtcttgcaaaggtctctgaaggagaccaatattggaagtcagaattaactgatttttaatgttacaaaaggcaaattgcacctatcgattctttgttgatttttaaaaatacgtggtcagaattaaagggaataaaaactttttttccttcatcaaaagtactttctaatgaaacctgtcacgcggtgcccgtgtgaagagaccaccgaacaagttttgtgtgagcaataaagctttttaatcacct

SEQ ID NO: 131364 - DNA, 1029 bp, Homo sapiens
cccgccttggtctcccaaagtgctgggattacaggcatgagctactatacctggcctggagctacctttgattatcaaggtgtcaatatttttctccactattaataagattaagcttatacctcagtatatcattgcattgacattacaacagtaactttggcattgattttgtactgcatcttaccataaatataagtaatagtaatgaatccaaataaaagtggttttatgctcagataatactgtatgagtttagccttttattctatgaaatgggtagcacgtgtccacatgcagcaaaccttttgtactcatgtactgacaaggaactgtgatatgaaaagcatgatttttcttatgcctgtgttgactacaaaagagagaagctccagttaaacccattgagaagcatctatgaaatacaagaagctgggcttggagccaacacatttgtctacatgttcactatttgctgagtctgcgctaatgagagctttaagccaagaagagcagagtctgattactaaggactttattataattttttttttttttgagacggagtctcgccctgttgcccaggctggagtgcagtggcacgatcttggctcactgcaacctctgtttcccaggttcaagcgatcctcctgcctcagtccccttagtagctgggattacagacacacgccaccatgcccggctaaattttgtatttttagtagagacggggtttcaccatgttggccaggctggtctcgaactcctgttctcaggttatccacctgcctcggcctcccaaagtcctgggattacaggcatgagccaccgcgcctggcagactttattataatttacaattacatctttcaagtgaaggtatagtggttaggggcaggaattctttagaaaccactatcccaatgcaccaggatttattaagccatttcatttatcatgggacaaaaagttatttgattatttatatgcttaattaaccaggggaaatctcttcaattgtcttcctct

SEQ ID NO: 131365 - DNA, 1176 bp, Homo sapiens
gctctccctgatgctgttagaaagatatgataatttcagccaggcgtggtggctcacacctgtaatccctgcactttgggaggctgaggtgggcggatcacgagatcaggagatcgagaccatcctggctaacacagtgaagccccatctctactaaaaatacaaaaaattagctgtgtgtggtggcatgtgcctatagtcccaactacttgggaagctgaggcaggagaatcgcttgaacccaggaggtggaggttgcagtcagccgagattgtgccactgcactccagcctgggcaacagagcaagactctgtctcaaaaaaaaaaaaaaaaaaagaacgaaagatgtgataatttcactctcattgattcacagcagctatttgttgatggctccaatgctttctgaagcaatggacacaggtcatactgttagcctttggtctgtagaatcacaaggaacacttgctgggtgagatgaaaatgtaaggaaattccactatttctgtatttctgtaacagttttcctttccttattttattttatttatttcttttttatcctttttaaactttttttttcaattttccttttcttgattttatttttgtgctaagtgtctgtgatacatattatgaacatccgctaacatttacacagcatcttatattttggaaagagattttatatacaccattctgctgatccccaacatcctactgacccttaatcctatgagcagagaggaacctgagtgattatgttgattcccaatttagagatgaaaagctttacgtgaagtcttgtaatacttccttgctcaatgttgtgtccccaggatttggtacaaagatgggtatacaatagacaaggaataaaaaatatgctaagtggcaaaataaatggagctcagagagaaactaagtgacttggccatgggcacacatgactaagtgatggagactgctcagatttaggatttaggattttttttttgagacagagtcttactctgtctcacccaagctggagtgcagtggcacgatctcagctcactgcagcctctgcctccctggttcaagcgattctcctgtctcagcctcctgagtagctgggactacaggcatgtgccaccacacctggctaattttgtatttttagtagagatggcgtt

SEQ ID NO: 131366 - DNA, 1040 bp, Homo sapiens
gagggggtggtatattgggcaatattattattttttttgagatggagtctcgccctgtcaccaggctggagggcagtggcacaatctcagctcactgcagcctctgcctcctgggtttaagcaattttcctgcctcagcctcctgaatgcctgggactacagccatgtgccaccacgcccagctaattttttaattttttagtagaggtgggtttcaccatgttggccaggatggtcttgatctcttgacctcgtgatatgcctgcctcagcctcccaaagcactgggcttacaggcatgagccaccacgcccagcctattttagttattatttaaataatgtttttatatttgatctttctatatattttgtctttgtctaaaattgtccctgagactgtttcttctcagggaagaagttttcagtttccaggactaaacatttcatggcaatgcagtgtctttctcaagagtgagtataatctgggtgtttccagaaatgacttgcagggctgtcacaaacagattctaggctagctctctcatcagcagtccactcttggttaaagcactagattagcaacttctgtttccacagtggcgctcaaccaatattctggtagcagtcaggaggtcaaggtttaactcttatctgggaaaagaggcaagttacctaacttctgtaagtctccgtttttccagctgtaaaacagtgatattggcaaggacttgaactagattgcctgacatttctttccagttaagacaattcagtgattttggttatcagttaggttgataccatagaagagatgaggttgattccagcaaacctcgcagtagggagtggccaagtactctctcacctggacttttctctgctttgacttaccactccaccagaagggctctctttctaatcctttaacaaaagagaacagccaagtctctccagtaattgccaatcaatttttccttgattcaggacttcatttgttaaaaaaaaaaaaaaaaaaaaaagctgaaatgctacttagtgg

SEQ ID NO: 131367 - DNA, 1035 bp, Homo sapiens
aagtagggtgggccctgaacaatttgtgataaagagggtgcactttgtttcagtgcatttctagggtttttgtttgctggttgaaacaataaccccactggagagagaaaaagcagggagtgaggcagagtaggggatggagagcttttctcactctcaggagtggcaggagggttctgggttggctgtgattgtttcaccctcatatttacctctgtcatctagatcagaggctggagtcactttctggagcctttgaactctgacagtatggaaatcaccaagcgagctaaagatattcaatgacaccttcatgcctttagaacttctgttatgttattactgtctgggattggtttaataatttgtgctgtcatcagaatttccaaagtaattgctaatttttctttcaggctcaggctgcacgaagaaaaggttattaaagatagacgtcatcatctcaagacctacccaaactgttttgtcgcaaaagaactgattgactggctgattgaacacaaagaggcttctgacagagagacggcaattaaactcatgcagaaattagcagaccggggcattattcaccatggtgagtgcggtggcgagtcaaggtgacttgagagaaatggaaggactagatcttttcatgaacatacccacttaagaaagaaaacattttgctttattttatctccagtgtacctctccctgattgcattttcttcctgcctctaagaggcatttgggttctttctttttttttttttttttttgtatttttagtagagaccgggtttcaccctgttggtcaggctggtctcgaactcctgactttgggtgatctgcccgcctcagccccccaaagtgctgggattacaggcgtgagccactgtgtccagctggcatttgggttatttctatgtactgctttatacctgtctgtatatacatctttaaggaatgcatcatattgttttaaaagttttctatcattatagaagtgcatatttatgcttttgcaacttgatcaac

SEQ ID NO: 131368 - DNA, 1014 bp, Homo sapiens
tctgtagccttatcacaccatatttcaattacagttgacatttctccttacctcactagatttcacattctttgaggctgatgcatgccccaatatgctttagaagaatttgtggattgcatgatgaattgaattgtgtgaacttcctaaatatgatgatgatgatgatgatgatgatgactatggtgatggtgatggtgataataatagctaaaaatactgaggacttactctgtaccaagtactatgtaactattttacaagtattagctcatatggtacatatttgcatgcatgaagaatgtgatagtgaaataattcttaattagcatcatacttcgcttgagtaattaaataagagcgattttttttctcatttgcttctctgtgcatattgtgtttcagtgtgtgatgagcataaggaattcaaggatgtcaaactcttctaccgctttagaaaggatgacggcaccttcccattggataatgaagtgaaggcctttatgagaggacagaggctatatgaaaagtatgttccgcatgaaatcccccctgtaatcttgacttatagaaagaagcagaactgtgccagtctcattatgttgatttcagcgtggcttttctatgtgggctggttacataactgttcttttccatatgagaaaactatcaagcatttgctgtctctttgccagaaaataagtcaatttcataaggttcttaataaagaatttacttaaatcttattttctgtatttaagttgattctacaaagctccagaatttttgtttaccatcaaatgatgtggatgcccctttcctctcttatttttattttttattttttggcactgagtctcactcttgcccaggctggagtgcagtggcatgatctcggctcactgcaacctccgtcttctgggttcaagtgattctcgtgcctcagcctcctgagtagctgggactacaggcatgagccaccacacctggctaatttatgtatttgtagtagag

SEQ ID NO: 131369 - DNA, 1050 bp, Homo sapiens
ttgatctgctacttctgtggcctctttaccattctgccttcctcatttagttttccagggcaaccattagaaaaaggggtgcagaagcaatggcacgtgctttgtaaccctggctgccttacaagacttgagggaattgaaaaatacgtatttatcggccaggcacggtggcttatgcctgtaatcctagcactttgggaggccgaggtgggtggatcacttgaggtcaggggttggaaaccagcctggccaacatggtgaaagcccgtctccactaaaaatacaaaaattagcccaccatggtggtgagtgcctgtcatcccagctacttggtaggctgggtacgagaatcgcttgaaaccaggaggcagaggctgcagtgagccgggatcacgttactgcactccaacctgggtgacagagtgagacatcatctcaaaactaaaaaaaaacaaaacatatttgtcacataaaagagcctgttgtacagtggttgggggtaagggtctgggtgggtgtctgagtggtcagattaattggcatgatggttaaaagccagacagagtttgaagtgtagccctgtcaccttacctttgtaaagctcagtgtcctcattagtgacatgacagcagcaatagaacctacctcctagtgctgttgtgggagttaaacgatagctgtgtcaagtgcttaagtatttagctcagggtctctggtgtgtagtaagacctcacagatgatagccattccaaatacgagcacagtactgacggccaccctcgactgtgtccttcctgtgttatgcgctctgtcccagttcttgtctccgtttcttgaggtggaatgatcaccatttgatgtcctaatttgtactcagtctactatcacttgctttctatactgaaatggagaaactctctcatctttctgactcacatgaatttgaatggaagggatccatcagaacctccatttgtttacttgaacatgtgcatttgttttgttgctactttcttttaatttcttagttccttttgtaaaattctagca

SEQ ID NO: 131370 - DNA, 1023 bp, Homo sapiens
attagccaggcgtggtggcatgcacctgtaatcccagctactcaggaggctgagacagaaaaattgcttgaacccaggaggcggaggttgcagtgagccaagatcgcaccactgcactctagcctgggcagcagagcaagactccatctcaaaaaaaaaaaaagaaaagaaaagaaaagaaaaaagttgaattcaggattatcaagtcctctgtatagtaacaaataaaatcagctataaaagtgagtgtgtgtttgaggtacaatttggtttttcctcactaaacccagtagttgaaatgtatattttaaactaacttcgattttatcttcaaacttagaagagacttcttaattttaattcaacctcagttttgatatggaactaaatcccctcttaatctggttcatagacacattagtctagttgttttttttttttttttttttatccaaagggccttgattttctcagcagcaggagtttctatctccagctactattagtctctttatcctgcttaggagtttagacctgatgaagaattggcttaacaagcccgtatgccattagatgtctattgaattcctactgcttccttcaatttcttttccacaggaccaaagagaaataaaagggagagagtacatccaaagaggcaaagcccttctgcgtgttttatcttatcagaagtttctctaccctgtgtgttaggatctttctcctgttctctcccagtgcctgggacaataaatatttgttgaatgaacaaagggctctacatgttgtgatcgctataagctgctgagcctgtaccatgagctacacagagcttgcttttaataacaagcaacaatagccagaattcaccttgtctggcctctttagagcccacaaaccatcatatacattaatttgtttgatcctctgtacaactctgtgagttatatccagcaggcataattattcccattataaaaatgggggacatgagctgtggagagaggtttaatgactgagata

SEQ ID NO: 131371 - DNA, 1069 bp, Homo sapiens
atcacagctcactgcagcctcaaactcctgggctcaagtgatcctcccacctcagcctcctgagcagctaagactacaggcatgtgccactacacccaactaatcttttggtattttttgttgagatggggttttgccatattgcccaggttggtcttgaattcctgggctcaagtaatcctcccaccttggcctcccaaactgctgggattaaggtgtgagccagcatgcccagtctgttttgcttttaaaaataattgatcatattaacacatgacttgttttttaaagctctctttctaaattctgaagcatctttttgacctaagccccacaggccattttgtctccctccctggcttttgctcctgtacatcattcacatctattcccaggttacacagggcctcctcagctcttttgaattttttttcccagtgtacaaggagatcgctatcagcttatttctattcttgtactggcccctaaatgtagtagttccttctattgtagtgctgccttccctctaggttaatacgggtctgggaaatctgagtcagatatagatccaggaaaggtggaaatcagctcacatgcacaagcaaaacctggtgagtgcttgcagcaggcaaatattggtgtgtgtgtgtgtgtgtgtgtgtgtgtgttttgagacagtcttgctctgttgcccagactggagtgcagtggcacaatcttggctcactggaacctccgtctcctgggttcaagcgattctcctgcctcagcctcttgagtagctgggattacaggtgcccgccaccacacttggctaattttgtatttttagtagagacagggatttgccatgttggccaggatggtcttgaacttccaacctgaggtgatctaaccacctcggcctcccaaagtgctgggattacaggcatgagccactgcacccggcctctatgattgaattttaagagttattatgttctggatgcaaatctgttattagacatagtctttgcaaatattttctcccattctgttcttgatggtattgtttgtagcacaaaagttt

SEQ ID NO: 131372 - DNA, 1018 bp, Homo sapiens
tttttttttgaaattactaggagaaaatgcatcttgtttgcttctgaagcaattagaaattacatgtgtggtaggctgggcttgtaatcccagcactttgggaggccgagacgggtggatcacctgaggttgggagttcaagaccagcctgaccaacatggagaaaacctgtcgctactaaaaatacaaaattagctgggtgtggtgacacatgcctgtaatcccagctattcgggagatcaaggtagaagaattgcttgaacccaggaggcggaggttgcagtgagccaagatcacgccattgcactccagcctgggcaacaagagcgaaaatctgtctcaaagaaagaaaaaagaaattacatgtgtggtggcacctgacagctgcatctgtctgtctgacaactttgctgtagtacttcatggaaatctatgatttcaaatgagctgttttcctttcgtataggtttacttttcttttccctttttttcttcccaggctgatgagccctgaaaacacactcctgcagcccagggaggaggaaggggtcaagtatgagcgcaccttcatggcatctgaattcctggactggctggttcaggaaggtgaggccaccacgaggaaagaggcagagcagctttgccaccggcttatggagcatggcatcatccagcatggtgagcgtattgggcagcttttgctgcaggaacaaacagccagccccaaatcttgtgtcttacaacaacacgtacttatttctcactcatgaatctgtaagtcagctgcacctctgcttatgttcagcttgtctccaagttgggggtcaaattcaggtctgtgctccacgcctttccattctgggacacagactaaaggaatatccactgtctgtgatgtgttgtttttaataaattattgcagatgctaaagagggcaggcaggttcttatagcgcttccaaaagttgctgcttggatgtgatgtaacatcacaactttgtatctaactggctaaagca

SEQ ID NO: 131373 - DNA, 1993 bp, Homo sapiens
ttattaataaataaactctatgaggtagatattctttttttaaaaaatgtattgtgataagaacattaatatgagagctaccttcttttattattattattttttttttgggacagttactgctctgatcatgcaggggcagatctcggctcactgccacctccacttcccaggttcaagggattctcctgcctcagcctcccgagtagctgtgcaccaccacactcagctgatttttgtatttttagtagaaacaggatttcaccatgttggccaggtgggtcttgaacttctgacctcaagtgatgcgcctgccccggtctcccaaagtactgggattacaggcgtaagccaccatgcctggcctgagagctcccttcttaacaaatgtttagatgtacaatactatagggccagtatttttattatctccattttacaaatcagaaggtgaaggcaccaataggataaatcacttgtctgaggccactcaggtagtaatgtccaaatggatattactgctagtaagtgtgaccttggagttgggtgggatgactggggttttccccagtgaaaaatggtaggtttgggttacagttggttctttcatatctttgctctacagagaaaaagtaagatgaggctgggcatggtggctcagcgagctggccaacattgtgaaaccccgtctctactataaaaacaaaaattagccgggagtcatggtggatgcctgtaatcccagctacttgggaggctgaggcagtaagaatcgcttgaaccctggaggtggaggttgcagtaagccaagatcacgccactacactccagcctgggcgacacagcaagactccatctcaaaaaaaaaaaagtcagatgataccaacttctaggagaaaaccagcctcttatactatgatgtactgacccacactgtatatccttggctttagaaagaagatagaggatgctgtgaatggtttctaaatgatttccaagggataagtaattatgcttcaattacagtgtaactctgtaatgctataaacagaaacaccataaaggtacaatgtaaaggataaaacaaatgcatttttgataataaatctgttttgtttttttttgtttttttttttgagatggagttttgctcttgttgcccaggctggagtgcaatggtgcgatcttggctcactgcaacctccacctcccaggttcaagcaattctcttgcctcagcctcccgagtagctgggattacaggcatgtgccaccatgcttggctaattttttgtatttttagtagacagagggtttcaccatgtcagtcaggcaggtctcgaactcctgacctcaggtgatccacccaccttggcctcccaaagtgctgggattacaggcgtgagccatcgtgcctggccgataataaatcttaaccaccgaagtatgcttcccgtgattgtaggagtactgaatattctacatagcaactggggtttctgagggagtttcagtttcccagcacagtaattcattgataggtcacaggttgtaacttggagttatgaaaatatggctaccatacctgtgtatgttagagctcatggtaagtaccagttagtgtcttgagcaaagcttttaattgtctggctaataattaatttcataggttaaacattaaggaaagtcagcctttaggctttgagcagaaggtttctggataaaagtggttccctattttgaaaccagtaagtgtaaaaatcaggcttacctgtgaaatcctaactagcttcatctatgaatggtgactggtgcgctttactcaaggcagaaattgttagatgaataattaacatgcatgtgtatttatgtggatatatatatatgcatgtatatgtacatatttatacaaatgtctgtatgttgaccacatctatacatatttgtctagctttttaatttatagatgtgtaccatctataaaggcattaggc

SEQ ID NO: 131374 - DNA, 2157 bp, Homo sapiens
gtcctcaaatactgaccacttttcttacctcccatccatctgctgagagattctgtttccatcttgatatttgacctactccctcttgtttggcgaacataaattaatttttgcttttatgagatttctgaaagcaaaggtgataagatcagcaacctgtcacctcaacaagaagcactggattgcctttcactgagagggtgcttctcaggccagaaggccgttcatgtaaccagtgggcgaggtccagctgcctggtagatcatcacgccttgccccacgctgcctttccttgtctgctgcacactctttccaggactggtacctggcctctgactgtcactagcaaaggggatcggaggatgccacctcaccaggttaggccccttggctggggccttttctgtttctctgtggcacttcaagttcacaatgtctgcagagctggattagaatggtctctgtcccctgaccccctggctacttggggaggatacgacagcccctctccagttcttagtgagcacaggatggatgggggggttcattatcggtgggttttaggcagccgcaagtcaggaattggctgctgtctgccatcttggtgggcaacagcagtgagctgatgtgaacgggtgtctcaggaggacagcatgccactatcttcctgagcttctagaccctttcttttgcttgcaggacagcatggcccagagtaaatgtggcacagtagctgagagtgtgggtgctggtgtctaatgcctgagtttgattctacttctgccacccattcgctctgggaccttggacacaatcaatttaacttttctaaggttgtttttgcagttataaaatggggataacaatgatcctaactcattcattcttgtgatgattaagtgagttaatatattcacctcacatggtgcctctctagcatatgttgagtactcagaaaagttcactagcattattactcatggcagaaagcagtgggtacatgcagtcctaggtgttaagaaggaagtgaggctgggcggctcatgcgtgtaatcccagcactttgggaggctgaggcaggcagattgcctgaggtcacgagttcaagaccagcctggccaacatggtgaaaccctgtctctattaaaaatacaaaaattagccagatatggtgttgggtgcctgtaatcccagctactcaggaggctgaggcaggagaattgcttgaacccaggaggcggaggttgcagtgagccgagatcgcatcattgcactccatcctgggtgacaagggcaaaactccgtctttaaaaaaaaaaaaaaattgacctgcccccttatccccacccctggcactcttgctttccttctctttctttttttccttagctttgtaaggtaggtttagggttatttatgtttgctgctatttactgtctccattcagctaaaatataaactgtgaggcagggatctttgccactttttctcactgatggtcacctacgagatatcaataaatagctgctgaatgcatggatagaggacttggaagtgcttatgtcttgacattgtgtttgtctgccagtgctgaagagacctgtcacctctgaggaactccttactcccggggctccgtatgcaaggaagacattcacggtaggctgatggtctggcctttttctcccgtgctgcccatttttctgcaccgtgtccatgtgtcaatgggtagcttatagactgaaatgaaaactacttttctaattttctttttgtttttagcgtaattatgatactaggctttcttgacctcaaggcactaaggtgcattaggacttcacatgcgttattattaatataccatttaaaaattttttgatgtgttctttgttaaagaaaagatttccattatgcatttattctaatttaattgcaaatttcaagattggcatcatttgcacttgcatttaccttaaaatctaataattttagattttatttcccaccattagtcatttaaattattattagattttatggcaaatggaagtgcaaatgatgccaataatcccttctgcattaggattaattctagaaattatttaaaacattaggggagtgttaagctagagaaaggaaactgtgggataaactttt

SEQ ID NO: 131375 - DNA, 1032 bp, Homo sapiens
caactcagagtaggaatgttggccaggatcataaaaaagcaagcatttgtgtccatgccaaggctgaatttttcattttctaatggaactcttggctggggaaggattttatattttatttccacaataaagtacctggtataaattttttttggcacaatgcttcagttctgagtgtgcactcactcgcatgatgctttggcttaaagagcatttcttttgaggaaagcaatgaatttatttacattgcaactaaagaccttgttttgcttagccaaatgtacagtgaaattaattgatttagtttatctttgttgatgtacatacataaccgttctgggcattgtcaactcattaactaactctttaacgtatattccctgatcgatgttttacctgatatattttttcaatttcataagctaatacttcatatggtttatatgtttagtttcttcagaggtacacagtggttttcttatgttatagagctttacagagttcattagagcagcctttccatcactgtattattacacagctccctggtccagcaaaacatctgtcctgaggttctctgatcaaagcagttttaaactgccacatactttatccccctcttagaaatttacaaagcacattagcatattgaaaactctgacaaacctggcaggaggaaaaaaaaaccttgtttaaattgtttaacataacattttatcatttaagagaaacatgcaaaaggaatctttatcagtgttgttgttaagatatagccctaaaacccttctaagatttttggccaaacagtattggaattgatataaagtcatacaccacttaatgacagggttatgttctgtgaaatgggttttaaggcaattttgtcattgtgtgaccatcatggagtgtacttacacaaacctgggtggtatagcctaccacatacctagatatagcctattgctcctaggctataaacactgtacagcatgttactgtactgaatactgtaggcaattgtaacacaatggt

SEQ ID NO: 131376 - DNA, 1078 bp, Homo sapiens
cctcccaaagtgctgggattacaagcgtgagccaccacgcccagccgaattttttagctttattacaatcttataagatgatgggaggccaggctcagtggctcatgcctgtaatcccagcacgctgggaggctgaggtgggaagatcacccaaggtcaggagattgagatctacctggtcaacatgctgaaacccagtgtctactaaaaatacaaaaattagtcaagcatgctggtgggtgcctatagtcccagctactcaagagactgaggcagaagaatcacatgaacccgggaggcagaggttgtagtgagccaagattgcaccattgcactccagcctgggtgacagagcgagactgtctcaaaaagaaaaaaaaaaaaaaagatgatgggaccaccatcacatatgcagttcatagttgactgaaacatcattatgcagtgcatgactatacagagatatacatttttagtattactgtttgttggttaaattacaatgatagcaaataccatgtccttccgtatagtttagctgcttatattcattagaaattattttgtacattattttcttaccgaaaatactgactcaattatttcctattttaccatttgtcatagaataatttcacttacaaagaagccatttgtataatctattcgtaaaggcttgttcccagcaagctgtcattgctgctatcttcaactcagaaaactgcagagtttggggtgtgtagtcgtcaagagggtcctggggtgccctgtgggaaggatccgcccacttgggcactgattaacctgctaggtctgagtggtggaaattttccagcattctgaccacatgcctccttttggcatctctgactgtccagagctgacctaggatagtgtaaagtgcctcagtgtcccttcctgcactgaatgtcaggctctccctttagtcagggttctcattttccccaggttttgaatgggggcagagccctgcatctgggcctttgtggccactccatccagtgagattttcacacttttgctatgactactttttttttttttttttgagatggag

SEQ ID NO: 131377 - DNA, 1021 bp, Homo sapiens
tgagacagatggaaaactttcatggcatttctgctcacagcttgttggttggaattgtgttgcgtggtcactttaaggggggcagagaactcaagtattctaatttttttttttgagatggagttttgctcttatcacccaggctggagtgcaatagtgtgatctcggcttactgcaacctctacctcctgggttcgagcgattctcctgcctcagcctcccaagtagctgagattacaggtatccactaacatgcctggctaatttttgtatttttagtagagacagggtttcaccatgttggacaggctggtgtcgaactcctgacctccggtgatccacccacctcagcctcccaaagtgctgagattacaggcatgagtcactgcaccccgccaagcatcctaattttataggtaaggaaagtaaggcccagaattgaaatgacttatccagggccaactgagataaacaaaagtggaatctggtcactcctgaccatgctgttaagtaagttgtatgaaatagactcacttcagggcttggcccatcgggcactcataatataaattttccatcccttctctgtcctctgttccacttctactatcatagttgtttcagagactaatatgatctagactttttaaagtttatattatattcaactgttcttaataatagtaatgcctaccgggtgtggtggctcacgcctataatcccagtactttgggagaccgaggtgggtggatcacctgaggtcgggagttcaacaccagcctggccaacatggagaaaccccatctctattagaaataaaaaattagtggggtgtggtgatgcatgcctgtaatcccagctactcgggaggctgaggcaggagaatcacttgaacccgggagacggaggttgcggtgagccgagattgtgccattgcactccagcctgggcaagaagagtgaaactccatctcaaaaaaataaaaataaaataataataataataataataataatgcctt

SEQ ID NO: 131378 - DNA, 1212 bp, Homo sapiens
atgcctggctaatttttgtgtttttagtagagacagggtttcaccatattggtcaggctggtcttgaattcttgaccccaggtgatccacccacctcggcctcccaaagtgctgggattacaggcgtgagccaccgcacccagccaagttttaaaatatggatttttttctgctgaaaagaaaatgtttacttctccccacccctctccataatacctagacccatatccagtccgttttggcaggagtttgtgctgactggtgaaaagttcacagagcagggtattaaatgggccttactcttgggatggagagagtgcagaatgccagctatctgcataagggaggcccagagaggccctctgcatctctgaggagaaagctgtctttatcatggccagatgtggccagctgtgtaattgctgatcgctggggccttaactgccctgtgctctgggtggagtgactgcctgcatgtacccacagctgggttaatgagatcaagtttcactttttagagccagagtaatcaggaccaggcacaaaccatatcctcgtaagcctgggggtgcatgggtgtcccctgccttggccaagccaggggaggccaaatactatggcggaccctcatctgtgtaagctggaatcctgggctgtgatgtatctgcggagaacagactttagtgtctccaatcctgcaggagtcaaatgtccttcctcttccgttatttctgatattgtggaaataggatatgtattaaaagaaattactaaaaaaagtacctgtttgaatgtttagggcaggggcactactctgtctgatactataatggtgggtaccggtcattatacatttaaccagagccatagcatgtgcgacactaagagtgaccccagtgtaaaccatagactctgggtgataatgatgtattgtgtaggttcatcagttttttttttttttttttttttttttttagctggagtctcactgtgttgcctaggctggagtgcagtggtgtgatcttggttcactgcaacctccgcctccttgtttcaagcaattctcatgcctcagactccccagtagctaggattagaggactgccaccacacccagctaatttttgtatttttagtagagatgggatttcaccatgtgggccaggctgatctctaactcctgacctcaagtaatgcactcgccttgtgctg

SEQ ID NO: 131379 - DNA, 1013 bp, Homo sapiens
ttcccgagtgggaccacaagtgaagctggtgatgaaggctgtgaccttgttggctggtgggggccttgagtccactgttggtcagtagggccatcagctggggagcagaactgcatgtggagcaatggagggcaaagccgagctgaaatccttcagcacctctgcgtctacctctcactacatttaaccataacagccacgagtgaacagccatggtggctgcttcacttccaccttccaggtattatggaaaattctttctggccaacttgaatctggaactgtgcaggaaagggaatctgaaaaatgtagctctgttttggccaagttgacaccaaaaagctccaccttcttatttgattcatgttcttcctcataactggtccagaaaatgtgcttggtgcaagtgtgagccaggaatggggagaatgaatgtgagagtcatccagtaaaagagaagtgaggatgggctgataagggggctagagagcttttggtgagtatcatacctaatacatgctactggatatggaattctttttttttttttttttttttttgagacaaaatttcactcttgttgcccaggctggagtgcaatgatgtgatttcaacttactgcaacctctgcctcccgggttcaagcaattctcctgcctcagccttccatggagttgggatcacaggcatgcactaccacgctcagctaattttgtatttttagtagagacagggtttcgccctattggtcaggctggcctcgaactcctaacctcaggtgttccacccacctctgcctcccaaagtgctgggattacaggtgtgagcaactgtgtctagctgtgagctatattttatagttgaggccgaaagagtttgagtcacagcctcttgttgtgtaactacatggcagagccagaagccaagctagcccaggtctgtctggctccagagcccttggtcttttcattatatcacagcacccttcaaatgtgtgatattacctgactttt

SEQ ID NO: 131380 - DNA, 1949 bp, Homo sapiens
cattttgttttataaatcagctatagcatctttctagaattaatcctgaatatgttgaatgttaaaatagagaagtttgtatatacacataattaaaaatcaacccttctggcaagatttcactttgaaggtgtctgtttttaagggaaggctaaaactttgctgatatgtgataaaacttgaactctaaattgcctccttagcctgaatttttactagctttctagtgtaacatattctaaggacatgacatgctgcttatttggggggattatttttcaccaaaatgatcatcttgtgttgtaacttttcagctcacttgtatatacgcacgttttcatttttggtctagaaaatagtgcattttggggctcagcgtgcagaggaaattcctcaaagtgccaaattaggcagtcaggaaatactaaattcttcattccaaataatggatctgaatgatgacgttaattttttatcatgcattaacaaaataaaatatgagaattgtaccacagccatttcttttcattaggttatcgtaatgtataggtactggtggaatggacctaccgtgctaaatatgttatagacatatatatatatatatatatatatatatatatttctggtaatccaacttttctgatttgtagctttagtcagagaataggattttggagtgacagagaatgtctaacagtaatactgttgatatacatttgagaaatactatcacctctgtgtgggtgtgcatttgtactgtatggcaggctctgtgcatttaatatatatgatatcctttaaccctcaatgcaaccttgcaaggtagatattaacgtccacatttttcagatgtggaaactaagcctgagcaagttttaaaatggtctctaaattcacacggctgcaggaactactaggtgaaataggctgaatgtaaacacaggtttaacgctaaatcccatgttactcccctcaacttttccccatttaaggaccttatattgagggtttattctgagccaggctgtatgctaagactttacgccatttgtccttatttacctgtgaagtcaatacggtcattatctccattttacaaatgaggaaactgacttgtaaagtggttagtcatatgcccaaggccacaaaactaataaagtgggaaaccttaccactggcttaaaaaaattttttatagcatctttaaaagatgagtcttaaatgctttctgtgctcaggtattcattaagtgacaaaagaagaaggaatacctttcgagaaatggtatctccttttgagaaatggtatcttcttcttgcctgctttacccattatcttggaccctggcataatagaacttcccttcagccaacctaagcaccagagaagcatttctctgtatctattgcacacgatctcctcttggctgtgaggaaggaaggaaagaagggagagaggatttccttctttggttcccatcaccctaagttcaaaagccaaaggccatgagagctttcccttagctactcctccagcccacccctgacatctttacacagcaattaaaaagactacccctaccttcctggggaccctatctcactccctccagcccttgcacatgtactttcttcttcgtggaaagaagaatgttctgtcttactgttgcctggaaaattctttcttcatgtaaactccctttagaaattatctcctctgagaagccttcaccagctccccagttctaggattgatgcctcttctctaaatttacatggatccttaagtcctccctatgccccgttagagcactgatgacatttactttgaaattcccctgttacatgtctgtttgcctaagtagactctaagcatctgcagaacaggggctatgtcttagtatccagggtattttcttcacctggcacaattcctgccacagagta

SEQ ID NO: 131381 - DNA, 1195 bp, Homo sapiens
tttgaatatgtggtataagtaatctgctttaagtcctattttaggttgggtgcagtggctcacacctgtaatcccaccattttggaaggttgagaccaggagtttgagaccagcctaggcaacagagtgagaccccatctttatagaaaataaaaaattagccaggcatgatggcacgtgcctgtagtcctaactacttggaggctgagaagggaggatagcttgagcctgggaggttgaggctgcagtgagctgtgatcacaccactgcactccagcctggacaatagagcaagacactatctcgaaaaaataaaaagacctgttttaaactgatgatattaactattctctcctgttgactattaatcttgtttcatttttattataaataataagaatgactaaaacatttcaattttgctggttggctgaaatctattgatgtagttgaccatggttttactcacttaaggcagaatttcaggtgtgacatgttttttcttcagttcagtaccaaaaggacaaatctgccatgtaccaaaatgaaatttgtcatcaaaaacagcatatggtattgtcaaatgcattaaaaatattaaagatacttaatatatatctttattttaaaattatattgggatttatttgctcctcttatgaaaatgtataccataatacttaaaattattgcatgaaaacacatagctgtatagcatgaaataaatgttactttttttttttttttttttgagacagagtcttgctctgtcaccaggctggagtgtagtggcgcaatctcggctcactgcaacctccgcctcccaggttcaagtgattctcctgcctgaacctcttgagtagctgggactacaggcacgcaccaccacgcccagctaattttttgtatttttagtagagacagggtttcaccatgttggccaggatggtctcgatctcttgacttcgtgatctgcccgcctcggcctcccaaagtgctgggattacaggtgtgagccactgtgcctggccccacattttttaaaacaatgactttagggtttcagcttttcctgtcttttaaaacaaattagccattttttattctaagaaagggttgtattataaagctgacctactactagcttatcagaaaaaacacgtgggtctcatatctgattctcctatgtagccaa

SEQ ID NO: 131382 - DNA, 1073 bp, Homo sapiens
ttttttttttcgagacagggtctccctctgtcacccaggctggagggcagtggcaccatcacggttcactgtagcctcaacctccagagctcatgtgatcctctgtttcagcctctcaagtagctgggactacaagcacatgccaccacgcctggttaaatttttgtatttttttttttttggtagaaatggggtttcgtcacattgcccaggctggtctcaaactcttggcctcaagtgatcctcttgcctcagcttcccaaaacgctgggcttacaggagtgagccaccgcacccagcccgatgtgccttctttttctttctcttggaggctacatgattcaccatggaggtcatgggttctgagatggaagagagctaccttattcatatgaaactttgtgtgattgtgaaataaagctttattgtgtaaatccactaagcatttgggatgtatttgttactatagcatagtctgtcctatcgcaactcacacaaacaataagatcccagaatatgctctaactttttggtcttgtatattgggaggatccttattaacaaagaagcctcccaataaaacaagtaagaaatacagccatttaagttacatactaggatgtaagatgaccattttcctcacttgcaatgccaagtgaatataaaaatatacatttgcagtctcttgttaggaaggaagatttacctgctggtccaggggggcctcttggaccttgggttccaacgcctggatttcctttttctcctttgataccagttagacctgtttaaaataatttttaaaaatgtttaaagttctttttaaaagaaaatcttggtagttccatttttctggagttcgaaagtgcttctctgatgaagacaattaagtgggttcgtttggggttatgagtaccatgggacttttaaattacattctgacattggtagtatatgtagaatcacatgttgaagtctggttctgtatttgagtgtgtggtctgtatttgctattctgccagtctctctttctccttcctactgaagtcacacagcctgccaagaactggtcc

SEQ ID NO: 131383 - DNA, 1085 bp, Homo sapiens
ttttgctattgcaaattctataccattttaacatgcttgctagtgtagagttttattgtaaatgtacttaagttgatgtagtttgaaaatattcagctttgataagttatatactaaaaacattttaagttgtccttgaagttttgacaggttaccttcctataacagttctgtaaatatgtatctgattttcttacagaaacaccatcataaatgaatttatattcctgaccaagaggggtgtggtactcttttttttaaaattagaaataataaagttgctgttaaatcatgtatgtgcaaatacatattatacacttgaagtcatatttcatgaatattctaaagtgtattctaaatcagttaaactggcaccacactaatataataattcacaaattatatttagtgttattatagtcagagtactgaccaaaattttcattctgctgaatgatttctgctttcttttgaaacaaattagaaagtgcctgagtgccttcattttattaatagaattagaaagggcttttctatagctatttttaaggagatttttagagaaacttagagccactagatgcattttttagttactactctgggaatagattttcctgccctctctcttcattccagatttccctgaggcaggaatatgcattagacactaggttttcctttatgctttattaaggttgtgattttttcctcataaatagtcacacgcatatgttaacttgtattttcaaaatagtaaaataggtatacgtttactgaaacgtatggatagtataggtgtactagtcatttaatataaatcattctgtatttctttctccctgcacatttgagctgacatcaagtccagttagtctttattacgtgaaaagtgtgtgaccaggaaaaatatagtcatttttggattaaccaaaagcttatctaagaaatagatgatcatttacttcaaggctcttgagtagaactttctacaatgatgaaaacaactctcagccaggcatggtggctcatgcctataatcctagcactttgggaggccaaggcaggagtacctcttgagttca

SEQ ID NO: 131384 - DNA, 1805 bp, Homo sapiens
ttttcttttgagatgggggctcactgtgttgcccaggctggtcttgaacttgtgggctcaagaagtcctcacacctcagccttccacagtactgggattacaggcatgagccatcatacccagccttcatctctggtttctttgggcagtagtttgtagttctcattatagagatctttcacctccctaattagctgtattcctaagtattttattctttttgtggcagttgtgaatgggagtacattcctgatttgactctccgcttgactgttgctggtgtctaggaatgttagtgactttttgctagtgatttttgcacattgattttgtatcctgtgatgtctttgtccattgatttttttcatatatgtaggattatttaaaataaatccctggaagtgtaatgtgttttgatatcaaaggaatgatcatttataggtcttttgataggtattttcaatcatgagttttctaatccatagaagagcatacaaatgtttgttatcccaaatctgtgcaggcacagtattatctttaaaaataaggctgttgtcttttgatatgcagctgaatatttacatttacttaataatgaagtttcagtgttactttatcactttctatggacgttttatctattaagattattaatccacttttgttttttacttttaacaaaatttttatgtcatttactgtagttatttaattttatattattacatgccttttcctttgtaatttcttctgttttccagtctcagaaattctttcttgttcagattttcataaacatttacttctaattttttaggggttggttgaattgggtgtgtgtgcaccttgaactttcacatctaagtctttagtcatctaaaatacattggcatgagttagagatacaacttaacaactagttgtatcaacagaattgtttaattttaaataggacaggattttgtcatatttatctgtgtgtccccagttccagcatgatacacatttaagtgtttattgaattaatttcaatgaaaaacccttggctagcatttaaaacaaatgttctcttactccatcccatattggaggaaagaatgagttattttcttactagtaaaaatcaattgagtgttgcattactcaagtcatcctccactcaaaattttacattagctttccaaatacgtcagaataaagtccagacttctgaaatatattgtaaatggtatgttttagaatttgccatctcaattttcaaactagaaagatcatctttcagcatagaaattgtaaaatatttttttccatggagagaaagaatgcaggaatagaagtctagacaggcatttctttttctaaaactgaaattccatgaaaaaagagaatatcaattttaaaactacccatctttctcagcaaacttctaactttgacaagttttattcctaaaatgtgttttcttaaatcatctttaaaatattttcaaattttattgaagggaacatatggaaaaaatcacctttaggtaatcttaaggttttttgcagattccacactgactttccaatttcttccccctttcttgaaaatcgtttggacttcatctgtttaggaaaatagaaccttacatctatatatgtattatttttgttttaaatttcccaatccctttcacaaatattttttcatttgacccagaaatcttttgaggtagatagcattatttattcatatgagtaaaattatatgcagagaggtaaaatgagttgcctgatattacactgggagtcactgacaaaacc

SEQ ID NO: 131385 - DNA, 1813 bp, Homo sapiens
gctatttttcagggaaattttgtatcagacatttaaaggcacttaatacaaacatttttactgaagtgtaattattaatgggaaaagtcacaagaataacagtaatttgcctttaaaagatgtattgttgttattggcaaccttattaaatttcttttactttgcagtgttgagattttccaaatggccagccaactctttctatacttagatgttatattaaaaagtaacagaaatctattcaaggatttttgatgttgcactgtaacttgctttttattttttaatatgttgtttgaactttgataagctttataaataaccaaggccactttttcttaaggtttttatttttcttacaaaatcttgtttctttttaaaatgtaggtgactgtggggatcatgttgttataatgaacacaagacacattgcattttctggaaacaaatgggaacaaaaagtatactcttcgcatactgggtaagataatgctgttgtcagggaaattaggtagttaaaatatattactttaagaatacagttgttcttacttaaaagaaaaaagatatttttaaaaatcagcatttattactaattttactcatgccatgtatataatttactcaatttttaaaaaccacacaactataccaaatatagctattacctgacagtatttgtttatcctacaagtgtttcatataacctgtggacaagattattctcatgttttagtcactcttttactttgtatttctgcttcctgtaattcatcttactgctgttttcagaaccatcccaaaccatctgaaagttaacaagatgtttaaggaatggtcactcttctctagataaaatcttgtttgtcagtatctctcttaagtaaatacactcacctgggtgtgttctgctggtttccaaatacaacgtgactctcctccatttttcagttaggcaatcttctgttgcaatagaacttttcttcaaggccatagtatttctgtatttgagtttactgtcagctaaaactcctaagtctttttcaggtatattcctgttgaatcatgtcttctccttcctgtgtgctttagttgtaatttaattcaattgcaagaccttaagtttactccatgttaaattttatctccagccttttaagatcctgattttatcatctcatgtattagttaacccatagcttcaggtcatgtgcacatttaattaagtgtactttctatactgttactcaagttatggttagaaatgttatcttttattcttgatcaaaatcactattttatttccaactgcatcttcgcctttgatgttcccatttgttacttttcatctctttccccaagtgcatcttaaatatttggaacaactgttttgcttccttgagccagcctttgcccattcctccccttaaaatacattcatgaaatctttatataatttaacaaaactgaatttacatccgtctttagtaatttcagctattggcagatctctatgtataaaccaagttctacaaaattgagaggtaattgggaaagaaatattaaaaatcagaataacataatgtgataaaagcataaagggaagtattgacacaaaatgctatggtaattactatagcaataatatgtagtattactgcaaatgaaagaaaatgacagcacagccagtagtgaacagctaccataatgtgtacgtcagctggtagtgtccctgtcagtagtgctttctcactgataggtgaaaattcaaactcctttacaagtcattggaaaccagttcccactgctgctt

SEQ ID NO: 131386 - DNA, 1025 bp, Homo sapiens
ccctgatggtgtaacctatctgagaccttaggtttcctgacatgaagctgttgagttttcactttgtctgaattagtttgaatttatttggccatttaattgagcacctagtattatactgaggagtcagataaagttagaagtttaaggttagaatttttgtaaataaactcacaattcctatttctaaaaattgcttactatttttcaacttaatttctcttcagaacatctcttgatcaagcactagagctatgatttatttacatttggtacatatatattaaatgtgcagttttaaattaaaaattataaaatgaaactatatgtatttaacttaatagaaatttagacagaaacaactgtgctatatccagggttacagtcttacagtaatactgactttagtgttaatgaaatacagttaaaagcatgtatttaattgctggttagtttttgtttagagttagtagagaaatgcttcttagaatgaatttactagagatttggcatatattattgaggaagaacaatttttcccagattagatgtgataccttagaactgaaagaatatgattttcagttgctttgtggcaatctgtctaatgccccttggaagatcttttttgctctctgtagatattttttgagtggctcgagatgctttacctatatttaaaacttaacaatttaaaaataaattcagttttaatggaaagtttaaagattccattttttcctccaaatagatgttatggaaagagcctacaccgggtgttaggtaacttagcgtgtgagcctctgcaaatcacttaatcttcttctgctgtaaatgtctgaatgtgagctaaagtaatttcagtgttttttgaggttgtctggttatcttcccaccttctttatttgctgttctgctgcattcgcccaactgcctcagtagccaacagggtgtcacttttaggaacttcaaccatttaattaaacattgtcagactattcttttccatctaataacagcaagct

SEQ ID NO: 131387 - DNA, 2705 bp, Homo sapiens
tcctttaatctcttaatctagaataatccttcttttattttcttctcattaaccttttgaggagtccaggctaattttcatctggagaactttcttcttgaaacacattcttcacttgtttccctggattcacttgtttccctgtttcttctccctttcttagtacccttggctatcctcagccttctaaactctcaaatgctcttctcaccaaaaattggaagtgcgtcagggcccagtccttgaacctcttctcatgccttagatgattgcattttgtctcatgtatctaaaaatcatctatatgctaatgcctcccaaatttaaatctccagttttgactgcttccctgtattctagactcacatatacacatttctattaagcaaattcatctgttgtctagtagacatctccaatgaataagtccatttggagatgtcttgcttcttatctacttcacccaaaccaacctgttccttcccagttttccctgtctcaattaatagcatcactgttctttttgttgctctggtttgaaggctttgccttatctgtgactcctctttgttcaaccaaaaaaataaaaaaagtacatatatatatacactcacacacacacacacacatatttaaaaatatattagaaaaaagtatatctgaactctggcacgtctcatcatctctccctctactctgattttaagctgctgtactccatcctgttttattccaaaaactgcctcactgtgatctgttttcttctgccattgcctccacgtaattctttctccgtagatcaactacagttatcttttccaaatgaaatttctgtgtgtcctacaagaacctaaataatatggtccctgttacctttctgactttctttcctttatttatttatttattattattttatttatttttttactattaattgtttctgtcaatccactcagacctatactgttccattaacttgcctgccgagcacatttttgccttatgccttttttttttttttgagagagagagagtctcactttgttgcccaggctagagtgcagtggcccaatcttggctcactgcaacctccgcctcctgggttcaagcatttctcctgctttagcctcccgagaagccgggattacaggcatatgccaccacacctgactaagtttgtatttttagtagagacagggtttcaccatgttgccaggctggtctggaactcctgaccgcaggtgatccacccaccttggcctcccaaagtgcttacaggcgtgagccaccatgcccagcccttaggcccttttcacacactgttccctctgcctagatattctttaccagatatctgcatagcttatttcttcatgtctttcagatttctgctcaggcatttatattctgagagaggcctcgcctgattcctctgctcaccctttcactctatatacctttaccttgctttaaaaaaaatagtgttcatgtatcacctgaaatgttatgtaagtatctgtttattatctaccttctttcactagactaagttccaagagcacataaaattttgccggttttgtacacagctgtatccccagtacctgtagtagtgcttcacacatagttggaatgtaagaaatgtttgttaagtgaatactggcatttatgaattccagttgtgaaaatgaagaaaatacttttagtcagggctctggcattgaagctaagtcagatttttggatctatggagctaagaggaagagtattccaaatgatttgatttgagcaagagcaaggattttctgtaatttcttatacttgctgctctaaccttttttctctacctaatgaaaatttcaataagatatcaaaataaacccatactctgaaatctgtgagtatagaatatgaatctgaggttttgtctttttaatctttgtttttcaagcacccagtacaatgtctggcccataatagatgcttgccagaaatcatttgtagaatgacactttcaaacagatgttttgtgagtagcctgttcttgttccctgtagttatcctgtgaacactggattagtgaataccgaaccattgcttctggggggaaatacggagttaggttcctctgaacctctggtcacagcattttcatcaaccaatcaatacataaccttgttttatgtgtgtttctgtttaaagatatcttaacactgaacttgtgaccaacagcagtataataacaagcttatctaacacacatattatctctataaggcaacaacacagccttcttgtatttaggaacactaaatagcactcagtataccaagcttgggggatattttaaacagtgaagtcactaagaaaaagtccacagatgccagaaacatagcactacatagaaaatgaaaaggatgcttgtttgttgtatgaaaggtgaaagaaggcagagcatcaccttgttcagcctcagctgggaacatgtgcgtcaagtaacacaaatttatttccactctgagcatgtccatgaatgactgcaaaagcactatgagtattgattttggggtaacaaataaattttaacaagtaggcaaatttgtaaatatggaatctatgaataaagagatcaactgtattttgaaagtaaatagtgatcaggagacttacactttcacttataaacctgtttactttaaaaa

SEQ ID NO: 131388 - DNA, 1916 bp, Homo sapiens
tttgtttgaaggtggagccagtaggacttcctgaatattgagtataggccaacagcaaaagaagaaacaaggattaccccaaggttttttggtttgtccaactggagggtgtgtcatcaactgagatagggaaggctgagattgaaccaggtttcaggtggaagaataggagttagtttgggttatatcggtctaagatgactctcaactcagtgccgctccaagtatggttccttccttgggctgtttgttgcctgtctgtgatgagataaatacaggaagtaaaataaaaattttaaaacctttttcagcaatctgacatcgcccagcatttgtatttttttcattaaaaattttttttttctaagtatcaaactattagtctacaatggatggggacaaaaactggcctttttcttatatgtagactagtttgaggttgtgataagtaaatttaaaataagaccagctagcctcgttctatttttccagcattgtttagcctcttgtgtatatgcatagagaaagcatctggtggagatctttctggcctagaattttctaagaatttgaatacattgatgacgactgtaaaaacaatgctctattcctgaggcaacctaaagatacctatttcaggcaactttttaaagttgaaatttattccacatcacccatctgtactttcccaactacattgttctatttaactctccccaggaattgaactcctgaatcgtcttcagtttccagttggccactcagctttcaatataatgtacctaataatctctaaatgtttttgaagaccttcataaacagcttctactttcttacaagcttctcattgcccctccagattctattatgtgttatacaaaaaaaaaaaaaaaagtcataccgtaaagggaaatatatctttgggatatttataacaaaacgtaagtcatattgctaacaggaaaccaggaaggaataattactgtgtttgtctttgcagaatgattagaaaaaacaacccttttccagaaatagaaatgaaaacaaaaattctttagcaatagagttatttttcaaagaaattgttgacattaattgtagaaacgtgatgatatatgataataaatttaattactgtatttccattttaatgataattatctttattttttcctcttcttttttttttttttcccccccaagcaatgggccacttttgctagaatatggtatctcttagatgggaaaatgcagccacctggcaaacttgctgctatggcatctataagacttcagggattacataaacctgtgtaccatgcactgagtaagtattattttagacctgtcattaaccactgtagttttcatgccagaatagaatcttgatgaagtttaacagggctgagtttaagggccctttttatttttcctgaggatcctgtattccattcttgctgaaaccatactagcgcccaaaactgaatttggcttattcactggaaaaccgtatggatcagtttacccggaacaagcctattttatgccactgcccagcgaaattattagtagcccttcttttcacactcagaaataacctgatttgccccatgacttaaactttcacttttatatatgtcttttcacgtgatgacatccatataaagagtttttaagggaaataattttgccctctcttctaaaaaatcttttcccctagaaaaatatatggtgctagctaggtatgggaagcttattttcactaataagactaatagacttgcttttctgtatcctttttccaaaataaaattaaaaagttgttttcgttctagaagatttctgcttacagatagtttttgatagacttcatttaccccagcacttcatggccagatccagatgtcagtttttag

SEQ ID NO: 131389 - DNA, 1327 bp, Homo sapiens
ttattgcaggaaagattttctttgatttgtacctcaaatgtatatgtaaaagagctcttgggagtattccaggggttctcatgataaattttacttcccccttgcgtgtttagggtttcttatacacacggtccttgttttgtatgatagtgttgttctttataattgattgtgcaaagcaatcctaatataatcaatgagaaaaattagaattgtcccatgacctttaatatcttttgtcaaaacattaaaaattctcttactgttataaaattttatggaaataaaaaaatagtaaaaataaaatttattttgtaccctgtaattttaaaaccttaggtacattgagaattaaagtgttttatttctttgtaaaaaccttaccaagagtagtttgagcagtgcttgccaccttcacatcatcacgtaacttatgatacagaatgaacatcttttattggcgaattatcatattccagttgtatcaacttccaatgttttattcttcgattttttttttctttttttgagacagggtcccactttgttgctcaggctggagtccagtggctcaatcatgcttcactgcagcctcaacctccccggctcaagtgtcactatcctcctaccttagcctcctgagtagcagggactataggcatgagccaccacacctggctaattttttaactttttgtagagacagggtttcattatgttgcccaggctggtcttgaacacctgggctcaagtaatccacctgttttggcctcccaaagtgccgggattacagatgtgagccactgtgcccgacctggactttcaatgttgtgaaatatctctgagttcctttaatattaaggtttttgctagcctcattttctctgggacatcttcacctttttgatcaaaaggtgtttgtcacagcagctatttttagaactctatttacattagctttgaagattgctttcagtgttagcactttttgtttctttggtgtttctttatctctctctttttaaaaaattccctcatccatttatccatttttataaaatatcacatgggtttacactgggaaaccagaaggcaacacaattacatcctttgctacctgtgtgtgaactgaatggcacttgcacagtgaccaatcaatgacgtactttaaaagtagtaacatgattggttactgatcatgacacacatcttttatgtatacagtggttttgtagactgagaagcttgcaatgaagtcttaaactatgcagttatagttagtgaatataccatggtaactgaaatttgaaccaggttgttggggaac

SEQ ID NO: 131390 - DNA, 1922 bp, Homo sapiens
atgtggttttattttcaagcctgttcagtgggaggtatacctggttccaagaagtggttctttgcagtgcaggcaatatatggattttatcaggtaatataaatttaaagatagctactaatgaatgtctttactaatataaataatttcatgatccattatttaatacaatcttttgatttgttagttttgtagttctgattggcaagagatacattttgatacagaaaaagataaaattgaagatgttcttcaaacgaatatcgaagaatgtttgggtgctgttgagtgttttgaagaagaagacagtaatagcagggaatcattatccttggctgagtatgcttatatggtttttgtattatcattaaaatacttaatattagacagttattttaatccatgagaatgaagattatatattttagcatctttactgaagaaactctagttaattgaaatttttgactctcaatttgggccttttatttgaataaaattctttaaaatgcatgtttcttaagcttacataatgtcaagaatcataaaaagtgatattttaataaacatgttcctttcttgaagataaattctgcctaatattttattttatttttgaaacagggtcttgctgtgtcacccaggctgcagtgcagtggtgcagtcacggcttgctacagcctagacctgggctcaagcgatcctccgacctcagcttccagagtagctggaactacaggtgtgcaccaccacacccagctaatttttgtatttttttttgtagaaatatcatttcgccatgttgttcaggctgacctcgaattcctgagctcaagcaatctgcctgccttggcctcccaaactgctgggagtacagctgtgagccaccgtgcctggccaataatgtattttaaaagcttgaatagaaatgttatttaatgttaatagctagcattcataccaaagtatcattttcattttgctatttgaggctgaaatatgtgacttctttaatttatgtgtatttgcagcatttcaggtaccttttaaaatccatagagtttgtgaggattatatgtacatgattgagttcacttttaggtttttttcaattgtggtacaatatgtaagttgatccaggtgacataagttgtgataataatttttctcttgatgaaatatcccacctcttatagttaataccttttattttagtctttcataacatttcatgacaaaactgctcttattttagtattcacatattatatctgtaagtagctgtagacttaaaaattttcattttcctttttccagatcatatttgtttgtactgattaataaaaggagacctttccaaaccagagaaatatcattgaaccagggattagtagaggtagactttatttacacaatcttaggccagtcacgtaacttctctggtcgtttgttttctcatccataaagtattgaagtacttttagataatttcttaggtgctttcatttacccttaaaaactcttatcatcccatatgttttcctaccactgttaaagacaagtatagccaggcacagtggctcacgcctgtaatcccagcactttgggaggccgaggcgggtgggtcacaaggtcaggagttcaagaccagcctggctaacatggtgaaaccccttttctactgaaaatagaaaaaattagccgggcgtggtggcaggtgtctgtaatctcagctactcgggagcctgaggctggagaattgcttgaacccgggaggcggaggttgcagtgagctgagattctgccactgtactccagcctgagcgacagagcaacactccgtctcaaaaaaaaaaaaaaaaaaagaaaaggcaagtataaaagtttctgataagtgacctaataattatttccacaagggg

SEQ ID NO: 131391 - DNA, 1044 bp, Homo sapiens
agataacatggctttcaataaatgatgaacatttaaaaagtttgaattcctaagggcgtatattgttttggagaatttcagaaattaaaactaaaagcttcctttgtcttctaaataaatataaaactaatttttctaaataaacataaaattcagttcttcagggtactattttgagacatttcagatctaactttttaaaaattacaaaaatgcctttttctctttctaggtagagcaatggtagatataatactgttgctttctgacaaagatcctcctaaattgaaagactatttacctactgtaggagcattaaaacatttgagagaatggtattcagcaaagatcactatagcaggaaatcattgtgaaatgtaagcttctttgttcatatttgattattgtctgccttgtctgttttcacaattaacatactattctcttttcagactcagcgtttgaaaattattttaatatgacaacataaaattctatgttataccatgattgcaaatttgtgtattgagaagaatctagatgtttcatattttatatttatgtttctgagatatttaagtttttagtaaatattattgatgctgttttacaaccattattgaggattaattctataagcacactgtgtgcttttgaacatagatacactggatttgtcatgttgtatttggttttctgttatgtgccaatgtaggaataaatatacactgttgtgttttatgatattctagcaaggattaattgtatattacaattttgatccttaaacattcagttggatttaataacttcatgatttgttttcattcaacgaatgtttattgagcaatacctttatggcaagcatagcaatagatgcttgtaagttaagaaagtgagaagacatgatctttttcattgaagtgcagggagaaacaggaatgctaacagtcaagaaagtctgtggtaagtgcgttacagaattccatgcaaagatgtatgggaacaatataggagagcagttctctttttgaagataaggaa

SEQ ID NO: 131392 - DNA, 1088 bp, Homo sapiens
ttagatgtttggccgtgtttttacataatattcagtatactttttgctaccattatgttaagaaaagttctacaacttgaaaaaaaaaatcttccctcaaatactgtatttatgcttttagaataggcagaggacttcctggtatatggtgtagagaggagggagaaatgttaggaatctgtggaaaataaaacaagtaatttataaacttaaaaaatgtttaaatgtttctcctgccatcagcatgaagaaacctaagaatcagtcagctgatgtatcattttatgtatttaagtaaatataaatggtatcacatgtatctgcaaatatattcaacatattttaaactctcttttaaaaatatataagcatgtttagaaatacacctaagaacagaacattttatataaaaagaaattgttattggctggaaatgaaacactagcatagtgtttttgaatttttatttaggagctacagtttttataaatttcttgttcttatagtttatagtaatgctctatatagtagcactgtttcttagcatattttcagaatcaaacaaataattggaaaaatacttatccttagggaaaggcgtaattgttaactgctacagttaaattttttaatagatgaatttaagcaactgtggaagaattgaaataatgaaacttattttaaggagtacattgtttcatgggtaccattacatcatttctttaactccttagtacagaggattgacaaacagtaccaaacagaattctgtgttgctgttggagcagatttcttctctgtgtagcaaggtattgagggtttcttgggggttttttgtttgtttgtttttatacttgccatttaaggatgtgtaagaaaagggaatgtaacttattaatctgtttgcttgatgacttggtttctttaatgtaatataggataattttggtcctaactcatattaagatactttggacttttcataataactgtaaaagtactctgcaaacataagtgacattttgtttttaggagatattttcagaaataagctttatgactggtaattgctttaaagttttaaaatt

SEQ ID NO: 131393 - DNA, 1032 bp, Homo sapiens
aatagaaaatattatccaggcgtggtggcatgcgcctacttgggaggctgaggcgggagagtcacttgaaccagggaggcagaggttgcagtgagcagagatcacaccactgcactccagcatgggcaacagggtgagattgtctcaaaaaaaagattttgaaactcagatttgaaatgttatttggcgtttatattctggagatagaatgatagcttgaacagatcatcctcaagtctctcagaggttatctaatgattagtgtatgggtgagaacaagttatcagcacctaagtgtattaagaatgcattataaacaactgacaattttattttgtagggaattatagtttgtgtgatttagaaatacttattttcatatttgtagcaaatgtctagtcaatttcagtctgtctcaaaagtgtggccatttcagctaatgggtcccaccacatttatattaggttataagtaatgcattgaactgcatttagcatccctaaaatgttgagaaagctataactgggactcagtctggcatactcacattacagccttgtccacctttttaaccgtacagtctggtcacattttttgggttatgaagtcttatgtatgcaagaaagaactaggatttagtgtcgagaaaattagatatattttttatatttaatgattattttctattgctaaatatttttatttttaatttctaattcttaactacataaaatatatttgactttaaaaagattatggctataataataaagaaaaataagcatatttcttttaacctttcttattttgttcctaacatattaggttggtgtaaaagtaattatggtttcagaccatgaattttaagtcattataactaggctcaaacacatctttatgaataaaaatagaaaccattacaatcaacacatttttgccaatgataattaagtttttttattcctgtagtataaaaatccatgctttggaattctacgaactcttggaaagcgttttctgcatcctgccttg

SEQ ID NO: 131394 - DNA, 1182 bp, Homo sapiens
tgcctacattggaaactagattttgctttattatttcatttttggaatgattattaaaataattggttatattattttgccatttctttatgaacatatataataactatcagtaagtcggaatattcacttacccagaatatcctgtttcccccgtagtcctgggatatattttttccttccatcatgtggaatattatttatcctttagattattataattttgtttacatattagctgttaaaaatgagtattataaggttttaagaacaactaagaaacttattgacaaagaatataacttgatttttgttatataagaattttttttgctaatactaataaagacataagactttattgtggtttatgtgttatctgtaaactttgatgcaactaatagacacttggtagtttctgcttctcccattttatctgtatagtatatccaaaatatacgtatgcttttggtggagaggggcatacaagccaacaccttatcaaataataatgtaagtaaacataacagttgaaaatagacagacttttttttagtaatcattttcccttattactttaggaagagtgatgaggctggaataactacgctaattgtaaatctgttactctctgtggcatttacataaaagttatttaataagtcttcaattaacacctgccaaatctggagcaacattttttaaatgactgcagagtcattatggctaagagagttgtttacagtaaatatttttcttttgaggaaaataagattgttgtaattacaagcttcagtgattaaaatgcaaataaaggtgatgagatttaaaataaatgtggaaagaatgtcatagattgaagatatatatataagttgaatcagcaagcagctaaaatggtaaatgaattaaggtcactgtatcttttggcaaaccttaatttctaataaaactggtaacaacaagtgtttttcttttctaataacctttatttaaattcatgttctaaaactgcagtttatgagcagaattaatgtcactctagctatctaattgtaaaaattgtttttgttacttcatcattgtttttgggaatagactataacccacggtatcttcctatctatgaaataaactgtagctattgtaataaaattacagtactttcttagtattttggga

SEQ ID NO: 131395 - DNA, 1062 bp, Homo sapiens
atgcaagttatatgaagcagatttattacttacagataggcagcaaggaacaaaagaagcctaggatctgttgtgagccaggcccccaaggctcacgaaagcttcccagggcagatggtgtcttgactgcatgtacgccatttgcaccacagctaagggaccccaaaaggcagcctgacctggcttctatatttcaggggccatgtgactcattgggcaacgctttgaaggacatcctgcttttaggggacagaggaaaaaaacccaagctatcctgggcagttcctccctatttcaagatagtacatttccagtgcattctgcagttattctgagtaaaatgggcatgaagaatggggagagagacacggctaaggctatcatgggaccatccagcacatttatctaggttggattcattgtggaggggactgcacaaaaaggaataacaggagatgtggttcattcaatggcttttgggggtatctttacagactagctaccattccctatctgtgatttctgatcaggtagaagaaaatgtgattcagggaattctactttgctatctaaattccctcaatttaaaaatcaggtcaatgtttaaaatgcaaaataattgagtatgcttattttctgctgcttaattattattattatttactttgaaatatgtaaggtcgagagaggtgagtgattgacttttattttttgttaaatccttgctataacacatttcccaggaactgagtactaattgttggcaaagggcatcattaatgttgaccttttttttttcttatttctcaggttttccttttgacttattatcacttccacatttttctggggagcagattgtacagagagagaaacagttagctaatgttcaagttttagctttggaagaatgcctaagtaagtaacaatttgtgtattttatcctaccctaaaaatgttgacttgtttggacataagctacctttatttgcacactttttcatatatagtttatcttttagttatgctacttaattatagaactatttttgaaagcaatga

SEQ ID NO: 131396 - DNA, 1069 bp, Homo sapiens
aaaaagacaatgaaccttatgattttctcactaagaggatgtaatagaggcagaatatattacagctctcattttactgttactaatattcttgattgtggaaggaatgttagttatcttgggtcagatttggaaggaccctaccaatgtccacattggtgatgcaggattttacagaggcttgtatcatgaagctgatgttctaaagtagaacctcgacattggttgcctccttcttattctactcccttgcattatttatgtgctgacctcaggtagtgtaatgtaataatgctttaatcctctgtgtctaaggacacagtacagtgctttttaggcagtaagctcttaaaattaataaatgtgcgttttgttgaattctctatgaacttctaggttagtattttattgtggaagaaaatgttactagtctagaagtgttttaaaatggactatttttatcaaagtgatacatggatatagtttgaaaaatcaagtgatactgaaaaagcttcaagtggcaaacagcaatgcactacccatgcctccccatctttcagtccctgtgtttatagacagctatcctcagctcttccaggtggacccctatacaaataatgtacgtatgctgctatttcttgatttactagtttcaggcattatcttaacatctaactatggaagataaaaacttcactttcccacataatcctcactttctctttctgcttcttcaagtgaagtcatgaattttggttaaatcagtggttggctttaatattattataattttataaataagtttactgttgagccatgtaataaatgatgatgatcagatctctcttatataattctttgtttctcttatggttgataatcaccttattttaaatttgcctactcttctgtatagacagaacattgttatgtttttccagaggctccaacatttctgctgcactcctatcattaacattcattgtgtattcaaatacatcagttcctttttatttctctattgttttctttcctggagtgtttcatattttgctcgactatggactga

SEQ ID NO: 131397 - DNA, 1027 bp, Homo sapiens
tgcgtctgtaatgtaaccttttgtatgttagcatctttacttgacaagtcggaataatgattgctttttaagcttggcatgccgattttcactttacaaagtacttatttttagttattatttcattttgagataagacctattccatctttttcaaggaaacttgtgaggattaagaatatattatatgtaaagtagtttgaaaaatataaagtcctgcatgtatttcaggtatataataatgattcagtgcttattcataatgtcatcatcatggctacaagagactttggggagatttctgattattgtctcatttcacggttgtgcttcaagtaatctttccagttcatggaaaattggaacattcagtcacttccctcaaaaatttatagtattgtggggtttcagaacatacaagagaatttagatttaagttttatagaattggtaacttcacaccactgaataataggccatcattaatagataatgtaattatgtttcttttaagtagttaaaatactacttcttgacatgataactgcaagttttattgtgacctaaagattttttaaaacatagttagaaactaagttatttgcaaatattttactttattgtctgtcctaaatgtttaattctcccatgttgctggtgtgtttttctggtttctgctcacatcttcttttcccgactgtgcttttttttttttttgactctggcttctctctggattgaatccacttttaataaatctgcataacattattttcccagaactggttcattacctcattcatctgaacagttgctgggccacaaagagggtcctcgggactcaatcacattgttggatgctaaagaattgctgaagtactttacctcagatggattacccattggagatcttcaacctttaccgattcaaaaggggtaggttataaacttataatttccagttaactttttaaaaattacttttaaataaaattgtgtctcatttccttattaattgatgtcctat

SEQ ID NO: 131398 - DNA, 1270 bp, Homo sapiens
aaaaacttgtgagtgaaattaaacaaaaataggtaaggttgctgagggcgattgatatgagaaatgagagacaatatggtaaaggaaagaagtaaaatgctagataaagatttccattttacaaaattattttaataatcatcgaaatactggggtcattgtaatttactaatgttactttttgtggaataatttaaatggatgcatttgaatataatgtctgctttttaggattcattaattggcatgaattttacattttaatgtaataatttcgaatgcttatcatagtaccctagataattttcagtggcaggacagttttcattaccaatgccataggggggaaaatgtgatagcaaatttattcttagtactctactatttacttacccttctacataccatttccaactcttctgaactcaagcccctggtatttcattttacctagtaactatttaaagaccactgttgcataatttccccatttcctgaacttctgagcttcaggaccatgatccattacattacaacagtggtttccagctcagagaaggacggcacctatcggaataatccagagagcttaatctaattgcagtgaccctcttctttcccagattttgatatatcgctgtagttctaggtgtggaaaggcttgaacatgaatattttatgtaaactcgacatatgattagttctaacatgccagttgattgaaaacctacttcagaaaaagaactgaactcagcagttagtctctataccctctgatatttaaaaagttgctgactcttaaagtaggtgccagtgactacattctcaagcaaagaaagatctgggtcccacgtgttttagtaggaagtaaatacttttattgttaccaaagattcaagttgactttaattattcccctgcagaaaaggatttaactaaatgcctaaacattagtttactctaccaaggaaaatcttccagaaataaggctgcctcttggctggacgcagtggctcatgccagtaatcctaacactttgggaggctgaggccggcggatcacttgaggtcaggagtttgagaccagcctggccaacatggtgaaaccctgtctctactaaaaatacaaaaattagttggacatgggagcgggtgcctgtaattctagctactcgggaagctgaggcaggagaatcgcttgaacctgggaggcagaagttgcagtgagctgagattacaccactacaccccagcctggacgacagagtgag

SEQ ID NO: 131399 - DNA, 1016 bp, Homo sapiens
cattatattgcctcttgccagactcttgaaattcacatttccaattttactctagattctaccaattacccatgatagaagtcggactcatcagtaacccttagggttgcttctggtttttaatgaaatatgtttcttaagcaacagactagagaaagaatattagctagagagatgccaagacctaggttctactccctactctgccaccaactcacattcagatttagagatcaattttgtcaccggttaaattaaactgagtagatcagagatttttcagtcctagttataatttagaatcatctaagtagactttttaaaaagtgtgtatttttaatatttaaatataattaattttaatataataagatgttttgatgtacgtatgtatagtgaaatgatcactgtagccaggcaaactaacataaccatcatctcacatagttacctcttgttttgtgtgccaagagcacccaaagtctagtctcttagcaaattttcaatatacagtacatatgattaactatagtccttgtactgtatgctagatttctagatttattcatcctacataactctgcaactttgtaccctttaatctacatctttccataaccttccccatccccataaccactattctactctgtttctatggatttgagtagttttttaagaatcacccaggcagatttttaaaactgtcaaagacagagtattaccctagaccaattaaatcagaaacactgagcaagtagtatttcttgaaagctcttcagatggttctaatgctcagccatgtgttgaacaggagtaagatgattcttacactttacatagagatagtataccaaaatggttaaagtcaggctctgaagtcaccaacctgggtttacattctggctgtgctacatattgtcagcatactgccagctttactgtggtagaaaataaatctaatgatgatgataacaataatagtaacatacatttcttgactgccctgtttgcat

SEQ ID NO: 131400 - DNA, 1889 bp, Homo sapiens
aggacaagaaaaaactggaaatgtttttaatacatattgaacaataacaaaaaagcacatggaagtgtggtgtaacagagtgaaaagagttacaatttaattgggtgcctagtggaatactagtgagaagcatgttaattccacagaagctgaggtgctcaggatttgaagacaccagctatcatggaaagcaggggcgagggtccatgtagaaagcagggaagtttaaataaagatctacaaagtgacctggagattgtccaacttgctttgcatgctcttctccccaaatgttcactacaaggtctatcatgcataggtttttccacccacctcagtgacactgtaggaaatagtcgctggggaaaatattggaagctgcagtggaaaagctaactggccatcttgtcactctaccttgaaaagaaaccagtgacaatctctgcacagagtttccagtcagatttttagtgtctcacttttaaatatgactagacagccatggattagcaggctttgaggaaagcttctaacacaattgatgccaaaacatataggaataaagggaactctgaagaagcaggaagttgaagaaaacttcataaaaactataattctcatagaaagaagataatcgcatccataaaactagaacaggatgctgtttccaaaaaaagcataaaacatgaaagctccataactttaaaaatatgataaagtcaattaaatagaaaggctgaacagttgagatgaaaaaaatttaccagaaattagaatcaaatgacaaaaacattaaatccaggctaagaaaattggaggattaatacagaagatccaaaatgctaataatatgaattttgtattttttgaacaattttctctcctttgttctcaaagtttagaagagagaaacttgttcaaaaatataacaaagttttccaggagtggacacaagcgtcctagcttgtccaagccaatgaatgaaaattcttcaacgagtcacataattatggaatttcacacctcttagcatggagagaacattttctaaaagcttcccaggaaataatctagtttatatatagtgaatcaataatcagaatggcattggacttctccacagtaacactgtatgctagaagatagtagaaaagtatcttcaaattctgagggatgtgcatttctagaattaaaaaaagaaaaaagaaaaaagaaaagaaacttctgagggaaggtgacttacctagtattctatacccagtctggaatgcagtcaggtatgaggatttaatgaagatacattcaaacatggaatatctgaaaaagaatttattttacccttttgaggaatctgctagaagatgaagttcaacagaacaagggactaaatcaagaaacaaaacaaaaactaatctaaaatggaaaagacaagtcctaataggaccaggcctaggcagcaactagaacaaattagaggaggctatgggagaaagatctccaggtttaaaaaatttaattaaaaagaccaaaagcagaaaggaagctgaactgagagattatcctgtatacttcagggcttgaaaaaactttgctgtacatttagcccatttattgccagtatttaggagtgaaaaacccagaattatatacatggaaagctgagcaaatgaaaaaagctaacaggtagttaacaggataaatagaatattggaagaaagataaattataaccataatacattaattagcacacaattgaaagtatttacatagatacaatagtgtaaacactgcctatttacaatcaaaaattgtggtacaactgttcttcaaaggaagagaaggaaggttttgtgtacgagacctgaatccatccatgacgttctccct

SEQ ID NO: 131401 - DNA, 1101 bp, Homo sapiens
gagtttcagcttgtttgtttgcatttaggggctacgtgcatgaaaaattccatacccagaagtacattcaatgcagccagatgttcaaactacaagagacacaggggagtgaagcctaacccaggaaataatagattctcagtcttatttcatgcttgtgctgggacatatagatgctcaggaaaggaatattcagagagaattttacacagtatttaaattcttttctccgtcacatttatttatttttcttatagttgaatttgcacaaattaaagtcatgttattgaactcccttgcatatttgtccagatgcccagctcttgggtgctatcttaacctcattggagaggagatggcagaagagcagggtatagtggagccctttgattccagaccagaaaaatgagagcagatcaccaatttgggtcttatacaaggtgatatgccaggtgaataaactagtctccattttgatgatgtctctctctctctctctccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactggtgagtactgcagtgagctaccaaggacacattgttacgggaagatgaaccctctactccaccggggccttaaagtagttttcatcactggcctctggggatagttaaaattccagaagcaaatttaaattcttctaaattaaggaggtctataccctactaaaatgtaacctaaggctttgattatagaaagacttatcctaccttcattcaagaaaagttggtaagttggatagtcagttacagttttcctacctgtaacctctgggtggcttcctggaggaatgaactttgaggcatgaatgagtagtgctcttggttacaaacaacagaaactgattccgagtaatctatcacagaataaaattattggaaatatattaggcagttaataggattga

SEQ ID NO: 131402 - DNA, 1033 bp, Homo sapiens
cttgcatgacaaaaatttcgtgccctttggccaacacatccccatttccctctccccgctggaaaccaccattctactctctgctttaagagcttcgtcattttagattcctcatataaatgggatcctgtagtgtttgtccttgtgtgtctggcatatttcacttagcataatgttcttcaggttcattcatgttgtcaaatatgggagaatttcttttttaaggctgaataatattgaattatatgtaaataccacactttctttatccgttcatctatagacggacctttagaggcatcacacttcctgatttcaaactgtattacaagcctataataatcaaaaccttatgatactggcataaaaacacggagaccagtagaacagattggagagcccaaaaataaattcacccatttgtggtcatctgattgttgacaagggtgccaagaatacacaatggagaaaggatattctcttcaataaatggtgctgggaaaactggatattcatatgcaaaacaatgaaccctattttacaccatacacaaaaataaactcaaaatggataaaagacttaaaggtaagatctgaaactgtaaaacttccagaagaaaacatagggaaaaatattcttgacattggccttggcaatgatttattgtatatgacacctatagcacaggcaacaaaagcaaaaataaataaataaatggaactacatcaaactggaaagcttctgcatagcaaaggaaacaatcaacaaaatggaaaggcaacttacaaaatgggagacctcatatctaattaaaggttaatatccaaaatatataaagatttacatttcaatagcaaaaaaagaaaactgattcaaaaagaacctgaatagacatttctccaaagaagacatacagatgtccaaaaggtgtttaatgtcactaatgatctgagaaatgcaattcaaaaccacagtgaggatgtgcttaggatgtgtgttaggatggctattgtcaaaaagacaaatgataatg

SEQ ID NO: 131403 - DNA, 1044 bp, Homo sapiens
cagagtgaaagtgttcattgtgtctgacccatccagattcccagcagcgctagcagacagcacctcttgacataactccaggcagcctagctgccttgccttcctctttgtctgggtctgctgggcaccaagctctttcacctacatgagtgtggggaagtggtgttttgtcctctgtatgagctgtttgcttttccttcccatcagagtctaaccactcccctgtgctcaggctgagtcaagatgagcaaggctgggctggactctcattgtgccccatctcctcactcatatttcccaggatggccctgccctgtgtcttttgcttgtgcttccttcaccccacagccctgcagctgtgcctcatcccattcccttgggactaagcccagtttcccctctttctcttgctgccccatcttatggtcagcctcaaactgaactgcaaaactatatgtctgactgtagagctaccacactatgctgaccaagatagattatagataaattaaatgacaaattgatacatggaataaaagacaagtaaggaattccagctacctattgctgagtaatagctacttcaattaaatgccttttcactggggcagcagcttaaaagcaacagccaatttaacatctctcacaattctgtgggctgactgggtttagccggaaagaacttctgctccatgttctgtcagcaggacctgcagtcatctggaaactgcactgagctgtaccatccaagatggtgcacacatatggctgataattggtcctggttgtcatttgggacctcagctgggattgtcaactggagcacctttgttctccatgttctctgtctgtatggcttgggcctctctcagcatggtggctggatcccaggggcgcagtgttccaagtgcatgaaagcaggaggtgcagaatgtcttcaaacccagcttcagaagttgcacagcatcacttctgctgcatcctgttagtcaaaacaagtcatggggcctgcccagaggagagaaagagactctacttcttgat

SEQ ID NO: 131404 - DNA, 1122 bp, Homo sapiens
tagtcccagctatttgggaggctgaggcaggagaattgcttgaacccgggaggagaggttgcagtgagccaagatcgcgccactgcattccagcctgggcgacagagcgaaaccccgtctcaaaaaaagaaaaaaaaaaaaatctagagacttttttgaggggggtggatgatgaaaatattctaaaactatattatggcgatagccccacaaaaataactgagaataattgaattgtacattttaaatgagataatatggtggtatataaattacatgatagcaaatctgtgtaaaagtcatcttaacatgacttttaaacagctattaatgtttaaacgctttttaaaagtttaatgactttgaaacagctttgttacatagcttatacacagaattgacatttaaaatgacttttaaatgctttttattatataatttatatatataatttttaaaaattaatttaatagattgcaaacaatatttttctcttaattaaatagaatagaaaatattagattgtgtttatgtagtgtatcaggattctccagagaaacaggagcaataggatgtgtgtgtaagatggagagggatctagatagatacatagaaacacagggaaagataatcacatgattataggggctggcaaatctgaaatctgcagggtggactagctggctggaaattgtggcaacagatgaagttaaagtcttgagtccaaagacagtgtagaggcagaattcctttctttcgggggaacctcggtcttttcaggtcttcaactgattggacaaggcccacacacctgatggaaggtcatctgctttactcaaagtcaatgtgattaagtgttaatcacatctaaaaaatacattcacagcaacacctagactgatatttgaccaaacagtggcataccatagcctagctaggttgacacataaaatttaccatcacacagagtaaaaatagcattttgtgaaaagtttgtttccatttgcacactcacctgtgtgtgaactggcttgtgattttcaatgccttcattactgtgagtcatgggttaaaaaatacaaaagcctctgctttccatcttcatatgcagacagatgactg

SEQ ID NO: 131405 - DNA, 1037 bp, Homo sapiens
gctttagggtcatcactgttctagtcattatacatgtaattcagcccatttctatctgcagatgaggaaactcagatgcagagaggtaatttctttctccagggccacttagctcatagccagtacttggacctaggcaaactggctctgttaacgacattctaacttctgtgctatgcggcctctcctagacggcagtcattgggttctgtatctgccaccacccaaataccccccccaccagcccccccacccccacacacacacttcagcctctgtggacagtgagctctttgaagtccatggctatgttttctgcctcagtatctccagtacctagcaggctgcctagcaggaaacaaacattcaaggaatatttttgaatgaatgattcaaacatgattaaggttgtttgtacttgctgcacccaaaaatctaacctctttcagtttatgtttttgtagaaggtacatttaagtcttgctttcaggccatgctttcatgataattgataaacacccctcatacaaattgcccaagggtacactgctggatgtaaagtttaatcacttgactcacacatctggagggaacaaatgtttggaatgctgtgaggcagaggcagacatctgaccacctaggagctcagaaggtctccctggcagcacacacagcattctcctctcgctctccactgcctgctcctcccaacccaccccatgcaccttgatgccaagaagtagaaagttttgggttaatttctttcatctgtaacaatttttctgttctactattttaatacacattatcttaaaaaacaggaactaatgaagtcgaaacaaaacaagtctaaccccatagttttgctgcctcacagagagactgactttcttcccaacttgtctggcaccttggcatttactataagatgagaaagattgaatttcatgtagtgtgaccttttaaaacttgagttgaacatttgcattattctgatttttgtccttctttgcagaattgcatgacaatttaaaact

SEQ ID NO: 131406 - DNA, 1085 bp, Homo sapiens
gctagaaatggaaagaacattgtgtccatctactccgaatgatgaagagctgctaggagcagacctgagactcaaacccagagcttctgagtccatgtccactatgcactttccactgaaatcttgcccctccttttgacttcaaagaggaattgtccataggattcatttaaagatctaggttcccccaggagagttttaatttgatctacttacaaagctataatatttgcacacttattacaaaatactaagtaaatagagaaataggttatttgacaccttagtgacatcttctgcttacaatcatcctctcacttccctacccaccaacccctaacatctacttcacaagcctgtggtcatccttcagtcctcatacggatattacctactctgagtagtcgtttctgtctgcttccttcaagaccagagttgttgatattgttcttctgagaaaccctggctatcaattttccagcccttgccgtatgaagacgaaggtattaagtgacagaattgggtttgagctagccctttctgacttcaaagcccatgtgtcatggaaccatcgtattacactgtcttcaaaccccttccaaagctaccctaaccacattgtatggcttatgggaaagaaagcctatttcctccaccaaactatgaatccttcttgttatccatgctgaagcacaatcccatatttcgtttgtgtcctaaagcacataataggtgctcaacaaatgtctgacaatagactagaggaatgtatggataacaagaaagctagacctatactttctaggacatgatacatttttatgagttgaaaggaaccttagagaaaaatttatactaaagtcaaattgagaaggtattccaggctacaacagtgacttagcatcaaaatgagacaatgaatgatgtcttgtcgttttctagcttcttgctactcaaagtgtattacagggacaccagcagcatcacatcacctggggatttgtaagaaatgctgagtttcagaccccactccaggcctgtggaatcagaatctgcattttaatatgattcatcccattacagtt

SEQ ID NO: 131407 - DNA, 1026 bp, Homo sapiens
tttctctattgcttacattacctttttttttactttattttttaatccttctcatgaatatattttgttcaccttttacctgtcatattttagctttttgttttctgaatttttttatagaattttgttcttttttggatgtcatattttccgttaattcttggagaatattctctctttttacttttctttgtgttcttttttcctccatttactgttttctgtttgtttgtttgtttgtttgtttttatcttcatcttctttactggaggttttctcaaatgtctggtgatccattgctatctgttcatttcttgcactgagtaaaacatgttggaacctatgtggggagtggggagggggatgtcaactggtgagaattcacatagagttattgcttggtgaaccaagccttaccaagagatccttcccaattctgcaaatatcagtgtttagaagctttacctgggtctgtgcagttacttatgggagaatcattctgtctttttgagtgtggattgggggtagatagtgggagaatacccactttccactgttctgagagtcccaacactcagcatacagacttcatttagggccctcttttcagggccatatcaccccctaccctgtctctggaggttctgagcccatgcaggttgtgcagagccaagggactcacatctggatggaattctctttgtggccctttaggttatagcattttatactcttcctccactctgcagagtcagtaacccagctccatcgctgtctgtcctccaaacatgttgtgcctgtcttgttctcctgtgagtttagacctcctttactgtctttttactggatcttacaaaaggcaggagatcaacatgaatagccaaaccaccgtttttcccgaagagaatccttgcataatttgcatattggtatataacagagtacacaaaagattcattttaatgagcttaaaaaatatttttctagtcttgttatttttaagaaaatttgttttcttcctagata

SEQ ID NO: 131408 - DNA, 1049 bp, Homo sapiens
cagacaaaaaatttagacaaaaagtgtttatgtaagttctcaacattatatagctgttatatagtctagctgggcttcaaactcatgcctataaaatgggtgacagtgtcagttaatcatttccagaaaaatctaaactgagacaaaagcttactgagacattgtaggagcaattcatacactagggagaaaatttgaatagatgatttcttgggtttcttccagaagtagacttatatgctacaacagcactcccaggtcatttaattatattttaaagaatattttgggagacatcagaccttaatttagatattggaaacttcagtctgtatatcaagccagtagaggagaataagtttcaaacttttatattggtgctcgtcaagtccaccattgacgattatacatagggcttcccctgtgggagagggagagcctgttctgctgtggtgtgagaaccagcagggcagaatcaaacatgagaatccagctaagccagatggttccgaagggacttcaggtccagacaggtcccaaactgcttctaacaagaagattgggggcctaggtgaggcttgcccatggtagaagaagagaagaaaataaaaaggaaacaaatattttatgaaactccaggtacaggctgagcagggtatggtgtaccatcagaaatgtggaatctgcaaaacccaactctatgctgaatgcaagagacacatctaacagagtgattttaaaaggtgaaagatacaaggatgggcaaaagcttacaaggtaaatgcaaactattaaataacaacagaaagcattgattttgatcttgatataagacaaggtaaaatgcaggctgaaaaatgtccaaggtaaaatgtccataaagtagcacaaggaaggactgatttatgttgaaggcaagagttcacaagcaacatccagtagttatgaatacataccacataacaaaacagcaacttttatagcggaaactgcagaagatgcaagaagaaatagacagaaacatattcatattagatatttcaacatat

SEQ ID NO: 131409 - DNA, 1043 bp, Homo sapiens
aacagtatttcttcatcactgtgcctttgggcaagcacagatgtgttgcataccgttaaatcactctcttcttagggtgcaatgttgttctttgaaagtatttggttctccttccacctctctttcccccaccctctccttatgccaaataaggcacatttcccagacttactctccacacccagcaaggtattgcttcagaaatcctgagtgatttttttttaactcattccatcccagttgcatctccaagctcatgatacatgtttcttattcatttcaggtttgcacacattgagcacctcttagtatggagccctaaagtagattccagagatagaaacgtattaacaaagcaccaacacacagacctatagagaggccaccttcttttcttttcttccagtggagtttgccttgaattagagtcagggagaaccatagtgtaatagacacttcaatcttagtaacaaaaagggttgaaattatatttcaggcaatgttgattccattaaaagtatgagtcttgagagggaaatgatggagaagcagaggacttcttatgtgaatcaggtagtgtacaacatcctgtacaaccagctaccttttcgtaaaataaaatcccaaacctttgaaataccatcaaaacttgctacaattttagcttcaaaccaattttcccatttcccaggttaacgctatactttagctaaattattcaatttaccatctaaaaacactgtaaaatataggacttgccacggtacttggctagcagcaagcaactagtttatatttggagaagaatgagtgaatgaattaacatgaattatttcttcttccattgcaattaaaaaagatttaaaagctttagggataaagtagatttttgttatatggatgaattttatagtggtgaagtctgggattttagtgcacccatcacacaactagtgtacattgtacccaatagacaggttttcatcacttacccccacccaccctccccttttctgagtctccaatatccattatccctctct

SEQ ID NO: 131410 - DNA, 1077 bp, Homo sapiens
gtgagttttctgcagtagctgtgatttttcaaaaagtcatgaaaattagtatggaacaggaaatgagagtggtaatatctattatagtataatttcaagttttgaaaagttgcataatgcccagtaggtgtcaagtttttaggacataaatacttactgttgtttgggcctcattacttaataaatagatttgttaggtatttctttggtccccaagtgtgtcatgaaaaaatcactaagtcactaaggacaccgtttacccagaaaattgggacctctgaactgaagactcttacactatctgcatgcggaaatcctattaactgaacattggactctccccatattgacccactaataaactgatttttgttgctatttctccacttttccttcatttttattcatttttttttcattctggagaactagatttttatgtacaactcttgtattgatttttcattccatctatcatatctctaagttcccaaaccattttcttgttctttgattgttccttttttatatagcatcctcttgttgttttgtagacacattatctttgcttgtctgtctgagcatattataatagttttttgaagactattttgcaccagtattgactcagatgtctccaagttcctttttctctactttgtttttgagtgtgctatgcatatctgataatttcatctattttgagatttgttccatctttgtgtaccccaagagacagaatctgaaatgaggatctaagtgcaagaagtttatttgggatgtaattctagaaaacactggcagtaaagtgcagacatgagacagtgaagggaatgaaccaataaaggccgtactgttagttgctcagtccctctagagctcagcatgtcccaattgaaagtgagtgagaaagccggtaaaatggatttaccaactctccagccatctttgcgttaagggttgcttctgggacattaactccctggtcagcatctctatgagggctgtgtgtactcccaacaaaaagatgccttcagggagagaactgaaggtattttctgtaagcaacctgcagcc

SEQ ID NO: 131411 - DNA, 1107 bp, Homo sapiens
accggctcaagtacttcataatcagcctcaaataccctacctcctcaattacttgaagctccctgaaatcagaagccatgccttataccgctttaacttccttttgtccacccacagtgtcttcagtttgtgtagtatacagcaggatgggcctgatgaggtgttagatcatctgatttccagcacctgtttggagagtaggaagtcacctactctctggcacttccattttactagagccttaccaacctcatgttactctagagggtgatctaccttaaatgcaaaactgagcatgacatttccctgcttaaaactttaccctcaatctgaaattaattctgtaatacgcccccccaaggcatggtcctcaattccttacttttttttccccactcttccccctcagtagtctgaaggtcacattctgccctcttagccacactgagctacacatgaggcccagactctttcttaggctacctgaaggcatttgccttctataatgccctgtccaagagcagaccagatacccttcccatgggctaccacagcatctcataatgcccataatgtagccatttttcctccctcttgtaggtatctgcatggtacttatctgtatctgtcaatagaatgttgcttctttagggcaatgttctagtagagtatagtacataaaagacactcaataaattagttgttaaaagagcaaatatataaatcgatgagaaactctcttgcaatgagagaggaagcgattatttataaaggtgcggttcatcatctaatgactacccaggacatttcttaccattacaacttcagcaaactagatttggtaggcagaagaatgcccaccctctcctccaaacacacccacgtcctggtcttctccagatcgtgtgaatatgttaacttacgtggcaaaggggaattagggttgaagatggaattaaggttgctaatgagatgacatttaaatggagaattatcctggtgtgtttcttagtgaccaaagtaatcacaagggtccttaaaaatgaaagggaagcagaaaagagactggaatgatttgatgtgagaaggaattagaccgccattgca

SEQ ID NO: 131412 - DNA, 1053 bp, Homo sapiens
ggagccgcggagcagctcagcgctggagagagtccgtgggaggaggcacgctggcggtgaagggcggggacccacaacccagcggccgctcacctgttccagccgccgcagcctcggcggtcacacgccacccgcccgcccagacctcccctcctctgtccccagagcgcacgacgccgcggggacagcttcccgagcgccttccccgtcccgcttctctccagcccaccgcagccccctttcttcccagctcccccactccgtgggcgcccacactgcaccttcgccgggtgcgtgcgtcccgcctcggtgccctcactcggtcctcctgagccgacttccctttcatacccagcccgtagaattgtccctgggtcttaacaactcatttgtaactgatccaggtctcctccctctgcttcctcaaacccaggcttcgctgcctctgcggagttcttacctgtctctcctttccacccgggttccctggaggaagctaaactcagaccaaggccctgggctccccaggagttaaaagggaatacgctgtcccaagattctagaatgaagagtcaacgtagcccgagtggcttaaacctcctgtccttaaatgcaagaaatgttttctatcgagccctggacaggtgtctctgctggcctggggttttcaacaggtcatgcctgcctcagaccccagggacaaatgttcttccagctctaactcattctatgctttaagcttttgacctatctttgttttcccagtgccacaccaaatgctgcctggggatctctctttcttcctgagttcccatataagaagccccccatttaagaattcagttggaatgggttgtatttcaaaagttgctttgcaagttagttatttggatttcaagttgcattttaccagggtaacaatattataatgattgtttaccttcccagagcaatccagaaatgcccacataacccatgtcacacctgaaccaccctgagttcttctatccttgaacctctcaagctttcccctaactctaagcaggtctcatg

SEQ ID NO: 131413 - DNA, 1041 bp, Homo sapiens
gggtgatagggtaagacccagtctcaaaaaaaaaaaagaaaaagaaaaagaaaaaagaaatagaagtatggtaagaaattggtatatatcttatacctatatacctaaaggatgatcaatatgtggttgatttaaaaaaaaatctgagtcaaaaaggaataattaaaaaaaaacagagactcaagtttatactagtgagaaaggcaaagaatggataagtggttttccaatattgtccatcatttgttattgatgaagaaacaattaatgaaacaaatatcaatggaggtaatttgacatttgtgggatggaaaaatgtatatgtgaaaatatgtgaggattaataagattcccttgcaaataaatatgaggttagattttagcaaaaggtaagaaagcacatggaaaatagactttaaaatttagatattatcatgctatataacccattttatatatgtagtttgatagcaaaagcaaagaaattacattagaagggacaaagaaatagcctggtgatttttaaaaaaaggagctggcaaaattgagacagaggagagaatgtagaaatctagccaaaaaaagctgataattttcaatagcctttatataaagcattatttcacgattcaaatttgcaggaaggccatgggaaactctcctattgctgctattgcaaaaaaagtgtggataaaggagaggaaaagtaatagccaaggataggatcagtttgaaattaaccagcacaggaggaactggaacctaaaaacattcaaatcttacgtgttatgaaagagtgcctgggaaaagagtttagggattgagatctaaagcctaaaaaaaaaaaatctcaatttggccaggcgcagtgggtcacgcctgtaatcccagcactttgggaggccgaggaagtcagatcatctgaggtcaggagcaagaccagcctggccaaaatggcgaaaccccgtctctactaaaaatacaaaaattagccaggcctggtggcgcgcacctgtagtcccaggtgaggcaggagaatca

SEQ ID NO: 131414 - DNA, 1040 bp, Homo sapiens
ggggacggagggagaggcgctaggggaactggcacctaagactgtgtaataggacacaggtcttgcaagtcctcctccccaggcaccgcccctgtgctcccagcgcctctttgcagctttaattatcctttcagcgccgttcccccgcggctgcgtttccgtggtcagaggaaaaaggctctttcgcctcccggttctcaccctcatacagaccctcctttcagacccgccctcctgttcacagggacccatttcggagccctggctcacgctgggcgggaactgccgtgacgaattccccccaaggtgttgattatccatcccaacccagcctctggcttccctcccacctccaccccagctcccacaggcccctcgccccgttcatcggctgggcgctcgagacggcgcccccagatctcccaccgggcagtgtccccagctgcagctgaggagagaagcgccggcgtgcgcggtgccacgtcggaattggctctggggacgccgcagctgccgaagcgcagcgcgcggtccccacgcacgccctgcctccgggcggccggcgggctggcccggcgaggagaggagggatgcgcgccctcctcccgctcctatctgcgggtgccaccgcctgcgtcagggacccctggcccgagtaagcccagactgacgagcctgacactttaatggggtgcgggaagtgcaaaggaggggaggcccgggaaaggggggagtggccgagaggggatggtagctgcgaggaggtagagaaggaccctccttctccagggtcccagcttgtcggagctggaagcccagattgcttaaccctttgcattcccagcaagaagcgactttttcacttagaagtaaaacgcgctgggctattccagtttttctccccacagtgtgtgtgtgtgtgtgtgtgtgtgggaaaaaaagaagggaaggggtggggcggctgtgcagaatgcattttccttacattgggaattcttgtttcctaactctggagcccctctgctgctccggaagatgca

SEQ ID NO: 131415 - DNA, 1045 bp, Homo sapiens
taataattgaatacagggaatatgggtaatcagaaaagactaataattcaagtacttttttaaaaattcaagaaaaagaaaataataggaatggagaacaaatgagacaaatataaaaccaacaggaatgagttgatttaaaagcaaatatgtcattaattatattaaataaaaataccctattttataaatcaaagttaataaaactggatttaaaaataatgttcaaaaattaaacttggcatagctgtattagtatcaacaaagtcggctgtaaagcaaagattactactggagaaaaacagaaatatttcataatgataaagaggtcacttgaatcagaaaatataacaataccaaattttagcacctaaatttttatgcatctaatgacatagccttaaagcacatgaaaaaacagatttaactaacaaaataattagacaaatacaccatcatggttggcaattttagtctttcattaactcatagaaaaagacactcttaaggatttgaaagatctgaatgccaagattgataaatgagccattggcatatatagatatcagatgtcagaggtgaccttccatcacttttttcatattctgttggtcagaagcaagttgcaggttccacatacacccaagaagaggggattagataatatgactcactggggctcaccttggggtgtctctcccactgccattcttatacatttgatagccatttatttagattgtccattatgtatcagatactgtgctagagctaggactactgaggtaagtaagctgtagttatctgctctcaagcagcttttagtctagtgggagacaaagactcataaacatttaataaacaatatgtataggcaatgagaaaggtatgaacaagaaatatgaaatagaggcacctagcccatcctcgtggttggtgacaggagtcagggagactgcatggatgaagacaggcctgagatgatttgggaagaataatttctaattatttaggtggtgagagtggggaaacacatcacaagtaa

SEQ ID NO: 131416 - DNA, 1003 bp, Homo sapiens
gtggctcatgcctggaatcccagcacttggggaggccgaggcaggcggatcacgagttcaagagatcgagaccatcctggctaacatggtgaaacgctgtctctattaaaaatatgaaaaaattagcccggcatggtggcgggcgcctctgtagtcacagctactcaggaggctgaggcaggagaatggtgtgaacccgggaggcggagtttgcagtgagccaagatcatgccactgcactccagcctgggtgacacagcgagactccgtctcaaaaaaaaaaaaaaagagtcaaaataatgtgattaaatgagttttgtaaaaatcatgcaacaaatggcctgtgctcaattaatattagcaggatttttttagttctcttttttccccctagagttcaataatgttatgataagtagcagaaagcatgggtgagattgagggtgaagagaggggtagatccttcaagtcagggatcaagaaacttcatagtagaggtagaatttgagttgagcattctgtgtaaagatgcttggcaacaggagatgaaacttttttttttctttttttcaccgtgtcttaacccattaactaaatatcagcaaaaaccctgaagagagaggataatattggacaattggggagcttcttttggactggcagtgggttggacattctttagcataggagcccttatctagctagccacagtggattattaaaggcttggtaactattccttaaggaatgtgtttgacttctagctgcattgaatagagaatattacttctacaattatgctgatgacatttcagctagtgaaaagagccacgggcagtaataaatggatctgtcattatccactgatatcccatcatacccattctgtgaagactggctgctgctaactgcagtgaagagagagagggacctcttgttcccatcccatattcaaaggcccacttagtctaagatgatagaaagtgaaaggatgctggggttt

SEQ ID NO: 131417 - DNA, 1032 bp, Homo sapiens
ccctctctaggctgtgaattgcccaggattcctctgctactttaaaatgtgcccatgttaaagctcgctccagaacaacaaaccatacccgtgacacaaacagcactgccccctcctttacacttacatgaaggagcgagcatgacagaatgtttcaccactcccagcccttttgatcataagcctcttcttttgatcctgatcaccacctatggtgtgcagggcaagagagtcagccaagcctcatctccccacgcagctgcaaggtttgagggaagtgggttaggcagtggcagctctttcctccgtcacagagaaagaaaatgacacatacaagatcaaatgctaagtagccatggaacctgggctaacaccctttgtttttggcttgtgcgccacaatttttttttttgtttgttttttagtattagaatttcatccaaagttctctgacaaagctaatcattcaaaattggtgaaatgaaaatgggggagataagaatccagagaagtcgtctattaaatatctttttggtgaacttcaactttcttttttagcttatgttttaaatctggaattttgttcccagaaaataatactgtgacttgattatctccatggcatagaggacttggttttagctcttagcctgctgataatccatggaggaaggctgagggctcagcctctgtgactgaggagctcctgggctaggtgacctggcagcatcctgatgtccaggaagcatcctttttccccagattctcgaggagagtcctgtccacctgactctcagccctcagcctttgctttgtaggagtaatgggcatttacatttacatttgcttttcttttctttttctttttgcttttctttttttttgagatggagtttcactcttgttgcccaggctggagggcagtggtgtgaccttagctcactgcaacctccacctcccaaacgattctcctgcctcagcctcccgagtagctgggattacaggcatgtgccaccacacccggctgatttt

SEQ ID NO: 131418 - DNA, 1053 bp, Homo sapiens
agagaaaggaaaaaaaaagaaagaggaattggaaactaacctcacaggggaaagaaaactcacttctgcataatcccacgctggtatttagttatgcccactgtgagtgcttttagacaacaagcaaccgagaaaccaatgtgcctgaggggacccgaaccacacccttgccccacttgtcacgcgtggggcctgaagtgtaagagcaggacctcgacagaggcagaagtgagttcgaatcatggctttgccccatgccagctatgtgacgttaggccactctgctgccatttcttcatctgtaaagggagattatcattgtatctatatcattcaaattgtttgaagcttacaagaaatcctgtagttagagaggtctctatgagttttcagaaggagttagaaaagggtgactctggggattgggtagggggggtggagggctacttttcattagaagatgatggttttcattataagcccctatagtgcttgatttcttgaccatgggcatgtatctgtctgctaaaaatatatatatatttttaaagcctcttaagaaatcatgtaaatccagcattgtgcacaatgtttggcaaagagtaagagcttaataaatggcataaatgaagacctaagtgccagccctagaggccgtccagtgtgcaggcttaagaactggcacagccacttatgagctgcagtgacacataaatgcccttcatctctataaacgtcagtttccttttctgtaaaatggggggtagtaacacctgcttccttggcttgttttgagtattaaatgcaacaatgtagggagaatgcttggcccagtacctgagatcttgtacacattcagcaagtggtcactatcatttcactgtggtcagagataacgtgaagctgggaacaatagtgaacatgttggatgatagatacagcttcctgaaagatctcagcagacaagaagaatggagcaaatgcagcaattcagagaacagcatcaagtcccacatgagcaggaaacgcggccctgaggtgtcacgtcctgcg

SEQ ID NO: 131419 - DNA, 1051 bp, Homo sapiens
tgccaatcaggcctttagtccactttcaggggggaagagaaggaaggtgggatggtaataggtccagagcgtttacgtaaagaccctttctcgtggaaggaaaatgtgtgagaggtaagaatccccctttcacatttaagaaagttgccaagaatttaataagcactcactttgtgtatcagtgctcttcatgcattcattcaataaatcaccaactatctattgatcacctgttttgtacctggttctcttctcaggctcttgggttcaaaacagaaagagattccttctctcatggaacttacatttttggactgaggagagacagacagtaagcaataatcatgataagtaaggaaatcatagactatgctagaaagcggtcattgttatagaaaaacaatagtaaccttagactcgagggaagtggaggagtgagccatggggctttctggggaaagagcattccaggcagagcgacagctggtgcaaagaccctaaggcaggagcgtgcctgaggggtgtgagaaaagcgaggagtccgatgtgtgcagcagaaaaggccatgcattctggagatgtgggagccagatggaaaagagccttatgggccacggtcaagacctcatgcctttcagagtgatgtgttatgtggttcacaccccgtagcaactctgtgatagttgttgttcttattatccctttctttacgtgaatgcactgagatacattgccaaaagccccctttattttacagctgagaaaattcatacccagagtagggaagcaacttgcccaaggccacagagtgggaaaaatggcacggagctagggttcgggttccctgattcttggtccagaaccctttctctcatgtctctgctccagaaatgaacttcttttgaaggaggtgactctgggcctctcttgaagattcagattagatcctggagctcttaacactgtgctttgctgcccagatcttctatgttaactacagtatttccttcctaggaagaggtttaacatggaaaacctgagaaaggctaac

SEQ ID NO: 131420 - DNA, 1040 bp, Homo sapiens
aagggtttttcgtgtatgattatagaagttatatgttggagcagggaaccccactataccctcattactttttttttcccttccttctttttttatcttgggcacacactagaatgtggcattgctctctgtgggcccatccgcactccattcagccaagtattctattgctaacagagaacagagcaggttgcacaagcaatggacaaaatctgaacatttccaacttccctcaccccatcattcactcacccatgagttcatctaaacccttcttccacttgtttatatttttagctggtacagcctctcgggcccagtgacttccatgtgttttccaccctcggtgtgaagtggcagaggcctgcccggctcgtatcctcagatgacctcctttggactccaaggggtcctccctgttttttacctttccagcattaagggaacaaaataagaacctcaatgatatgtttgcaattagcaaagcacacttatggacataattttgtagaactatagaacttggtattggaagaggccttaggaacagtttaggccagtgttttcctaaaagtccacaatacagggagtatttccagaaatcactgcaagttgtacagtccccaggatatggtggcacggggtggcatgggatcgtggggggtttggttttgtttttgcttcgggctgcaattggataacaatggttacctcgttttgttcagaaactccagcagttatacatatgcctggttattttgttaatagataattaatgtatgagagacagaatcttttaaactttgtgttgtggagaaggtggacattgatgggaccctctattctgagctagatctgtgagtggagaggtcactgcctgaaggttgagaaatatatattctggcacttcactgcctgaagggtgagaaaatgggctctgaagtggctccctgaccccagcagaagaggctggtacatggggccactggactagaatccagattgtctgactctaagtgccaggctagctccagggcacc

SEQ ID NO: 131421 - DNA, 1390 bp, Homo sapiens
ccatttcacaggtaaggaaaccgagtttcagccaagtggcaggaccagcatccggagaacagtggtagatgctgagtcagaaaagacaggaaagagccacaacacatagggcctggaggacttggtagagcaatttggattttgtttagggttcagtggaaagccttcaaaagtttaagcgggagagcgctgcgacctgatccacatttttagatcactgcccagagtggagaaggcaaaagtggagacagggaggccacttgtgaggctgctttggaagttccagtaagagatgagggcagtgcccgtggaggtaaagtagacagattcagagatacgtagagcatctaaagacagccttactgaggattggatgtagatgttggcagagaggggaggaggcatggtttccctgtgggttgctgggtggttgatttaggacatcttcaggaggaacctgttggaggttgtggggaggggagttaggggatccttgcaaacttgtcaggttacagtgacctaggcacgcacttttgcaaagagtcaggttccccaaacatgcgtccttctctggcggagagcaggtcttattctcttgctcctgggcattgactaaatgctttctgtgaactgagtgagctagaatgctgccgctggctctgagaagccctgtattccttctgccaccagggaaccagggagcaagtaatgacccttctcagaatgttgggtctgatacaagaaacaaacaaaaacccccgatgtcctaccttctaatgtttcagactttgtgtatttttttttttttttttttgccagtctccatgggatctttcctctgctcatgtttgaaagtgattctcttttttttttaaatgttgttactcaggccttaaataacctttgtcctatgatggcttctgaaaggatgaagcctaagttagtgcaaaagtaactgcagcttttgccattgaaagtaatggcaaaactgcaattacttttgcaccaacctatagaattataagatcaacaccaacaataggcatttgtagagtgtcattccgttaaaagacctctcttatatacattccatgattttagcctcatgaaaatctaaggtaagataaatggtgtgtttagctctatttgagaggccaaggaacgtagcagccacgagcatgtgaactacaataatagcattaaaacattaaaagagttgagctggataaggtactcagaacagggcctgcaatatgaatgttagctgatgttgttgttattgcgattagcctccagatagagaaactgaggcatgatgaggctgtgatgtccccacgctcagtagtggaatcaatttcaagttgtgttcccagatgccaccctcagaagg

SEQ ID NO: 131422 - DNA, 1052 bp, Homo sapiens
tcccaggatgtgagcaacacgggaccggtgagtaccgtcgcgtttggcagtgtggggcctaggctggatttcaacaagggaaaggagagggatgggaggggcaggggcagctgagctctggcagctctgaaactgtatttccatgcacgtgtgcctggaaacagcacagggcccagaatctaggtgtgagtcccttggaatccactgggttcctgccaatccctccccaggagcactggagcctgcaggtagctggactgtcctccctctgctctgatgatagcagcccagactcaccatccagagggcatgtgctcagaagtgtttccagtaaacctctagccagggctagggagatattcttagaacagagagggagctatctggctcacaccatttaggaaaccatggccccgaggagacagtgctaaagtgaggcaggaaagccacctttgcacatttgaaaaactgtcatgagcagggcagaggtgggcagctgttgactccacctaaggaaacattcctaacagaagagctatgcaagagtgcaataggaaacttgggaagtagagtgagttccctgttgctggcagaattcaagcagaggttggagaaatgtctgtgggacacgtcgaaggggagagtgcaatgttttacagaccctgttccctggtgatctagaatgctgtgagggacaggcagtgggaggagggaggtagtgtagggaaagtctgaatgaaggaagcttttgaactcgtgcctgcaaatgctcagcattgcctccgttttaggtgcaggttctcctgtaaaactgtttggaagccaccagatgaaatgaccctcatgtctctcctacgttgttgcccattggctggctgtacctgagctaatgccagacaatgcacatatcatagacatgagcccaaacacctgctgtatgtggtccagggggcaactctcaaagcataatgagagttttgctcagaggctctggggagcctatctcatgccagaaccaccaaaagagttactggctagtcatgtcatcaagg

SEQ ID NO: 131423 - DNA, 1061 bp, Homo sapiens
tgcacaggctgtatattcagctgagccctgtttgctgtcaggggctggggaaaggagggagaggagaggactgaactgtgacttggcaagtcttttttttttttttggagacagagtctcactctgtcgcccaggctggagtgcagtggcacgatctctgctcactgcaagttccgcctcccaggttcatgccattctcctgcctcagcctcccgagtagctgggactacaggtgcccaccaccacgcccagctaattttttgtatttttagtagagatggggtttcaccatgttagccaggatggtctcgatctcctgacctcatgatccgcccgcctcagccttccaaagtgctgggattacaggcgtgagccaccacgcccggccgacttggcaagtctttaagcaggacttgagctttgaggacaggtactgtgtgcttgcattcatagaacctggcacgtagtaggtgctcagtaaatgattgtcaaatatagtgatgaggaggcagcccagggaggcaatgtctgtggttcagagcatggtccctggagtcagaatgccggattcccatcccagcccttccactagctgtggggcctcaagcatcagtctcctcctaagatagagatagtgatagttcaatttaatgagttaattcacatgaagctgctgggatatagtaagtgctcaataaatattaatccttattcttattctggatgtgagacatgaacccaggttaaggcccaatgatgggacaggaaaaagtagtgtaggttggaggacagagcactgggctgggagtcagaagccctggcatagctgcagggcagggtcaaggaagcaatccccaccggttagcacatcctctaagctggagatgctgtggaaggctgtcaaggtggcactgtttttcctcctggctccctctggtccctcctggttgaaagcggaggtggccctgctatttattcctagctgtgggcctcctggagagtggtgtgacctctcagaacacccctttttcccagtgaatggggacacccttactatcctc

SEQ ID NO: 131424 - DNA, 1001 bp, Homo sapiens
gaacactggaaatactccctacccttgtccctttggaaccttgagatagagatgctcatgaggggctgggcacagtggttcatgcctgtaatcccaacacttcaggaggccaagacaggtagatcacctgaggtcaggagttcgagaccagcctgggcaacatggtgaaatcccatttctactaaaaatacaaaaattagccaggcacagttgtgcacacctgtaatcccagctattcaggaggcagaggcaggaaaatcacttgaacccaggaggctgaggttgcagtgagccaagatcatgccactacactccagcttgggcaacagagtgagactccacctcaaaaaaaaaaaaaaatagagagagtgagagatgctcatgagtgagaacatgccacagtggaagtccaggtaacaccctggacattaccctaaagagcagctaaaacagatgctgcccaatcgcccgatcactttgacaataggaagtcaagttagagaaccctgatttcatgtcccaagaaaccacaggagaaaagaaacccacccagggtttcagtgcagtaaacctgagtgactgagaaagcagtggcatcatctctccaagtcccaacacttgattaacgcccattgacctacgtgactgagtgcctgatgcggatgtgatattgctgacagatcatttgctgggaatgtgagcgtggctgcaggatccgtgcgggagcactcgggccctcctccctcatcctgaggcatcagtacctataaaacccctctaagcaccttgacattggagccttttaactcctggagggaggtcatagtgaagatgagagtctgtattttacagataaccaaactaaggaggtaaagtctgatactaattaaagctctgtttctttgcctttgatcaaaatcttaggttcatatttgtggcccaccatttaccatctgtgagactttgggccaagttattgacttctctgtgcctccatttta

SEQ ID NO: 131425 - DNA, 1085 bp, Homo sapiens
gcaggcgcctgtaatcccagctacttgggaggctgaggcaagagaatagcttgaacctgggaggcagaggttgcagtgagccgagattgcgccactgcactccagcctgggtgacagagcgagactccatttcaaaaaaagaaacatcaaaaatgaaaaaatatatatacatatatacaagtgtatatgtacataacatagatatgttggtgcaaaggtaaagcggtttttgcaattacttttcattgcaaaagtgtgctaaaaattagaaataaccaaagcaaagaaaagaaaatggaaaaccggaggtagtagaaggagcccccggaaaagggcaaggagccgtgtggcctggagctgcctggaattgcagtcctgggccttgggctgagaaaggtttttccaggtggtccctgtcttgcttctcccaccctcgcgccgcccccaccacccccatgtctgagtctcttcctgttggtgttgccaccctctgccgcgcttgccggccagggctcatcaggggacagtgtgcagcatgacccaggctgaccagtgtttgcgttgggctctggccagtcggagagctgtactgcagccagcctcctgccgtgggtggtcctggattacttctctcaccccaggttgttccgagggttccaagccacacagcaggagccccctctctaccccttctccaggggtattccctttttaaaagggactaagaggaccaggcagcagtcatctcattcttcagtggggccaagcaactcgggatccacagagctgcctctgcctctgaaaatgcagacagagcctgcagagttcagagtccagaaacacagaaacggcccttgatttttttttttgtttttctttttttaaaattattttaatggacacataattattgtacatatttatggggcacagagtgatatttctatatatgtatacaatatgtaagaatcaagtcagggtaattagcatattcatcacttcaaacatgtacatttctttccgttaggaagattcaaaatcctctctgctagctattcaaaaatatacaaacaattattggggtt

SEQ ID NO: 131426 - DNA, 1050 bp, Homo sapiens
tgcactgaactgaaatttggcctgtgtaggaatttgtcctgcttagggagagagctaataatggccaagtctcccaggagcattgaatgatttttttgttgttcatctaagggaatcataatcccctgaaacaggatattagaacaggttagagataatgggaagaatggactcaaaattaaaatacttaaaataaatgagcagcaaagcagcttctatctgcactgtgtaatctgctaatgggtatgagtactggggtgatttgggcaaaaggagacttggtacagagtgaaggcgggcaagaacacttgggaagattaattgaaggtataaatttagctttctctcccccaaggaattccccagtggctcgtacaaatccacatgtatttagagagaaggagaaacccctgccatgtcatcacggccagagagacccacagggagtacagaattaaatctaggtgcaaggcgtaaggattgcttgggaaatgtttactgagctcagtgtgtcatttgaagccttaacctgacccagatgaatctgatctctcttttctctgtcagtgtgttggccttttcctgagggcttgcactgatcctctaagtgtccttgttggttaagggcagtcactgttagcttaagggagcctctggattttgatcattaccgacttgatgtagaagtaggctctaaggatgtaacaagatgcctctgtctccacagccaggccctcatttgctgtaagccagttttctcttggaggtgcccagaccccttactggggaggagggattgggacttttcgtgatcacaggcatcaggtagggttttctgactgcaggtacccgaaaaggaccctcgctaagttaagcaaaagataatttgttggaaggatatagaatagctcacagattctaagggcctgctgagaaccctcacatggatgggggaccagggattcaggcagtaggcattgatctcatcacatcccttgctgggctaaaccagcttcgtctttgattctattcttgtatctctccctttta

SEQ ID NO: 131427 - DNA, 3574 bp, Homo sapiens
ctcagctgagagccttttagaaatgctgtgcaaggctcaaacatgcaggctgtggatttggcctttgaaagtgaatgtattttgtatcctttgatccagtttgagccatatttagatataccaagatgctatcagtcattctttggttgctgggcttgtgggtgtaatatttttgtttccatactgttctgcatggattacttttataagcagagaaaaaaacgttcagagtgtgaatttagctgaaatctgaatacatttaagaaacatgaaaaacgaatgccgtctgtggtcaggtcatggggctgagtacagaaaagacaaagttaaataagacgtccctcgctgccttcaacatgacaagtgccatgggaacagcaggagagggaggtgttctcggaggtcagataactatgtggaagtgactttgttctcttctctccgtttgtgtccccgtctttctgcaccaggtaccgctggctgcccagtaggagaggaggagtatcaggatttggtgtgccccctgctagcatgaggcgagctgctgatcagaatggcggaggcgggagacacaactggggccagggctttcgacttggagaccagtgaaggggcggcctcgggcagccgctcctctcaagccacatttcctcccagtgctgggtgcacttaacaactgcgttctggctaacactgttggacctgacccacactgaatgtagtctttcagtacgagacaaagtttcttaaatcccgaagaaaaatataagtgttccacaagtttcacgattctcattcaagtccttactgctgtgaagaacaaataccaactgtgcaaattgcaaaactgactacattttttggtgtcttctcttctcccctttccgtctgaataatgggttttagcgggtcctagtctgctggcattgagctggggctgggtcaccaaacccttcccaaaaggacccttatctctttcttgcacacatgcctctctcccacttttcccaacccccacatttgcaactagaagaggttgcccataaaattgctctgcccttgacaggttctgttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccatgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatcccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttatcctaggaaatgagagttggcaaacaacttctcattttgaatagagtttgtgtgtacctctccatatttaatttatatgataaaataggtggggagagtctgaaccttaactgtcatgttttgttgttcatctgtggccacaataaagtttacttgtaaaattttagaggccattactccaattatgttgcacgtacactcattgtacaggcgtggagactcattgtatgtataagaatattctgacagtgagtgacccggagtctctggtgtaccctcttaccagtcagctgcctgcgagcagtcattttttcctaaaggtttacaagtatttagaactcttcagttcagggcaaaatgttcatgaagttattcctcttaaacatggttaggaagctgatgacgttattgattttgtctggattatgtttctggaataattttaccaaaacaagctatttgagttttgacttgacaaggcaaaacatgacagtggattctctttacaaatggaaaaaaaaaatccttattttgtataaaggacttccctttttgtaaactaatcctttttattggtaaaaattgtaaattaaaatgtgcaacttgaaggttgtctgtgttaagtttccatgtccctgctctgctgtctcttagatatcacataatttgtgtaaccaattatctcttgaagagcatttaggaagtacccagtattttttgctggattaattcctggatgcagaattcctgggttttcattttaatgaaggaggatgcttgctaactttgagtgaggagtcatatctgattgtagcatgctttatggcatttttatagcttctacccatggatctgagccctggaactttataaaattagtttaatcctgtttcctcataaggcacacacagactagatagcaggtgccatgacattcctgagcccttttttttttttttcctcgagggtgaacatcccagtctgtatcttgggccttcgacaggccaacttcactcatcacaaggtgaggtgacaggaagcaggttgtatgtatgtccctcttctattactggggaaatactgaagcaatagaaaaagatcccgcttatttagaaggacacattgccagtatcattgtgttctaagctaccttttgaatgacatggatctaataataggcaatgttgcagttgccaacatcttcgtttattgccaactctgtttctgaggtccctgcccctcttacactttcagcagtaacttaacactctgaataactaacctttgaaagaagttactcctttctggactttatactgtttttttcttagaaggctgggctgagcaaatgggtttactggcagttcacttgtttgccttccagagtgactggtgatcagaattggccaggaataccatgtcctgtgtttacttctttcttaaccctccctcccaccttccctccctgtccc

SEQ ID NO: 131428 - DNA, 2083 bp, Homo sapiens
aatgttcagatacccaatggacttgggaggaagaaattttctatccacacctcagtttttgtaagtgtttttgtcctgtctcatctaacattttactgcctgtgttcttagtgcatcctaatgagagctccatgaggagtatgatttacccctatgccccatctgctggagaaacctgaggcaacaagtgacttaccctagtcacacagtcacaggaagttagggattaaagcttaggctcagttgccttcctgttactcttttagccagggaccactgacaactagattccaacattacaggaggcatctcagctctctgagcctgctgagggacctgatgcaactccagagtgcgaaacagtaggctggtgaatgggcagagtcacaggttagtggggtgtcttttcttggcccatcagtttttacccatgattttgcccaaggaagggtaagttagcgtgttggtcagcaattttaaacatttttatattaaatactatggagtagacattttacaggactgttcagagttaaaatgagagacttgaggtttgtataggcccaaccccctgggagtttgtgctctttatctgcttttagggtttactgaagtgggctggtaagggcaacagctttgatttttgagacaaacttggatttgaatcccagtcccctcagatagcagtttttatactgggaaagttacttaatcaaacctccaagcttcagtttgcaagcctgtaaattgtgggagaagcccctgtctcacaggactgcatgaggtaagatacactgttgggaagcacagtagcgggttctcggtaagtaaagctagctgccatattcctaaaggtgggggtaggagagcaggattttgacgatctgagaggagacgcgcacacacccagaagcatgtaatagtcgtgtgaccgttctgtcagtgaggcaaaaggctgtcgaagaacgggccagttaaatcaccatctgggtgtcacagcctgcctgacaatcatgcctaatctcatatcagggatatgcagtaatagcttgcatttgaaagctttaaaaaaacaaacaaaccaaacccttccacatcttgctaattttaatgttttgcagttctgtcattcctctaagggatcagtgagggcagtaaaacttgagcaggcctcctctttctccccttccttttatagggtaggggtatgtttttcaaagacttttcaaattgtgaactgtaatatacagagatataccatattggtggttgtggtgtgtgtgtttttctttaagagaataaaaagaaacttgtttctcttctgagccttgaattgccttcaggctaaaaaaacaaatgaccaatctggtttctaattatcaaaggacataataacagcaggtttggctttctgatctaggtttatcaagtaggatggcagatgcatcaattaaaaaaagcttggtgcttttggggggcagccaacagttactttactttaaatggccatattctaacttaacggcttgtagctacttctcagttgtgggcaacacaggatacaagattctagtggcaaaatcagcgagccctggagcctgccttccacttgaactttctctgttgggggaagtccttctgctaaattttgcataaagatcagatgacaaaatacagctccttgcaaaagcagtaactgctttgaaattaccataaatttttgttgattatgtataattgggtatctttttatactaattatttgcatttaatttcactatctacttaagcagtggagatggcttccatattgtcttagagtgagtagcaaagcaagacagccctagcattttctccagcaagtgttctattttattatgtactttggaggaatattattgtaccagaaggcatggatgttgagaaaccagcacttggaaaatacattttgatttaatggtaaagctgtatttgtttaaaatggaggaggtgagtataggaaggtataactgcttttctaaatggaatgctgatacatttgtatcaccattttccattccatttagagtagttatatcttctc

SEQ ID NO: 131429 - DNA, 1197 bp, Homo sapiens
cttggatttggtaaggggctcaaatgttgagttcatctggagagctttcttatttgggagagtattagtttaagatatcaatgcataatgagataaaaattcagaggaattttgcaagatatgtaaaagaagaacctaaaaagatggggtatgtttattttatttgtagcaatttgttggctggaatcttagtgtgattctctcatgggccttgcttttagtagcatctgtaggacactcatctgctttttgaagctgtctgtttatagcagttcagcagggcctgtattgcatcagacctgtgggcaaagtactgtgtccttccagttacaaatacacaattaagtctagttttagataggaaggtttaagtatagtgggaataatgctagattgatcctagaaattttgcagtgaccttccagaggatttatataaagcccttgtcagtgtatccttacccactttagtccccgtagtagctgtgtcctcgtcaggtgtggctactcacatttgcatatattcattccatcctaggcctgctatttaccctgggttatccttggattcaactatatcatcggaggctcgtaagtgatattagatttatttaattggaaactaatccttggaaaatttccattagtttttatctttctctaacctttatacaactttaaagaatctcaacattgacgcattagaaccctatatttatggaataatttcacttcgattgaattgattagattgcagggctttaagcatatttaaccttgaatggttgtgattttgttaacttattgttacacacagtatgttcctatgtgtatagtacaggaataaatatgtatttctggattcactattctgattgggcaaacagagacctaatttttgtctgagttggctcctctaagagctatgtataaaattactatgtcttatattcttaaggcatttccagaatgccttggaaactgcctatcggtcatagaaatccagattcttagataggatataattttgcaagtggtttgatgatacagaacttttttttttttttttttgagacgaagtttcacttttgttgcccaggctggagtgcaatggtgcgatcttggctcattgtaacctctgcctcatgggttcaagcaattctcctacctcagcctcccgagtagctgggattacagg

SEQ ID NO: 131430 - DNA, 3261 bp, Homo sapiens
cctctgacagaacttaacggtctagtggaggaggacagggatcaagcatgtaatccagaatgcggccatcaggtcatggcgagagccaagaaggaaaggctgacaggctgggagggagcttggggggcctcactggtctttgggatacagggctcagaagctgtggaattgactgtactttctctgggtctgttttagcctgtggtagtcagagcatgtcacttactggaattcagttaggagagcatagattaaccttactcaggtaactttgattcagggctttattggggacgttgtttagatatttttaaaaattcacttttttagagaggagtggtttttaaaatgttctcattttggctttttctgtaactttttgaagtgtttctctatgtagatgttactttgttgtgaaattctgaaccatgacatttggcttgtttttgtttccaggagcttttgatgggaggccagcagactatttattcatgctcctctttaactggatttgcatcgtggtatccttcagtctgtgattttgggccagaaataaaccagtttttttccaggtttggggaaatagaccatattctgtaaacgtttcaaattacaatatttgcatcttggttgactaccgttaataagaataattatagttttttaaaaaaaactgtagtaaatcatatagcccttgagtgatgcattctcttaccatttgtgggatttttttccacctttggttgagtagttttatgactgttccctcttcttgttcccagttctctgtgttctcatgtgtgacagcttgttgactgaggcacaaagagagtccgtgccatgagacagcttttgaaatctgtggtccttatcagaaaattaatttacaaccagcatccttttctgacttcattgctgtccttctcttggggtcctacatagtaattcagtccctctgtgaagtacccagctctgggaagggacacagtacgtttctctgctttgtatcaatagcagttgtcagcagccctccaactgcaggactcttacagatggtgagagcagcagcagctctcgatgtctcaggtcctgtgcaaaattggtgagctcaaaattgcctttgggctcagctgccatttaaacttggctgagggccagaaaatgtggcactgtggatgccctttcccccctcctttgagggaaggaaaaaatattttggactttaaccatgctatagagtcctgagaatgtaagtagaatgattatttccttcaaaggctacaggcatcttcatcctttatttgaaggagagatgttaaaatgcaatagcagagaaaaaggatgccagatgaccagactaagtcatatgcggaagctgttgatttctactatgtccttgtcatggtatcgtctaatggaatatgcataatgaagattagatacctttgtgttgtagaatgttttaagcaatctgaactatagaaaagtattttccttcagaacactggaattaacttaaaaatttttttaattaaaaaaatatgtatataaattagagatggggtcttgctatgttgcccaggctggtctggagctcctggcctcaagcagtcctcccatcttggccttccaaagtacagagattacaagcatgagccaaattacacctggccaagtgaacttttaaatgggaggaaaataaccacatcagtcttgactaggtacagaatgcttttttatgtctgatctttaactttacaaaccaagattactggcttagcaatggatatgcaggtaagtgtccatttaaactatctatttgcccttttatttgtttcaaatatactattagtggcctttgtcagaagttgaaattgcattaactatggggttaattatgtggtattttgaaattatggaattacagctgttttatttatttatttatttatgagatggagtcttgctgtgttgctcaggctggagtgcagtggcttgatcttggctcactgcaacctccgcctcccgggttcaagtgattttcctgcctcagcttcccgtgtagctgggattatagatgcacgccaccacacccggctaatttttgtatttttagtagagatggggtttcaccatgtcaccaggctggtcttgaactcctgacctcatgatccgcctgcctcggcctcccaaagtgctgggattacaggcatgagccaccgtgcctggcctatagctgttttattttgaggatcttaagtcagctaaatctttgaagatcttacatgagctatctaaatcattgctttccttgctcatttctggcctctttttggtgtttgaacattgacaataatggttgtctagtattttctaggcatgtgacaacagtggttgtctagtattttctaggcatgtatatggatgttttttaaaaattgagattatatggtaatgctttgttgcttactttttgtaaataacagagcttgactcttacatttctgaatccatctaaaataatatagttttgttgtattttattataggattttgtaatatttattgtatgataaataataggatcaatttataattctgatcagttgagtttccctttacccaggtgaggattgttgtgaagaggaggggtaaaaagcatagtagatgtacaccttttttaagtgcctctggagcctggtttttacatgtcgacttcttttgcagttgctgatgattcctctgatcatgtcagtactttatgtctgggcccagctgaacagagacatgattgtatcattttggtttggaacacgatttaaggtactttgccttggttggaaaagtgtccttttcatttgtctgcagaaatccctcttcagtccagagatgtactttctgactcatccagaaggggtcactgcagagcagtgtaccataggcaagcccctttctgccctcctcaatcccagctctatttaattagccagcctggagtccgttgctggcctttgtttcttcactccctctgtacctcgggcccctcaaggttatgtccctgagtgatcttatgtgtctgtgttagagagaaggagagataactcatgtgaaaccctgctttaaaaatctgttcttatccctccctcgttccctgttatttgctttatactgtagctgaaacagattgtttttgcccccaaacacttctctttgtacattctttcacaattttccacctgtaacatcttgattctcttcttt

SEQ ID NO: 131431 - DNA, 1188 bp, Homo sapiens
ggggttcaagtgatcttcccaccttagcctccctagtagctacaaggatgggtgttaaaccgccacacctggctgacttttgtattttttgtagagatggggtttcaccatgttgcccagcctggtcttgaactcctgggctcaagagatttgcccaccttgacctcccaaagtgctgggattacaggcgtgagccactgtgcccagctggagtaattattttatattgatagtaaacgttatatcaatagtaaaatagattaagtgtggatcatttatgatcagttatttaaaattttattctggaaaattttcaaacatatgcaaaagtggagggaaaagtcaatgaaccttttttctttttactgagaccaaattcacataacataaaattcatcattttaaccattttaaggtgtacaattcagtggtctttagtatattcacaatgttatgcagccatcaccacaatctaattccagaacagtttcatcattccctaaaaaagccaaagcagtcactctttacctcccactttccctcctcccagcctttggcaaccactaatctactttccgtgtatatggatttacctattcaggacatttcatatgtcctttggtgactggcttctttcactttgcacaatgtttttaaggttcattcctgtcatagtgtgtgtcagtacgaacccctccttaaccatctaatggttatcacctctaatagttatctcatagccaatcttgttttatttatatctattgctgtcctccacccctgattatttgaagcaaaatgccaggcatttcatttgtaaatatttcagaatttaactctgaactataaggacttaaaacataattctaatgctattattaaacctaaattgcaataattccatggccacttttttttttttttttttttgagatacagtttcactctgtcacccagtcgggggagtgcagtagcgtgatctcagctcactgcaacctctgcctcctgggttcaagtgattcttgtgcctcaggctcccgagtagctgggattacaggtgcatgccaccacatctggctaatttttgtgtttttggtagagatggcatttcgccatgttggccaggctggtctcaaactcctgaccttaggtaatccacctgcctcagcctcccaaagtgctgggatt

SEQ ID NO: 131432 - DNA, 1001 bp, Homo sapiens
atttttggacaaggtttgtcattccagaatattctttccctaaatagaggcattactgtactgttggaaattaagcctttgtaattcattttttgatgtaggcttaattgtatgcctgatctcagcaaagactaaccatatactcatatagtattgattttgtttcaacttgtttagaaatatttgttgcttattttatgatgtcgttttattccattgatttgcaaagtgatgtgattgtatttggtgtgaacacttttcttcagttgttttcttgagttgtgttggtaggatcactttcacacctctcattgaggaggatgctttgttaattttgtttagttagaagggaaagaaataaccaggcttacagaaactaacagctgtgtttattttgatctggacagatttggaggccaatcactgccaccttttatttccctgtgggtccaggaactggatttctttatttggtcaatttatatttcttatatcagtattctacgcgacttgaaacaggtatgttacccatagttgttttaagcattgtttctttctcatttactaatccatgtgtttactttggaggaatttggagggcagttagcattacaaaaagaaactgcataaagatagtaaatgcttagtgactgtgccaggactgcaccaggcacttagcttactcaatttttaatcctcacaacatcctgaggtataagtagcagtgttaccattttatagatgcaaaaagtagcagatcagaggttgacatggcttgtccatctccttagtggctgagctgtgtgcctttcatttattttgagggtctcactcatttcttttgcagcagtccttgtccttcagtgcagaattgggctggagtatatatgtctcctagattggggttgaaaaacatcaatttatgtaattaaaagcctagatttattctctaattgaaaaactcaactctaaaatacagtatatagccaagatttaataat

SEQ ID NO: 131433 - DNA, 1227 bp, Homo sapiens
cacttcgtttgccttcgtcccctttaaataccctccaggtggacccagccgcattaaaactctgagaactaggtgaatggcatttggcctcgccactggccggagcgtttgccgttgatccaggcaaccactgttttcccaccagtcgtgtagtcgctctacctggctccgccccccaggacgccgagcctcggccgggcggtaaaatcggcgcttaccctttaagcggcgggacttctggtcacgtcgtccgcggtcgccggaaggggaagtttcgcctcagaaggctgcctcgctggtccgaattcggtggcgccacgtccgcccgtctccgccttctgcatcgcggcttcggcggcttccacctagacacctaacagtcgcggagccggccgcgtcgtgagggggtcggcacggggagtcgggcggtcttgtgcatcttggctacctgtgggtcgaagatgtcggacatcggagactggttcaggagcatcccggcgatcacgcgctattggttcgccgccaccgtcgccgtgcccttggtcggcaaactcggcctcatcagcccggcctacctcttcctctggcccgaagccttcctttatcgctttcaggtacttaccggagacggggggcgtggagactacaggccccaggaggcccagcggcggctaagcgtaggctggcatgttgcgggcgcgcggtgcctgctgggatttgtagtgggtccggcgccggcggtttagggcggggtcctttgggcccggggaggctctgggatctggagcggggtgctggatagctggagttgtgggctggcctggtggggaggggttgacttcactggtatagtgagattgtgcttcccgctcttcgcactcagtgaaggaagcagtgagattagtcgttggtagttgtcaatctgttggacgctggcgattaggtccgcctggagcattgccctctgacctccctctgtcacccacgtgggtggcctgtaggtgtcaacttcaccaacttatagctgagttcctttcacgtttatggagtttttttgttttggttttcctataggagtgatttaaagtcagagatacaaagaacgagtgtattgttctgcatttccctctagacctaatttagtgtcccccacgtagtaatagaatgtacgaaggaatgggcaaagagtacatttgtccagaaatggaaggccttgttattttctta

SEQ ID NO: 131434 - DNA, 2262 bp, Homo sapiens
ttttcatttaagtttaatcattacatatgtgtctccagaataagattgaaaaataagctcccttactgttttatatggcagtatgattaatgtgggttttaaagaatgatttcttaaagcatttgttcattcagcaggcatattttgagtgtcttttgtgtgttgtaggccaggtgctggggtacagtaatgagcaagcagtggtcctgtccttacagaactcgcctgccagggtattcatggtagatacattagaaatggaagtaaaactcatgcacgcgtaattcactgtgaaacattccatacacaaaaacaaaatctcataccctgttgttatcacttaatcacagtttataaatctgtttatatgtgtgtttatttttttaatatctgtccttactactaaattgtaagtgccatgaaagcagggaccatatcaattattcttagcacctggcttgttctgtgtctgacacagtgagttttcaagtatttgatgaatgaataaacagtagctattttgataatgagtagcttctgacctgtttttctgaaatcctggtaagattgattctagaggagcgggggtatagcggtagcagtaggagagggaagaatgaacagacgaaatgctttacttgccatatttttcataatatcaagtaatacgtgacatagattcaatgtttgggtttttttctttgacagaattatagtgaacattattcacaacacttccgattaccatccaaaagttttgcgatttttgaatgtggcttttgatggcacaggcgactgcttaattgctggggaccaccaaggaaatatttatgtttttgacttacatggaaacaggtaagcagataccattgatatctacgttctttaacaagttattaattcactgactgttttcgtacctgctattcattattcattcagaaagatttattaagttctattatatttcaggtaccttgcaaaatactgtcataagtgctaaaggacgaaagtgggaaaaaacagaatgataacatggttcacattttaaagaattaaagtgctggttttaatagtatctctagtagtttccttttttttttcttaaatttaaaaatttattattgctaatttttttttttttcttcagacggagccttgttctgtcgcccaggctggagtgcagtgggatgatctcagcttactgcaaactccgcctcccaggttccagctaccgcacccagcccatagttgctagtttgtcaatttctggtacatcatgaggcaatgtagaaataacacagttttctttgcacattgttgttgtggggtgccagatctaagaattttaaagaattgattttcagctgggtgtggtgactcaggcctgtgatccagaaatttgggaggccaaggcgggcggatcgcttgaggtcaggagttcgagaccagcttggccaacgtggtgaaacactgtctctactaaaatacaaaaattagctgggtgtggaggtgcacgcctgtaatcctggctatttgggaggctgagacaagagaatcacttgaacccaggaggtggaggtttcagtgagccgagatcgtgccactgccactgcactctagcctgggcgacaaagcaagactccatctcaaaaaaaaaaagttggttttcactcttcttcctcttctcttcccttgtgaaacaatttagtccgaaagcaattaggtgggattgatggagataggtattcatgcagcggggctaagagggaaggacagctgcagcagcctagcagagaggcagagggtgtctgcatagcgaatggggcagtgatgggaagctagtttaatacagggggctttgatcaactaaatatattagggataatgagggccaagtttctcactcttagaaaagagacttacatatatggagggcagaaaactagaataaaccccatggtattgtattggaattagatatatcagtttgaacccctggttttgaatatatagagatagatatagcactaaatagaggtatgtacacatatatgtacacattccctagcttcgtacacccagagggcctgggagcaacagcatgccagcagcaatgaatatacccggtgttgagttcttgttttcaaaataccactttctactaaaaagaatcaaggatatttgcaaaaatggccaatttcagaatgcagacagggaaagtacaggatgagcctgtaacattttgtagccagaaagaag

SEQ ID NO: 131435 - DNA, 1599 bp, Homo sapiens
aatttttaattgattaaatattgaaatactaatgttttagacacatattgagttcataaagtatattagtctgttctcatgctaataaagacatacccgagactgggtaatttataaagaaaaagaggtttaatggactctctgttccatgtagctggggaggcctcacaatcatggcagaacgcaaaggtacttcttacgtagtggtggcaagagagaaatgaagaccaagggaaaggggtttccccgtataaaaccatcagatctcatgagatttattcactaccatgagaacagtgtgggggaaactgcccccgtgattcaattatctcccactgggcccctcccacaacatgtgggaattatgggagccacaattcaagatgagatttgggtggggacagagccaaagcgtatcatatattatcaagattaattttacctgtttcttcttacttttctaatatggctcctagaaaaatttaaattacgtatgtagcccacgttgtatttctttcagacagcatgactctagatgagtttcacaagggccttaaacaacatgtttaaaagcaggtttattatttcctacccccaaacttattcctcttttgcctaagttcaaaagcttaattttttgtaaattaaactccagctaggtgcccagtactctactgagcactcaacatgtattctttcatttagtcatcacaacagccctgtatctattcttatcttcattttacgcaagatcgggtcctgattccctcttcttcactccatgttgaatccataccgaacctctgcttggcttctgaaacctctcctatttatgctcccatatctctggctgagattttctgtagtaactttcttagtgatctcctttattccttgtccctctatccatttgccattgctgccaggatcgtcttcctaaaacacatacctgattgtgattctgctgtgctaacacttacagtggtttcctattctgataacatccaaactccttaatatggcacatagcacccttcataatctatttttggcctaaaatggtagctcatttttctgggtttcattttcttcgtctctacggactccttccacatggaatttgtaattattggaagaatttgtgatactaatgcaatgatctcttaataggttcaatcttgttcagcgaacagcacaagcttgcacagctctggcctttaatcttcgtaggaaatctgaattccttgtggcattagctgattattctattaaatgttttgatacaggtaagaagttctcctatttttcttttgaagcagagtaaaatataaactgaagaactgcaagaactttatcactctgtacagcttgagggggcagtccccatgacagccctcccttcagacactaggtgcaagctgagggtcctagaaacagcctcactttagatcagttgactacaaagtcagggtttcctgactactgtcaggtttgataatttactagaacaactcacagaactcaggaaagcactacacttaatgacagttttaatataacaaaaggatacaaagtataactagccaaaggaagagaaac

SEQ ID NO: 131436 - DNA, 1066 bp, Homo sapiens
aatattaggtgaaattttttaaactgtcatttagaattttgtgacttgcctagtcattatagtgtacctagttttcgtttgaagggttttttttttagttaataataatttatgaaataatcagtattactccttgtcatatattagaaatgtattttccccagcttaagaaaataatattttaataaagaaaaatagactacttgtataattttaaatttaaagtctctatgtgaaccttatgtgaaaactaactttctctattcctccttaggttttctttctaccattaagtaataccatcctcagctgttttaaagataattccatttttgcctgggaatgtgacacacttttttgcaaatatcaattgccagctccacctgaaagctctagtatattatacaaagtgtttgctgtaaccaggtaatgtgcattttaagacactaggaatatttaagaaatttaatttctggtaaaaaattacaaattttcatttagtttttattcagtatctttttgtcatattagaaaaagttaccttcaaatttagatatgatctgctaactttttttattttgcaaaatatcaaatatacacaaaaatagaaaaatacatgaacccctaagaatttcttctttttttttgtttgtgtgtgtgtgttgttttatttataccagcctttcctccatcagaaccactaaatatttccataagctacaataatcatcaacgaatggccatttcttttcttttcttttttttttaaatggagtctcactctgtcacccagactggagtgtagtggcatgatctcagctcactgcaacctctgtctcccgggttcacgcgattcttctgcctcagcctcccgagtagctgggattataggcacgtgccaccatactggctaatttttgtatttttagtagagacagggtttcaccatgttggtcaggctggtctcgaactcctgaccttgtgatccgcccgcctcggcctcccagagtgctgggattacaggcatgagccaccgtgcccggccatttctatttttatcaataac

SEQ ID NO: 131437 - DNA, 1046 bp, Homo sapiens
aattcctctcttttctcacgctgttcttctaagtcatcagtaaataccatcaactcaaccaaaccatatagcaaattggtcaatttgtttttattcattgctgtggttattaccctaatccaagctaccctagcctcttttagactactataatagccttcttatttgttctccctgttttcaatctcatttcctatagtcattctctacacagcagataaagtggtttttataaatcagtaagtcagatcatgtcactttcctatttaacctccttcatcacttagagtaaaattcaaccccccacccctcatttcccctgaggccttctgtcacctggcctacgcctccctcgcttcatctcatttccttccttagtctgctctagccacatccgagtatagcagtgtactttcatatggcaatgcacttgagtatgacctcttacttacttttccttatatactaaccttattgctttttcagcacttttgtaccagccagtctggaatactgatcaggatagaattcttcctccaagtcatcccatgactggcctatttgtgtcattcaggtagcagatcttcctcctttcccagctttcatcaccttattttatagttctatatagaacttatcacctgctgagatcaagttcatttatttgtttgtttgccttcctctagaccagaagtcctgtaagagcaggattacttggcttgtgcagccttaactgactgtgtccatggcttctgggaccatacctggcttatagcagacacttgaaacataaccatagtattaccacactttttaaaaattagtaagtcctttacaagttcttgttgaatgagtgagcaacggccttgcaagtcaaaacaacttactctttttgtatcttattaaggtagctttctttgagcaggaaaaaagtttgggctgttttgtttttttcatatagccatgtaccaccaattctatatagctgtacgtgaaatatagaaagttggatagtgataagtgactttgagattatgctataaaat

SEQ ID NO: 131438 - DNA, 1010 bp, Homo sapiens
acatcaggagttcgagagcagcctggccaacatggtgaaaccccatccctattgaaaatacaaaaattagccgggcctggtgacacatgcctgtaatcccagctactcagcagggtgaggctggagaattgcttgaacccagggggcggaggttgcagtgagtggagatcgtgccactgcactccagcctgggcaacaagagtaaaattccatctcaaaacaataataataataataataataaaataaaatatataatatctcactgagaatagaatttcctctaggtgtccctctcaaaatatatatatttatacacacatacacacatatacacacacacatacatacacaaacgttgcatacacgtaaagacgtgtatatagtaggactttcagacattgactatcacatgtttttaggaatttatattttttctctcttaggttcttggagtactaagtcaagatggtattatgagatttatcaatatgcagacttgtaaacttctctttgagattgggagcctcgatgaaggaattagctcatcagcaattagcccacatggacggtacattgcatctattatggaaaatggaagtctaaacatatattcagttcaggctttaacacaagaaataaataaggtatgtatgatgaagtaatcaacatcagctttttataaacacttatatattatatcatcaagaataaaatctttatgctactatttctaacttacctggaacttatccatttttctggatatattttgttgctcttactcccaaagccacatctctggccttgatttctcacgtatgctccattcttaaattgctgccttcctgagggacatctccgtttgatgtctctcatttaggtgttactcattatctcgttcccaaaagagttctttctgcaattctctctcatgttttcttcccatctcataggctagaaaccttgaagttctatgacttcctatgcctttattttctaaatccagt

SEQ ID NO: 131439 - DNA, 1016 bp, Homo sapiens
cagctctcatagtgtaaacaagtatcctttttgtgatctacttaataccatttatttttttgcattttgaagctttttgttaagattctactgcttaaagtggtccccaagcgtagcgctgaagcgctatttattgtttctaaatacaggaaggctgtggcttaccttacagagaaaatacatgtgttaaataaactcattcaggaatgagttatagtgctaagctgtgagttcaatgataaggaatcagcaatgtgtattaaataagatgtctttaaacagaaacacacatatatgtattgattgattaatgaggctctcaggaacctgactctgtgtttcccctaggagcagtgtttcagtattcactaatcgagtgttcatggtgactttatagaaccactgcaaatagtgagaattaactatacatatatgtttctgtgtgtacgcacatgtgtgtgtatgcatacttgtctctaaacatatgggattatactctgctgctgttttgctctttatgtcattatgtatactatataagtatatttttacattataatatgtgctatatattaataaatttttttaaatgtattaatatctgctcttactgagagagttttcagcctgctgaatagtcagttttacagtactagctaaaccttcttttctttttttttttgagatggagtctcactctgtcttccaggctggagtgcagtggtgtgatcttggctcactgcagcctccgcctcccgagttcaaacaattctcctgcctcagcctccctagcagctgggattacaggcgcgtgccaccacgcccagctaatttttgtacttttagtagagatggtgtttcaccatgttggccaggctgctcttgaactcctgaccttggtgatccacccgccttggcctcccaaagtgctgggattacaggcatgagccaccgtgtccagccttgcaaaccttcttaatagaggcaggcagagagctgagaaaaactatggtaag

SEQ ID NO: 131440 - DNA, 1086 bp, Homo sapiens
tatgatcaagtcacagcagtgatagagctaagattaagcccaggttccagagccgaagactttttttaaaaataatttttattatgaaaaatttcaagcataaataaaaaataatgtaacaaatatccccatgcccatcacccagcttcaacaattgccaactcatagccaatcacgttgggtgaatattcccactcactctacaccccacatcccaacatacacacactccccttgctaaatatatacatatgtatccctaaaggataaggactctttttctttaacataagtacactatcatactgacacacaaaaaagaattaataattcttcagtatgttcaaatattcaatcagcattcctctgattgtcttaaaaattttcttatgtaaacttgttcaaatcagggttcaaacaacatgtacacattacatttggttgataccccactgagattaatctatagactctgatacctctttttttcttacaatttatttgttggagaaaccagatcgtttaacccatacagccctctatgttctgggttttgctgattttatttcatagtattgtttaacatgtttctctatctcctgaatttactataaactggcagttagagctaggggcttgatctgagtcaaggttttttttttcccccctttggtatttgtttctttcacttgcaagaaaacttcctaggtggttttatgtacttgttaggcggattataattaatacctggctgtctctcttttcgtgatgttgtccattgatgattattgcctacatccattatttcaccagagattagcaaaacagtgataatataattctgttccttctcattttataaaccgggaaatttctccaaagaaaaagttcttaggatcaactacttggttaccggaagatacaacccatgtaggaaaaggcaagttaaatgcttggtatctttttttttaaacagttttcagaatagtaaacttattaccttggagctccccagagcaatcagtgtattgattatgaactcagattgaacatatagaccttttcagtacatagaaccaggagttc

SEQ ID NO: 131441 - DNA, 1005 bp, Homo sapiens
agagtgaagtctctcatcagatgccgaaggaattaaaagaggagagtacattacttcaaaaatgatgattttgtgcattcttctgaaataataaatttcctgagttcagaggacaaggtagaaaacattttctccttctgttgaccccctcactgtagggaatgaagaactgattttatcaataagtaaaagttactcaagtaactgtttaaggtatctaaaatttcttataatttttccgtatcctaggattttagactttctaaattatgaatgcttttcttgggtacttgttgatgcttcttccttatccccagtagtacaacttaaaaacagaatattttaggattttttcactctttcattaagttctgttcacattcacattaagagcaaataatactgctctgctttttgggaaagagtgaggtaacacttttaatatcatagtgtaagctataaatttgattaaaaattcaaattatcagagaaataattttgatgttttctacctaaatacagtgtatacatggggaccttcttgagatgtattttccaaaagatcttcctaaagtgacaagaggttgctcatatcatttgaagtttctcataaaatgtaataagctgttacgctttatatacttatatgcctactagtacatttacaattaaagttaccattgtaactaattctgtgtaggtgtactttaaattataatcctagtttagttaaagcttcaaagcaattttttttgttggttctgaaatttctgtttttctaaatttttaaatttaaattttacatttctgtttctactaaaattcaaaattgtaacttaaaagggagggattattctacattaaaagagatagagatttaagggcgataaccaaattcaatgagtgagccttttttttctgctacaaaaatggatcaatgaatgagtcttgtttagacaattggggaaatttgagtcttgcctgattatgaaacaatactacaaa

SEQ ID NO: 131442 - DNA, 1485 bp, Homo sapiens
atttgaggagattggcatgctaatgttgattacatttaatgaagggttaaataggggccctttttaaaaagatcatttcgttaatcaggtgatgaacaaagcaggagtcaggagccagaatgccatcaggagtactttgggaagttgtgattgtttgttttaattaacactttttcattgactactgtaaggaaatttgcaaaatttctgtaaacatactatgttaacatgataggattttaaaatcgattgtcatacaatataaagagtttttttttattattcatggacatattgagaacataaagattggatacatttaagaattgcaaagagttttgataacatggaaagatatttaaagatatgttttcttttttttccttcatagtcaattggtgtcaacactggtttgaatattttcctaatcctcctatcaatattcttagcatgatagaaaatgttttggcatttcatgacaaggaactgctgcaacacttcatagatcatgatataacctcccaggtaagaagcataaggtttttagaataacatgccttattttgtaagctaacattggttctggtataaacagtcttttcttgaaggagtataataaaaagcatactacatgttgtatttttaacagtattccattctttttcttcattaaactgccttcctgaaagtctgtaaagaagggtccaaattaaggtagttattttcataattatgtatttaatatgattttcatagcttaaatcgaatgtaagggaatattaccaatgactccctttttacttttccctagaaaaataataaatttttccttatctgttttagctatatgcatggcctcttcttgaaactgtgttctcagaagtgctgacaagagaggagtggctgaaattgttcgataatatcttttccaaccatccttccttccttctgatgactgttgtagcctacaacatatgttctagaacgcctctgctcagctgtaatcttaaagatgactttgaggtaacggtccttgttcttaagagaaggttctcaaatatcagttatttctctctattttttttttaattttttgagacagagtctcgctatgttgcccaggctggagtgcaatggcgcgatctcagctcactgcaacctccgcctcccaagttcaagcgattctcctgcctcagcctcctgagtagctgggattacaggtgcgcaccatcatgcccagctaatttttgtatttttagtagagatggggtttcaccatgctgtcagggtggtctcaaactcctgacctcgtgatccacccacctcggcctcccaaagtgctgggattataggcgtgagccacagtgccaggccatatcagttatttcaattgaaaaatccatttatttattgagtccctgttatatgtcagacactggtgctaggtagtaggaatataaaggataacaagttagaccacatccc

SEQ ID NO: 131443 - DNA, 1011 bp, Homo sapiens
attttcaaaggctaatttataatttattttggattttgaagaaaaaaaaaatccaagcagagtttgttccattgttgaagcattctttttctattgtaagaaaagccttcattttttaattttatgtcagaatttcttatgattgtgaaactcttacattttttaaataaattgtctttgttgtaaaacttgagtaaagaaaagctttaatgaatttgcaaaaaaatatatattcttaaagatagatacactttttttaaattcttgttttaattctacctcataattgctttgtcaggtaaatctcgatttaaacaccaagttttcttacagtttttttttcaccatcggaataacctggatataaatgttgtgattagacaagtttatcatctcatggagaccacgcctactgacattcatccagacagcatgcttaatgtttttgttgcactgacaaaagggcagtatccagtatttaatcaatatccaaagtttattgtggactatcaaacacaggaacgagaaagaataaggaatgatgaattggattacttaagagagaggtaattatggaatagtttttctttttctgatacaatgaaatatgttataaacataagaaagttttaatgaaaaatacatttggctgagcgcggtggctcacgcctatagtcccagcactttgggaggccaaggcaggtagatcacaaggtcaggagttcgagaccagcctggccaacatggtgaaaccccgtctctactaaagatacaaaaaattagccaggcatggtggcacgcccctgtagtcccagctactcaggaagctgaggcaggagaatcacttgaacccaggaggaggaggttgcagtgagcggagatcatgccattgcactccagcctgggcgacagagtgagacttcatctcaaaaaaaaaaaaatgcatttaaattatgagtatttgtgtaaaatcagagtttgaaggctagaaatattaaagatagttaattc

SEQ ID NO: 131444 - DNA, 1048 bp, Homo sapiens
catagtgagaccctgtctcttaaaaaataaaaagaaaaaacttaaaaataaatacataaaagtatgttaataaggtaaaatgtgtaaattaagtaaagtaatgggataaacattgagactaagcccaatagttgggaaactcacttctgtgtttattgattcctattcttagatggaactttatgtaacagatttatagtgtgggttaaaaggaattactgaactgagccagtgagctttctactaaaattcttaaagcataagtatacatcatctttggtaacggtggagcagttctcgcattcttctttcaaataaaggatatcaattgtattgaaatgatcagcatggcagacctgttatgaaaaaactaaatcatattaggaattgctgtatttgttccacttgatgtattttgtatttaaggctagctgctgtgaaaagagagctgaaagtaaaggaaatgcacttacaagatgctgcaagaaggcgttttctgaagcttcagcaagatcaacaggaaatggaactaagaagactggatgatgaaattgggagaaaggtttattattcttaacttagttctcatacatcatctccatttactctcacttaaatgtaatgaacaccttcaaattaaataatattcttagagtccaccatgaatactaaatagccgctttaattttatttacttttcccctcagctttctcattctcttttgtatttcatgaatggctaaatatttaagaaatgccaggaaaattagtcaagtgtccttggtgactatttctctaaaactagaaatatcagtatcagttagccattaagttattttttcttttcttttcttttttttttttttttgagacagagtcttgctctgttgcccaggctggagtgcagtggcgtgacctcagctcagtgcaacctccgcctcccgggttcaagtgattctcctgcctcagcctcccaagtagctgggattacaggtgcacgccaccacacccagctaatttttgtatttttcttagagacgggatttca

SEQ ID NO: 131445 - DNA, 2672 bp, Homo sapiens
ctcagctaggcagtttatactttctagattccgcttcctggttatgcaaaacctcagagttgaccagaagtgtgagatcttaggtctttctgtggtctgagaacacagcccgtagcatatacacagccttacacatgcacatgaccttccaggaacctatcagcttttttaagcctcctgtggacatctgattctccagtttttcctgttaagctttttacttagcctattggttgctcttctaagatctactgccccaagtagccaagatactcaacagtttgctctaattgttttcagcaacttccccagggataaggctattctgcactaggtgagctctgagtgagatcaaaaaagacagccttaggagtggtctttcagggaccaccagacaggtcaaacagtgacagttctccagcaatggtggtttgaaggatctccgtccaacccccttttgcttggcttccttccttggcttccaggctgctggttttcaagactaatgtataggctggacatggtggctcacacctgtaatcctagcattttgggaggccgaggcaggccgatcacatgaggtcaggagttcaagaccagcctagccaacatggtgaaaccctgtctctactaaaaatacaaaaaagttaaccaggtgtggtggcatgcacctgtaatcccagctacttgggaggctgaggcaggagaatcacttgaacccgggaggtggaggttgcagtgagctgagattgtgccactgcactccagcctgggtgacacagtgagactctgtctcaaaaaataaaaagactaatgcatagcttgggagtggggtgggaacaggaaaaatgcaagatgaaatgtcagagagctagctgttcttaccaagattcagccatttttataagtaaatgctccccagatagctccaagcctttggttaatttccagaatgctgaagaagttcattttgacatttttttttatcagtgttctcaatgcttttatggatgagaggatttccaggggtccttactctgccatttttgctgatgtctccagtcgttgaattttactttgaaaattagatgattacagcttttatttgtgtgcatattactattctgaaaaaagtcatttttgtattctagcgttatataaattagtgatttttttttacaaatgattttaacagaatcttactgaaaatcaagaagctcttgcaaaagaaatgcgagcagatgcagatgcctatagacgaaaagtggatcttgaagaacacatgtttcataagctgatagaagcaggtgaaacccagagccagaaaactcagaaggtaaaaatatgatccatttagtatacatgcagaggagaaattttcatctgtcaccctcttaagagaacaaaatcgaaattaaactctgtgaagttgagttagtttgtttctttgcttcagttgtcacagttcctagaatctcacattgcttccttttatatatgggatgcttacttcactgacaatcacatgatatgcatgtctttttcctacagtttgaggaaatacaaaggaatagtgacttacaagaaaatacaaaggagtagtgacttagaagaaaatacgaaggaatagtgacttaaaagaaaatgcaaaggaatagtgactttacaaattttactgtccttctgtgttctgcctctgaaattgtccctgtgttgattaggttcaaagcatcaggtccctgcatggtatgtaagccagcacttccaagtgtattgtgtggactattaactattattcaataagatgggggatggtcaaataagtattggaaatgctgtcttaaagtgaggtatttttcacgccaaatttgaggatttaagagaatttccaagatgtatttcagagaatttcttacggagtacactttcagaaatgctgacttaagtgaattgaaatagaacttgagactttcaaagaagagctttctctattatctctttaacaaaatgttaaatgggtatgtgtaccggtctgctcctattccaaaaaccaggaatagtgtaccgtagataccttctgttgtacaacagtctcttaggtgatttcctcaagatattccatttttttttaataggcttgtgtccagtctgttaaaatgggctcttcttcagagtctcctcttcagagtgctgaaaacatggaaattgttgaatcccacccataccctagccgataagttcttaaccttggctgtaaattagagtcacttgaagagctctttttttttttttttttttttttttttttttgtagagatggagtcttactctgttacccaggctggagtgcagtggcacaatctcagctcactgcaacctccacctcctgggttcaagcaattatcctgcctcagcctcctgagtagctgtgactacaggcgcgcgctgccacgcccagctaatttctacctgaagagctttttaaaggtgctggtaccccgctgtccagtgattggtttaattggcttgtggcagggcccagtcatcagcttattttaaacactcccaggtgattctaatatgcagccagagttgtgaacaactgccccagacacttggatacattgaatggttataccttcattttatgtactagtagtttgaccttgttt

SEQ ID NO: 131446 - DNA, 1486 bp, Homo sapiens
attccagtattgtgtaaaatatttttgctaactcacatttttatatgcatctataaattctgtgccagaatatgaattaaaccaaaaatcattcaagagtcagatgaagtatgagagattctcagctactctctattctgacatatcaaatggttatttggcagcaaaatacaaaagcatgaaagttgtatttctttgggaggaaaaacagtttttcagaaattgaagctgactgactatttgaatatgtaactaaatttcagagaagtatatttttaagggcttttaaaaaaaatttcagtgttcactagcccctctaaatcagtaacgctcttacacttggacatgttgtagtattttaatcttgattctggaccttcctgatattagccaatattaaaaagcatttgatttacttatttttatttatttattggaaaggtaatcatggtgtatatttcacagttttatgacttggaatgccttttctcattactattaagcatcattgtgaggaagcttacagttgcacaaactcaaattctctcttaaattaacaagctttgtttctaacttaagattgtttgtatcccaagtatttcaaagcagagaagttctctgttagcattcattcagtccaacaaataattatttggcttgtaaatggaaccacctagggccaggttatatgtaaaatttaggttttagaattgcatttcattatttgtttttacaacacatttatctttaaaataaatgctgtatcaccgctaacatcagaaaactcagcttttctaaattttaaatttcgttttcaagtttctttaaatagaagagcagtagaatgggacaccacgggacagaatcttattaagaaagtgagaaatcttcgccagagactcactgcccgggctcgtcacagatgtcaaacccctcatcttttggctgcatagaatgcatgtcaccttgagacggtcgagagagagacctattttgcaatcagtgacattgatttttagattatttatttaaaattcctataaagatcagccctttgtacagaaaaatgtgtctataaaaattatgtgttatttaattctgatactttttggcttgtaaatggcttcttgaactttttacaataaaaatgttttagaaactgttaaagctgtgttaagctttcaggttgcagggaccagcataaacctcagtaactttagttgataaaggtttatcttaaagatgaatagagaaataaagaacaggaaaccatctcaacagctctatagcctggactgagggagaactcagcagcaggtggagagcgccagcagcgtggagtggcctatatcaccatcttcctgcccacccccgcctctgccagcgggaccccctctttgtcagggaccccaccggacttgtaacatctcatctctgcccagctccttctgccctctgcctgcttcttctggcagcaccgactgct

SEQ ID NO: 131447 - DNA, 1038 bp, Homo sapiens
attagtccttgcggtcaagttgctgtggggtcagcgagatggaagggtcacagaacactgacttcaaaggagcaaatccagagggcctgtgtgagaggagtctgattgggaggctcgttcctttcactccaaattacttatcctttcaatcccttgacttccacaggaagctcttttgaggccggaagctcttttcaggtgttgctctctgaagatttctttgagcagttttagtctttatattttagaaaagatgaatctccaatgtaaagttgggcaattgattccaagtcggaagctttagggattgaaatgatagttctagtgagggtgggtacctgctttttaacctggtgggacttgcagccgactcaatacctgggctttctgaacatttcctcgcggctttcctttatctggaagcgttgggacttttcgccacgcattgagacttttcggtttttcaggcttctgcttcagtttacccaacctcagcaaacatcgtttgctttggagaggaacttaaggactcagcaggaaattgaagataaaatgaaagggttcagcttcaaagaagacactttgctgttgatagctgaggtgagtgtatccctcgggtttatgtgaaacgaagcatcatagatattttccctggctctgatagcattttttataaagcagggccaaatttaatctactgaaggacttgtctccctcctctgtgtgccttttgatcactcagcaatcaccaaggcggcctcttgatcggcattcccctgcagcgtgcgggaccgcaggggctgtgtttcatgtacttgtcagtgcttgttagcacctgcctgcctgaacatcatcaatgcccaataattgtttgtttcagtgctgaataaatgaatgaatgaatgcttacatttgtgtagcagttctattttttttcctccattcatcataacagcttgtgaagttgagtagagctagaattgaggctcagagaacttgtgacttgcctgcggtcagattttcagtgggagagctggt

SEQ ID NO: 131448 - DNA, 1081 bp, Homo sapiens
ctacatggctggggaggcctcacaatcatggcagaaggtgaaggaggagcaaagtcacgtcttacatggcggcaggcaaagagagtgtgtgcaggggaactgccttttatgaaactatcagatctcctgagactaactaccatgagaatagcatgggaaaaacccacccccatgattcagttacctcccaccaggtccctcccacaacatgtgggggttatgggagctgcaatttaagatgagatttgggtggggacacagctaaaccatatcactagaatagtgaaatcttctttaattcatttaaatattcatgtaattcattggtcagttataacattactttccacctaggaaaaaaaatcacccctattctgaatccttttttctgttatgttttcctcctttcatttctttatttaacaaataatttccagaaagcactgcaggagtattccagtatctctgaaaaattgtcatcaaccaattttgccatgaaaagggatgtccaggaaggtcaggctcggtgtctggctcacctgggtaggcatatggaggcgctggagattgctgcaaacttggtgagtgattttattgcttattttcacacacattcctataagggtggtcgaatggtgtattttttgaaaacaaaacaaacttcttgctagtagcaaaatctatgggtttggataagcagaagaaaattgtcaggggtgtgagagttttattatgatgaacaacttggaacctagacataatcattttcttgtaatatttttcttgtgtcatgctcaaaattctgtattgcctgaaaatctcctttgcagaggtttttctcttgttaggagtaacattcagtgtggaaggactatgagtgatctgttttcttcgttagattgtttttagacgttgttctccaaaatttctacaatgaacagtatttttctaagccaaaaaaggtcccccccccaaaatgactaaatactcattaccaagccacacttagtagtcctttttatttttaagtggaatttgcagaatttttttttctttttccttttccccagtcaacgaaagg

SEQ ID NO: 131449 - DNA, 1030 bp, Homo sapiens
tcctagatgggcatttcctcagacttctctcctacaggtttttggtatttggttgcattggagcctccttctagccttaatttctgtctcctttgctgaaattctagttttttgccattatgacattttcataatagcaccatatctataattcttctttcctatgtcctttcagtaaagaattgtcaatccctattccagtcacactaaagtttatctacaagaaagcatgtctcattttaaagaaccaatgtgggctgggtgcggtggctcacacctgtaatcccagcactttgggaggccaaggtgggcagaggcaggatcacttgtgctcaggagttcaagactaacctggccagactcttgaagaagtctttttttgacgtttaatcaattatattatgggaaattgcttctgaatatgaggtggaaaagcatagctcactctgtaataggctattttcatgatttcaagtggttttatgaagaaacagaaagcagtgatgatgttgaagtgctgactctcaagaaattcaaaggagacctggcctacagacgacaagagtatcaggtagaattcaacatatggtgcttgaagtgggctcttgttttatcagttatggcatatgtaaataacagtgtaccaagttagtgtggtgtttatgaagatgagtttaatcttttgtgatgtgtgtttataatctgaggctcccaagtttccgttcttttctgcttggctctgtatgatttgtttgttttctgtaactccaacaaaaggatctctttggggtccttgtccttgtaggtttattcctcaaggttctgaatctcctcattacttaggaccctctagcacagacatttcacagtgccacaggagcaaatcaccccaaaatgtataagaaaaagaactaacaactagatgttagattgcgttacatatgtatctcatttcatctgcatgagaatcctgtttttattttgctgatgaaaaggttataaagtaagttagtggcaataccagaattca

SEQ ID NO: 131450 - DNA, 1849 bp, Homo sapiens
aaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtgaccttttttttttcattttattaacaaagtcaatttttaaaacattgtggtaaaatatatatcacatactatttgccattataccagtttttaagtgtaaattcaatggcattaattatattcacagtgctgcaccaccttcaccacttttccaaaagtttttcatcaccccagacagaaactcggaaccatt

SEQ ID NO: 131451 - DNA, 1088 bp, Homo sapiens
gctctgttattctgtgcagtttttccttaattcccttacatcttctctctggttttatttattttaacaattatttatagagagcttaatatgtaccaggcactattcttactgcttggcaatcctttttcaggttttctccttgttaatattttttaagggataacagatgaaactaaaaatgtacctgttttaataagcagtataaatatcattccaggttatagggtataatgtaatcattttaggttataagaagttaaacagtttcatacagctttatcctgaagtgcagccctccatttcctaatgtcagaaatcttcagagcaggctttcttctgacccagatacataaaatatttttaacaggcattttttttattgctaaacacaagaatgtgcactcagccaagattaaatcaacaaatttgttgctgcagtgaatgttgttgttgtaacctctgcaatgatttttttggggagttgcagtcttccaaaaataatgtgaatttttctgtacagtttagtttgacctttaattttgtatagataattcttatgttatatattaacactgtaatggatactaattctggtcagaaaattcatcctaaaactacagttttcaaaagactgtatgatgtatgctatacatgcactgtattagtccattttcacactgctataaagaacgacctgagactgggtaatttatgaagaaaagaggtttagttgactcacagttttgccggcttaacaagaagcatgactgggaggccccaagaaacttacagtcatggcagaaggcgaaggggaagaaggggaagcaagcacatctcaccatgaccgaacaggagagagagcgaaaggggatgttccacacaactttcaaacaaccagatctcctgagaactcactcactatcatgagaacagccagaggggaagtccacccccatgattcagtcacctcccaccaggctccctcccccgacactccctgattaaaagttatgtatgggcttatacaatttcaaatgtaaaaacagcctatttacatatgttgaaacaataagattttgtggtat

SEQ ID NO: 131452 - DNA, 1050 bp, Homo sapiens
tttcctttggtgtacttttccccttctttttagttttcatttttgaattatttccttaaataggcaaaaaatgaagctttagtgaagggggcattgcaataaaatacattttagttatctttagtatttgtttgtgaatcccctcaacctgcctgccagtctcccttcatagagattgggtaactttccttcaaaacaaagtaaaaaaaacccaattcatatgaaaaataataattaagacattaaactctacataataataataaaactacacatgataatcatttatctcttagctatactagtggtacctagtcttattagggaaaagaaaaactacttcagaaaatatcaaaaatgaagatgactgatacaacaaggtgactgttcaaaatgtatgtggttgatgaacatatacgcagattaaaaattttcttaacttacatttcagtcatctgatttagacagcttccgtttcacatgtcgtggaggttcccaagtgtcactatcatctgtttcttcttcatcctcttcctggtcatcaataacttcatcttcctcctcattttcctcaaataattctatacctaattctgatcttctctgtctttctgcaaaccactctctgacctgctcatagcccatatgtgatttgttaacaagttcatcaaggtcttgctcattaagaaacttgtgcttcaggtaataatccttaagtattgcagttccagttttaaattttatgagtgatggtcccctgtcccagttgttaattcttttgcttcctctaggccgcccacgcggtcttcctcttccccgtcctttgggtctccctctccctcttttcctaagggaagacagaccattcatactacttgaattggcgctctgatagtagtagtaccatttcaagtttccattcttccaagcataacgggtgtccccaaaccaactaactatgtctgttctagcaagcccgctttctttggccaacttgtcatactcttctggtgatggccactgtgtccggacaaatgcactcttaagcat

SEQ ID NO: 131453 - DNA, 1048 bp, Homo sapiens
accctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatggg

SEQ ID NO: 131454 - DNA, 1682 bp, Homo sapiens
atttttttctgattcttatcttattctagatctttgtaactgagctatccagccacttcatataagtgaactataactataatttgtttaaaagatcatagttactcattttaaaacattttaaaatttattttaatgtaggtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcaga

SEQ ID NO: 131455 - DNA, 1415 bp, Homo sapiens
agaaagataaagggtttctttggttcacagttctgcagactgtacaagaagcatggctccagcatctgctgctggtgatggcctcaggcagcttccactcatgacagaagatgatggggaatgcatgtgggcagagatcacatggcaagaaaggaagcaagagagacagtggggaggtgccaggctcttcctaacaaccagctcctgcaggaactggtagagcgagaactcactcattaccacatggacagcaccaaactgttgatgagggatctgaccccatgacccagacacctcctattaggctctgcctccaagattggggatcgaatttcaacatgagatttgaagggatcaaacatccaaattatagcaagctgttattaaaaatgagacacaatatctagagtaaggagaccacagatatggatggtggtgcagggacagaaatgtaacattactctgccatgtacagtatggtaagtactagactagaaaataaacgggaggaaatgggaccaaatgaaagggagaaggtgatctctagtaggggtccccaacccctgtgccatggaccagtaccaatccatgacctgttaggaactgggccgcacagcagaaggtgagaggtaggcaagcaagcattaccacctgaactctgccttctgttagatgagcagcagcattagattctcataggagcacaaccctattgtgactgtgcatgcgagggctctaggttgcgcactccctgtgagaatctaatgccagatctgaggtggaagagtttcatcccaaaaccatctcatcccctcgcaccgcggtatgtggaaaaatggtcttccatgagaccagtccctggtgccaaaaaggttgaggactgctgtcctagagggcacacagatcaacacatcaagtgtcctaacctaaggaagggcctgagtaagggtctgaaagtgcattgaatgtctgtggaatggcagccatttctggtatacctaaagcataaggaaacaggaggaaggaaagtgaggttagactaggttgtgaaagggattatatgtcccacaaggagtttgaactttattccttcaacattaggaacctgtgtcaggagactgatgtgattagatctgctttataacttttggtagcattgtggcaagtgctaagaataatgtttctggtaggccaggcacggtggctcatgcctgtaatcccagcacttttggaggccaaagcggacagatcacctgaggtcaggagttcgagtccagcctggccaacgtggtgaaaccccatctctactaaaactacaaaaattagccaggcgtggtggcaagcgcctgtaatcccagctactcaggaggctaaggtaagagaatcatttgaacccaggaggtagaggtcacagt

SEQ ID NO: 131456 - DNA, 1008 bp, Homo sapiens
gtcaatgagagggaactagtcctgcttcaagcccttggctgaagttcctaaaatagttgccattaatgtgacttgacaaagacaaagccacccaggctcagtgattctctgttctagacttcatagtaccctcctggttccaaagaattggactggtcctgatgtccaccctagttcctgccagagaccaatgtcacataatttagacattattaggggaaacccatattataagaaagtgtgaccctggcaggcgacccgggagttgtctgccacaaaagtttagcagataaaatttgctgacttactctctcatgtccatttgagccaattatttgatacatacggtgaacactcaccttgtgtgcagtttacacacagtatctcattcatacttacaatggccataaaacgcctagtaggtaggttctagtattatttttcttttacaaataaagaaacagatgctgagactgattaagtcattcactcactatcacatataagtggcagaagcaggacttaaatgaggtgtctgtgactcgaaacccatgctcgtaacaaccttccttgaacagacactgtatggctttggcactcagcattccagtatgcgccagtggcaactcctgcaaatgttggtaaccctacacctgagggttttctcatgactcacggtggaggtggtctggaagtggcaaagagttaacacccctgtgagtagcttctggctagacatagatgggagttggtgaataataacccgttcccttggccctttggtgggatatctctgaggtgtgttctacactttatctctaggttctccattagagttgagcacgaggtcccacagcagcaaccggctagaaactgtaccgttgctagcttccttcccttccctttcttatatccccactcccctactcattctttttggcatcacctcccaaatgaaccacttgccctcatatcctttactcagggtccgttttaggggcagcccaa

SEQ ID NO: 131457 - DNA, 1600 bp, Homo sapiens
caggcaggagccaccatgcctggccttattattatttttaataacagatcatttcactagagagtgctaaattttaaaaaaagatattacttacatatgcatattattggtaactacaaaatataaaaatgataaccattagtatatatatagtatttagtatacctactaaagtatactatgtagtatatatataatattgatacctacaaagtgtaaaatactaaactctaactacatcagtaccttgattaatactatttgaatttaacataagatgaatgcaccccagactcatttcaaagttatttaaataatgaagtcctacaggtaaaatctatgtggcagtcttaaatactgaactgaatgtttattttcactatcaaatatatacctgaatattaatattcttaaggttgtttactgaaaaagtaatgaaatgtttctttagcttattccatattgaaacttactatttgctcttcctcccctttatctagaaaatggagcaagaggtagaaaacttcagttgttccagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattccctcgtcttcacttaaaagccagagtgcaagtcatgatttgcgggagggctcttgaaccacttctggctgcaccacaattctgtacttgagtatcacagtcattgtttttgagacaaacatttttataattctaatttgggttaataaagattttaaatatttcttggtttacttttgtaattatatacacaacaaatgtattaataactaccttgttaaacaccttttaatagcacaaggtttttatatttgcaagctgttgatatctttctaaaactgtttaggttatagtctattgatactttttatatacaattttataaatataaatattataattttatattaatggtaccaaaaatacatttcttaaggttaaaagcatgcacttccatgcatacttgcttttggggagagtggggagaagacattctaataatcagtttgtgaaatagcttctgttggaaaccttttgaggggaataaggaatggtcatctaaaatgagagattctggattttaatgcagttcaaagttgagctgtatttttgttgttgatttatctggattttttttaaagccttctaa

SEQ ID NO: 131458 - DNA, 1024 bp, Homo sapiens
ttatgtagtatcttttttagtttcacataataaaattagttaaaatgtacttatactatcataaaatcccctgcaaaaaaactttgcttttctcctgttaatctaaattgaggttagtttttaatttgtttgtagatgcttatggctagacttagaattggcaatcccctcagctctagtttttagaatatgagttactcaaggtcaaggccaggattatagctagacttaagtacatttaaatgtcagagccactgccagaggctgccctgtgtcatcagatggcttggtctaccctctgtcaggcttgtaataattgcccaaaccttctaaattaagtatcttgtctgaggaagtttctctctcacacatattgacactcatattttcttttagaatcttttgaagactgttgttaaaaaaagtcaaaactacaacatatttcagttggaaaatttgtatgcagtaatcagccaatgtatttatcggcatcgcaaggaccatgataaaacatcacttattcaggtaaactcttgagtggaaactttttacaaatgctcttgtggtcacattaatatatcacttatgtaggattgttgaggctttatttaatctgtgtaagaaactgattgtaggaacttaaagaccatctttctatttccaaagttgatgtcccattccataaagatcatttttaatatgtggattatgaattatttctaaatgcaagtgagtttagtatttttccaatctataacttaattagtttgtttgtttatttatttatttatttagagacagggtctctgtcgcccaggctggagtgcagtggtgcgatctcaactcactcactgcagcctccacctccaaggttcaagcgatcctcctgcctcagcctcccaagtagctgggaccacaggcacctgccatcatgcccagctaatttttgtgttttttgtagagatgaggtttcactatgttgcccacgccgatcttgagctcctgagctcaagccatccagcca

SEQ ID NO: 131459 - DNA, 1247 bp, Homo sapiens
caggagatcgagaccatcctggctaacaggttgaaaccccgtctctactaaaaatgcaaaaaattagctgggcgtggtggcgggtgcctgtagtcccagctgctcggagaggctgaggcaagagaatggcatgaacccgggaggcagagcttgcagtgagccgagatcgcaccactgcactccagcctgggcaacagagtgagactccgtctcaaaaaaaaaaaaaaaaaaaatttcaagataaaatcaaaattttttaccattttatggtctgggccttacccacttctccaccttctcacagtatgctctattcttgtttctgtattttaatcatacaaaatactgtggtttctcactatttatcctttcatatatcagggtttttcactctttgaatttcagaaaatggttgaatgttctttcatcatttttctttaaatttcttgaagctcagttgaagaggaaaattcgcaaaaagtcaaactggtacttaggcaccataaaaaagcgaaggaagatttcacaggcaaaggatgatagccagaatgccatagatcacaaaattgagagtgatacagaggaaactcaagacacaagtgtagatcataatgagaccggaaacacaggagagtcttcggtggaagaaaatgaaaaacagcaaaatgcctctgaaagcaaactggaattgagaaataattcaaatacttgtaatatagagaatgagcttgaagactctaggaagactacagcatgtacagaattgagagacaagattgcttgtaatggagatgcttctagctctcagataatacatatttctgatgaaaatgaaggaaaaggtacgtctttttcaattaaaataatttactgattttaaaagatatttcaaagtttctaaacacctaattgcatcttagtttattgctttttgcttgcctttcagagagcagatgttagttaattagaaaacaatagcattatctttactattgagctagtaaggatagttacaagctgtggcatcaaacagacctagatttgagcctccagttcactacttagtagcttgtgacctttggcaagatacttaacttgtcagcctgtttgcttatctgcaaaattggggtagataagatagttgcttggtaatgaggcatttttaagattaaatgtaacaaactaaagtatatgataccctttcatttttaagcaagataagagtctgctatgattcttgctgagtg

SEQ ID NO: 131460 - DNA, 1045 bp, Homo sapiens
agaccaggaggcggagcttgcagtgagccgagcctgggtgacagcactccagcctgggtgacagagcaagactccatctcaaaaaaaaatcaagataacaagagaagcagcttctgacaaccaagaggcagcagacaagttcccaaacaccattaagaaaatcactggacagaggccaggcactatggctcatgtctgtaatcccagcactttgggaggctaaggtggtaggattgcttgaggccaggagtttaagaccagcctgggcagcagagcaagaccccatctctaaaaaacaaacaaaacactggccaggcatggtggcacacatttgtagccctaccttcttgggagactgaggtaggaggattgcttgagcccaggagttcaaggctgcagtgagctattgattatgccacagcactccagcctgggtgacagagcaagaccctgtctcaaaaaaaaaaaaaaaaaaaaaaaagaagccactggggagaaaggtaatctttcattctcctttgtcatttctattacctaaaagttttaccacttctttccaggactactgctgtgtggttatactgcatctagtctagacagaatatttaacctctctgtaccttagtttcttcatctgtaaaatgatgatgataatggtagcaaacttcattgggttaaagtgaaaaatttttttttttttttttttttttttttttgagacggagttgcgtcacgcaagctagagtgcagtggcatgatctcgattcactgcaagctccgcctcccaggttcacaccattctcctgcgagtagctgggactgcaggcaccggccaccatgcccggcaaatttttttgtattttttgtagcgatggggtttcaccgtgttagccaggatggtctcgatcacctgacctcgtgatccgcccgcctcagcctcccaaagtgctgggactacaggcgtgagccaccgcgcccagccaggttaaattaaattttaatgagtaagcatacataaggggcttagaagaattcctagtatatg

SEQ ID NO: 131461 - DNA, 1378 bp, Homo sapiens
ctctgttgcccaggctggagtgcagtgacacaaattatctttcactgcaaccttgtggagatagggtcttgctgtgttgcccagcctagtctcaaactcttggcctcaagcaatcttcctgtctcagcctcccaaagtgctggggattacaggcatgatattattatgacctacacaattggaagagacctggagagccacgtcttaagttgctctgaaggatgggtggcaattggatgaggaaagaatataggctgttactggagaatacagctgcccaagaataagaaacaattactggaggatacagctgcccaaggaatagaaacaaatacaaaacaaaaacagccttaaatcaagtgaaaggttttatgttaaatatattatcataatctcttacgtatttattctctatctcctatattgcctggcatcgaaacttgactcacatgttatgtttagagttaattttgtgatttgatcatttgcttgaattttaggttcctgattatgtcactgtaataaagcaaccaatggacctttcatctgtaatcagtaaaattgatctacacaagtatctgactgtgaaagactatttgagagatattgatctaatctgtagtaatgccttagaatacaatccagatagagatcctggaggtgagcattagtgaattttttttcagggggttgagttggggggcagctaacacttagggttgatttttgtgtcaggtgctatattataaacataatcaaaatactatttaatcctcacaacaaccattttacaaatggtaaaaatgaagtttagaaaggttaaaaacattgctgaaggtcacacttccaggaagggacagagtgagaatttgaatgcaggtttctttcattcccaaatccctgtttattaacaattacatgatagatcctctaatgagacacaaaatggcttgtatactttgtatatcagtgctcttcctcaaagtggaaaagtaggcactctgtaatgaaatagtttttaaaatattctattagttaagaccattataatttttattacaaaagcaatataatatagggcttactagtagtaatatttttaaaaatctagtcccccatttcctttctccaaaggcagacactgttaagtttgaggatatcttttcagacctttttctgtgcatataccccttctgctttcacctatcgcatctattaatataaaatttagtgggtacaatgtatgttatttgggtggtggatacccccaaagccctgacttcatgtgcagtctgtgcctgtaacaaaaattacacttgcaccccatacatttttacaaatttttaaaaataaaatgtataaaggatttttaatgata

SEQ ID NO: 131462 - DNA, 1110 bp, Homo sapiens
tacaggcgcacgccaccacgccagctaattttttgtatttttagtagagaccgggtttcactgtattagccagggtggtctcgatctcctgacctggtgatccacccacctcggcctcccaaagtgctgggattacaggtgtgagccaccacacccggctgcctcttaaattatcttaaaggaacagaggtaatgacttgtaggaattagcattccaaattacaagttactaatgatttctggaggggacgtagggttagagattatggtaatacttttgtatttcaaatctttggattccttgcatatatgaggaagataatccctcaaatcctgactctgttttcattaaatcatttgtcaacctcaatgttatggaggagcagtaactaaattcttccattcatgtgaagttttgcaggctttggaggtactcccagtagcaccaccacctgagccaagatcactgacagcagaagaagtgaaacgactagaagaacaagaagaagatacatttagagaactgaggattttcttaagaaatgttacacataggcttgctattgacaagcgattccgagtgtttactaagcctgttgaccctgatgaggtattagtttaatctttggatcaagtgtattctaggccataatgcttcacaatcaaaggatatttgaagagtttatgtggttctgcctacactcttaactagttttatctatttggaaacatgtaccgggttagtgtcctaagcacatgtagactttaagagcagggtaacgcattttcctttcctgcagacaattaactttgtctccccaacctaaacattccagaagtaattgagaatgtcttattattttttttttttgaaacggagttttgctcctgttgcccgggctggaatgcaatggcgcgatctcggctcattgcaacctccacctcccaggttcaagtgattctcctgcctcagcctcccaagtagctgggactacaggcgtgtgccaccacgtccagctaatttttgtatttttagtagagacagggtttctccatgttggccaggctggtctcaaactcctgacctcaggtaatccacccacctcagcc

SEQ ID NO: 131463 - DNA, 1263 bp, Homo sapiens
aaaagtaaaatatcatcaagtcagttcctttattaattgtagtttgggttcttgagttctcatgatttttagttccttaatctcttgtaaacatggtttatacataaatctaacattctttaaagacttgtttaaaaaatatacaatttagcttgtcattaaaaatatgtgtataataacctgctattgtcttgaatgactgacacatgcatttcatatgcatgtgtgtatatatactgcatacatatgtttatatactgtatagatgctccttgacatatgatgggtttatttggacataacccgattgttaagtggagggacatactgaatacatgtcactttcatgctgctgtaaagtctaaaaattgtaaattgaaccattgtaagttggggatcatctgtatatatgatatatattgcatttattttcttttttaaggtgcaagaattgtttatccgtgattatggagagatttttaatgtccagttaccggataaagaagaacggacaaaattttttgaagatttaattctaaaacaagctgctaagcctcctatatcaaaaaagaaagcaggttagtttctatatcaaagttaatatttaataattttgagaaagtaggaatgaaatagttaatggcattgacatgtatctgataacacaagctcaaaacctaagtcatgaggttgatgcatctgctgcttaaaaatctctatgcttcccattaaaacagactaaagttcttaaggtacacaaagtctttcatagtatagccccaatctatctttctaagctcattttgggcacttgtgttctgcctcagccctccacccccacattttttttctcataaaacactatctttaaaccatatgtaacataattttaccttttcactattttagtaatgcttgctctctcatcagtaaagcttctatctctatcccccatctctgtctaaagaactacttattcttttatttttattttttgagacagggtctgtgtcatccactggagtgaagtggcatgatcgaggctcaactgcagcctcaacctcctgggctcaagcatcctcccacctcagcctccgaagtagctaggacaagaggctcatgccaaaatgcccggctaaatacttgtccttttagtatacctcatttattctttattatgaagcctttcctaacttatatgggcaaaatgaattgcttctgcctttatgacccatcatacttttaaaatactactaatatggc

SEQ ID NO: 131464 - DNA, 1510 bp, Homo sapiens
ctgtttttggtatttgtatattaacttttttttgtttgtttttggttttggtttttttgagacggagtcttactgtgtcaccaggctggagtgcagtggcacgatcctggctccctgcaacctccgccttccgggttcaagcaattctcctgccttagcctcccgagtagctgggactacaggtgcaatgcatgccgccacacccagctaatttttttttttttttttttttgtattttaatagagacggggtttcaccatgttgcccaggatggtctcaaactcctgggctcaggcagtccacccgccttggcctcccaaagtgcgtggattataggcatgagccaccgcgcctggctatattaacatttttaaaacataaaaatattttatatttgtagttttgtttacttttgattaccacaatagaaaaatcttctagatttctccagctgttttctagttgcttgaagaaattatctttttccaaaaaaatgaaacttttaatccacatttaaaaataaggttgtgggattttggagaagcattttaaaaacttgaggactttatatgttactcctgggaggttaaacattgtttcagactaatagaactagcattattaacgtgctgactctaactgaatttgttttgttctctctctactaggtgattcgtgaagctaagagaacagcaccaagtatagtgtatgttcctcatatccacgtgtggtgggaaatagttggaccgacacttaaagccacatttaccacattattacagaatattccttcatttgctccagttttactacttgcaacttctgacaaaccccattccgctttgccagaagaggtaatttatgtggggcggtatcattatactttcaaaaagagttgtttctaccacaataatcataacttattgaaaaaattcaaatgctgtagaagtgaataaaaggataagttttcttatcaaatataccattggtaactatttggtatatgtgctcattgggcaagatggtatatgtatatgtgtatgtatatattaaggatacataaattttttctcttgaaaaatggtattatatgccgggtgcagtggctcacgcctgtaatcccagcactttgggaggccgaggtgggtggatcatgaggtcaggagattgagaccatcctggctaacagggtgaaaccctgtccctactaaaaatacaaaaaaaattagctggacgtggtggctggcgcctgcagtcccagctactcgggagactgaagcaggagaatggcatgaaccctggaggcagagcttgcagtgagccgagtgagccactgcactccagcctgggcgacagagcgagactctgtctcaaaaaaaaaaaaaaaaaaaaagtatttaaaaaatgggagtatatgatacatactattctgcaatttgctttattcatttatcaataaatgtattcatgtatttgttagtgctaaagtctctttaagagctgcatggt

SEQ ID NO: 131465 - DNA, 1156 bp, Homo sapiens
tatatcataataagataatagctattctttactgaccattttgtagtcatccttttaagcattttacatatattatttcatgtaattttcacatcattcctgtgatgtaggtagcagtatctctacagatgaagaaatggctggagagcattatgtgaatcttctaaggtcatacagctagtaaattacaaactggaatgtgaatctagtctgtgtgattttaaaactcttgcttttgacctctgtgctatacttagtgcttgtgtattgcactcttaaaagttgattgattgttgatggccattactaccctataagtttactgggtaaaagagattttggtcttattactcttaaatatttgctaactatattccgaggctgatttttaattttttttttaaccatggtcatgctaatagagttttgtgtttctttgtttggtcggctggttcttttcttcccctggttgctttggataggatactgtggagcagatattaaatcaatatgtgctgaagctgctttatgtgctttacgacgacgctacccacagatctataccactagtgagaaactgcagttggatctctcttcaattaatatctcagctaaggatttcgaggtagctatgcaaaagatgataccagcctcccaaagagctgtgacatcacctgggcaggcactgtccaccgttgtgaaaccactcctgcaaaacactgttgacaagattttagaagccctgcagagagtatttccacatgcagaattcagaacaaataaaacattagactcaggtataaaacttgattgaccatttaaagttagtttttataatcagtaaagtgaaatgtttcatacataccagaaatatttatttgtaaaagaatctcttgaaaagaatttggtaatgctttacctgggatatttgaaggaaatttactccatggattgcccttaatttaacttattgtaagtttggggtgcatttttacatttacttattaattcatatctacacaaatatttttgattctttgaaaaaatttaattgaagtatgctgacttggtaactgaagcaataaagatttgctttgcaatccaaaagttactaatgtacaattttttggttttatagatatttcttgtcctctgc

SEQ ID NO: 131466 - DNA, 1025 bp, Homo sapiens
gtctcaaactcctggcctcgagtactcttcccacctcagcccccaagttctggggttacaggcgtgagccaccatgccttgccttttttttctttttgatgttatatattgtttgagaactcttaagttcctttgtgaaattatgctttataaaatgtcttctaggattcatttgtggggggtctaacaaccgtctgttttccattgatttcaatttctgtgggccatttgggatgttattttatagatttttttaatccattggaaatagtgaggtgccctgagaaaatttattcacatgtaatgcgttaaatcttacaaaagaagaaatattactgaatgatatagactgtgttcatagtattaatctcttctctcttatttttaaaatttagttctattgtttccaccctgctagctcttatggatggattggacagcagaggggaaattgtggtcattggtgctacgaacaggctagattctatagatcctgctttacgaaggcctggtcgctttgatagagaattcctctttagcctgcctgataaagaggtaagaatttaatgtcactcaaattttgacaaaatatattgctgtttattaataataagtcttggtatagtaaaaatttggagattcttgagttttgtatcatggtcttgtcaaatgatagtaaacaactcaaatggggacaaatttttattcttttctttaaatataataatgccttcccaaaattactcttaaaattatttcaatttgagtgtagcctttggatgttctaagtgttgcttcagaacatatggcttaatgagtaatcaatccttagccagtttgttagccttgtctttttcatgaatatcatcatataatcctaccgagtttttttaagtctacttaatcttctgggaaccaaagaggaaaatatgtcaagagctgtctgtactcttaaaaacagctcttaatatgcaccagaatgaatagctactttagtagttacttttctcttatttgtgtttatg

SEQ ID NO: 131467 - DNA, 2176 bp, Homo sapiens
gagaggtcaaggtaggtggatcacaaggtccggagttcaagactagcctggccaacatagtgaaaccctgtctttactaaaaatacccaaaaaattagccaggcatggtggcgggcacctgttgtcccagctactcgggaggctgaggcaggagaattgcttgaacctgggatgcggaggttgcagtgagccgagatcgcaccactgcagtccagcctgggcgacacagcaagactctgtctcaaaaaaaaaatagaaagtgccaggcatggtggctcacacctgtgattccagtgacttgggagactaagacaggaagattgctttagctcaggaatttgaggttgtagtgagctatgatcatgccactgcgctccagcctagctgacagtgagaccccatctttaaaaataagtcagaaagttattaatattaaataacatttacttcttacaggaaatgttggaagtgcctagttaaagtaatttagtaaattaaaaacaaatttcttgaattttctttcacatttcttcttccttacaatatacgttttcccccatacaaattgaattatatgattgtgatatgtgattacatatgcaaggtaagataatatgatgaacatgatgaatgaattgttaaaatgtttcaaatagagttttatttacagtttcaatattaattttacagtatcagtattaactcccaggttttaagttgtgctttgtggtgcgaaactgtaccataattcagttgtcttacacattttaattttctaattaaatgaatcatgaaattggtttctaatttttgttttaaaagtctgctttttaaatgtaatactaaaatgttaatgtattgttttacagaggttgtttgttttatgggccacctggaactggaaagactctggttgccagagcacttgccaatgagtgcagtcaaggggataaaagagtagcatttttcatgaggaaaggtgctgattgtctaagtaaatgggtaggagaatctgaaagacagctacgattgctgtttgatcaggtatgatattaacattttatatatctggatagttctgtaatctaggcagatgtgtgtgaggattagataaatcttacatttaatcagtgttctaaataaacccagaagaattagactatttctttctagattattttcttttatatgtcgagatgacactgacctacagtgaacagttttatagtaagaagggaaagaaataattggatcttagttgtttggagtcttaggtctcatgcatataggaagagagtggtaatctcatatttagagagatagtagtagtgaattatggctcagtatgggagttaaagactatttctgccctggagcggctttcattttcatatcccagattgtattgacagcacattgtaagataatactttctgatctactgaggcatattgctgcaaatgcttttaaatctctttttggaactctcccgaggttcttttttacttttatgtttatggaaatggataaaaactgtggcatcttgctaaataatgttttcccatcctgacttggaggaagactatgtcactgtcttctattctttgtcttgtttccatagttcaataaatatttttgcgtgtccaggaacgatagctatgtgaaatctaaggtatataaccagtggagtatatcttttgaatacttctggttgaaaatgcaattgaaaattaaaccatatatcattataatttagtttgaattcttaaaaccccgttactagaacttatgtttaaatttataaattataaatagttataaattataaataaattgagactgaggcaggaaaatcacttgaacccaggaggcagaggttgcactgagccaagatcacgccactgcactccagcctgggtgacagtgagactccatctcaaaaaaaaaaaaaaattatatataaattctggtaagtaagtttgaagaaaaaccgattcaaatagtatatattcagctttataaattctgttaagcatatttgaatgagaatttattaaaatggtttatattaagtctacgtgtttgaggctgtttatgctaacaaatgaccactccacctactttctaggcctatcagatgcgcccatcaattattttttttgacgaaattgatggt

SEQ ID NO: 131468 - DNA, 1081 bp, Homo sapiens
tttttagtagagaccaaatcttgccaagttgctcgaatgatttttagtggagacaatgtcccgctacgttgtgcttgaacacctgtcaagtgatccttccccctcggtctcctaaagtgttgggattacaggtgtgagccaccacacccagccccaaatattctaataccctcttaatcccacctttctctttgagaataactgatttatatcaagactaagaagtcaccctgccttctcctgtctccatgaacatttgatattcagctctgccacagtctttagtcttttttcctttcctctcagttgtttaagtcttttattccatttgaaagattcagcgaacaaagtttatgtcagtgggtcagcagatgtattaattttatgataaactttttggagcattaggtatttctgatgcttttcttatgccttttctttttcctgcccttccttatcatgatttcaattttgttttttactttaggcgaaggcatgcaatccacagtagtgactcgacttcatcttcctcctctgaagatgaacagcactttgagaggcggaggaaaaggagtcgtaatagggctatcaataggtaagtgccatattgatgcctttttaaactagcagacacattttgtaaaaattgctaagaaaacagaataatttgggtataagtataggctggctgattaaaaagttgcacaacaggttaatgtataaactagaatgctgtcttgttagaattatctacagttgaatcagaataacaggttagaacatatgactgatttcttgactttttttttttttttttgagacagggcctggttctgttgcccaggctggagtacagtggcgtgatcttggctcactgcaaccaccacctcccgggttcacacgactctcctgcctcagcctcctgagtagctggggttacaggtgtgcatcaccacacctggctcatttttgtagttttaatagagatgaggtttcgccatgttggccaggctggtcttgaactactggcctcaagttatccacccgcctcagcctcccaaagctatggaattacagctgt

SEQ ID NO: 131469 - DNA, 1125 bp, Homo sapiens
cttcatagaatgatttggggaggattccctctttctctaccttgtggaatagtgtttacaatgtttttaaactgaagtaatgacctttctacagtatagagtaattgctaagaacctgggcccatgactaggactgtctaggcttggagctcagctctactagttattagcggcctttggcaagttacttaactctgtttcagttttttttttatctgtaaagtgaggatagtaggacctatctcatagtattgtgagaattagatgagttaatacatgtaaagcatttaaaatagtgtctgccatacattaagtgcggtatgtatttgctattataactgtacttcgatgtttaaaaataatctccattttgcaaatcaaatgtcagaaatttcatgttggtccacaggttgtgttattgtttgcttttaactttattggtttatgaaattaaaaaactggaaatcatcagtatagtaatgtatagaatgcagattttttgaataaacatataggtttgaattctgacactatcaatgacagattctgatattttgagtaaattatttaacctggaagccacactggccctaactgtaaattgagcctactaataatccacttttccaaaattttaattaagattaaatactatatcaagtacatggtacagaaagcagtcagttaatgttagtcttttttattaattgggaggttagtctgaattctgtgactacatagtgagttcacataaaattatgtgaatacattaaagtctaatattcatggtaataatgaataagttagtttttcatataaagttgcagacttgtactggatataataattttagtttcaggctgatcacaaagatggtcttggtgtatttgggtaggtggatgggtgaaagattattttctcatttatttctgtgtttccacaaccccttatccaaaacccttggaaaaccatttgtgtttcagaattcagactttttggctggatttacagataacacacaacatatgtagtgtggcaacattaacatctctagggtctccaagccagcactgtgtggtcaaatacattaattaataattctgtagtaaaacatatgaataatca

SEQ ID NO: 131470 - DNA, 2075 bp, Homo sapiens
tatatatacaaatatatatatatatttcttttttttagaacctcgtcaccagagaaagcccaacatattttatagtggcccagcttctcctgcaagaccaagataccgattatcttccgcaggaccaagaagtccttactgtaaacgaatgaacaggtttggttctgatatagtgattgatttatgacaacataattgtttttatgttagggctggactctagactttcaggattgggtgtattaggataaaattctagaattgtgtatttgggagagcttagtttctatacctttagtagtctaatccccagtaccactgactagtttttgcttttgcttccactaataggaggtgttagtaactaccgtagtaaggtagtttattccatttttccacactttaataatagagcaaccttagactcagggtttactgtagtcctggctctgtgttaagcattttacgtagattgtttcatttaatcttcacattaagttagaatataggtttagtcttttctttgcatactatcacagatgcattttcctaccatgtcagatgttctaagctacatggcctctagacctttcatgactctggttatctttttctggatctattttataatttattcctcttctgttgtaggaaacatttattttctttgactattcaatatttgtggatttcttttccttctacatcccaacagttgttcattggtcaaatttaagtccaaagagataattcttctatttttattttatttatttattttggggagggtgggggcggagcagagtcttgctgtgttccccaggccggagtgcagtggcacgatcttggcttactgcaacctctgcctcctgggttcaagcgattctcctgcttcagcctcccaagtagctgggactacaggtacctgccactacacccagctgatttttgtatttttagtagagacgggttttcaccatgttggccaggctggtctcaaactcttgacctcaagtgatccactcgcctcagcttcccaaagtgctgggattacaggtgtgtgccaccacacccggtcaaagagataattcttgatacttcctcatcaatgcattggaataatcattttggtagttcatgaatgagagagaagactaagaaaccaggaaaaaaattttatttgtatggggaatggtaatttttttcccttaatattagaattttctcagaagtaagaccgaagccttaggatatttcagttatttgaacagttcttggaagttttctcctagagacagaccatctgatcatgttttggtcatggaagcagcacctttgtaagtgctgaaggttaatttctttcaggaaaaataaaaaatactatttgtgtccctaggtcttttcatttcattgtaggaatcacaagtgtacatctagatttcttatttcatcatcctatttcacatgaccagggtccagaaggatggaggatcgggaagacaaactcagtctctcagggcttttcaagattaattgcacttgaaaggaggctgcacatcagtattctcacaggccccttagaatgtaaagacctctattttggtggtgaaatgtaatgatcttcagaaaaggagaggaaggtatagtgttccctagaatccccaccaccaccaggcacaggaccaaggcactgttatggttacctaactcaaggggtggatctctgtttgatccagcagtactaagagggtggcagctactttgggatcttatttcttctcccgttttgttttgtttaagaggaaatctcactctctcgcccaggctggagtgcagtggcgcgatctcggctcactgcaacctccgcttcctgggttcaagcgattcttctgcctcagccccccgagtagctgggatcacaggcgtctgccaccatgccccgctaatttttttgtatttttagtagagacggggttttcaccatataggccaggctggtctcaaattcctgacctcaggtgatccacccaccttggcctcccaagtggtgggattgcaggcatgagccactgcac

SEQ ID NO: 131471 - DNA, 2313 bp, Homo sapiens
ttagtgtgtattatctacagttttatataaatggaatcatacagtatttattctttgtttggcttcttgcaactcatcataattgctttgagaatccatgtggtcacttttttgttgatgagtagtattccattatatggatataccacaatttatctcttcaccttttgatggacttgggttgtttctggtttggggctatcacaaagctgctttgaacattcatgtacaagtctttgtattacatatctttcctcttctcctgggagtaggtgggctcaatcttatggtaggtgtatgttttaactttatttttgttttctgatgtttttaagaaagctaagtttaagatactgtaattttgttacatgaaagtatagcttttcaattgttcattttagaattgttttataaatactattatttcaaatgtttctatttatttttatgtatgcatttgtgaagacaaagtgattccagttactcggtcattgagggctagaaacatcgttcaaagtacagaacacttacatgaagataatggtgatgttgaagtgcgtcgaagttgtaggattagaagtcgttatagtggtgtaaaccagtccatgctgtttgacaaacttataactaagtaagtaaaaattccttagatcaagatgatttatctgtcagagactttttgttggggaggaatcatggatttcaaccagcccaaacatttaatgcattctactacgtaaagcgtacaggagaatgattatcagaggtctttgtgacaattctgtatatgtctctattcttggaaagaaattttaaaatatttttatacaagtaaatcaatgcttcttataaaaatatttaaaaccttagtgccaaaagtttgcaatggaagaaaaataaagtttttaaaattctgctactcttttacaattttcacttacatttatatcttttttttaaagcactgctgaagctgtacttcaaaaaatggatgacatgaagaagatgcgtagacagcgaatgagagaacttgaagacttgggagtgtttaatgaaacagaagaagtaaatatattcttccattaagggaatgatttaatatccagtttaatttttttatagtacctaatccatttttcattaaatatctactttttccagcatttatttgatcagtcattagttactgctggaaatgtaagagtttatggctgtaaatatcttaattttaaacaagattggaggatccaacttaatttttttaataaatagattccaaatgttaatggcttttatttaaacatttttagagcaatcttaatatgtacacaagaggaaaacagaaagatattcaaagaactgatgaagaaacaactgataatcaagaaggcagtgtgggttagtctcttctcttgttctgtcttctgggattgaatttaagaactttttatttagtagaaaatagcctttttagctagaaggtgtgacatttatggtagtttgtgagagatcagaggattggtaacttaaaagtggggaaaggggagagcttaagaggatagtatgttttgtttgggaaagtaactgaaatcaacaatctaaagccaataatattggtctgcttatgtaatacatccactatggacaacacactgtatatctcttttttagtttaaaggtgattaaagttatgttttgctattccatttaggacttaattaccataatctattagaacttatcttaagtgaaaatcagttttctgaaatgcattttaaatgtttggtgagcatgttttaccataatcataagtagattgagttatgcagcgtgtaactccatgacagccagatgggctgggtgaaatgtcaaacttaagtttagaaagcaaaagcttaatgaggaaatttgaaaacttgtcaaaaagttatgttaacttggaagcttaagtttagtcacctacattaatgaaattcatggaaagactataaattttagtttggtgcttgcttaacagtagccttcaaacttctttctctacttccttttttccttccttgtgtttttctgcagttttttaatgttggaaaagaattacaaatacttcccatgaacaatctaggagtagataagtttggtttttttttgttgtttttttttttttaggagtagataagttttaaaagggtggatctttctctcccaactcacctatgttaaaaattgttaacattttgctgagtatctttctggaagtaaggatctcttaattgtagagtcatctgaagagggtgaagaccaagaacatgaaga

SEQ ID NO: 131472 - DNA, 1109 bp, Homo sapiens
tgggcaaaatatacagtaataactctttttcattgtttaagccaaaattataattctgatggaccagttattttgaggttgctgctggtggttaggtgacagtattttggtgagtctgtatctttcttaggtctttctaacttctatagccttaaaataaatgagtacctactataataaactattgcaacttttcgtcagtggtggaaaacttcactctctagactactttttataaagtggttatgaactacttgttatgaactataaaccagtaaatcttatattagctgcttcatagacattgctgatatttgtttatcatgaaatggtttttctagatactaacttgtagtttcttggggagatacaaaatgattctgcacaaaaagcagtttttactaacttgtaatcagagaatactctttggaggaatttaaattggagttttgtaaagaaaaacttagatggctttcttaatttttcttaaaggatgggtcatcagttaaggaagttgaaacctaccaccggacacgtgctttaagatctttgagaaaagatgcacagaattcttcagattctagttttgagaagaatgtggaaataacggagcaacttgctaatggcaggcattttacaaggtaatacaaggtggttgaacactaattcaaaatagttttaaagcagtaatttaggatttgctttaatttttgaagtgtatttttgactggtcatcaaggttctagggctataaaatgtagtttatttgaaaataaatgatcacaagtgagtatgactaaattaaaaattaatacgtggccaggcacggtggctcacacctgtaatcccagcactttgggaggccgaggcagacagatcacctgaggtcaggagttcaagaccagcctgaccaacatggagaaaccccgtctctactaaaaatacaaataattagccgggtgtagtggcgggcgcctgtaatcccagctactcgggaggctgaggcaggagaatggcgtgaacccaggaggcggagcttgcagtgagctgagatcgcgccactgcacttcagcctgggcgacagagcgagactgtctcaaaaaaatata

SEQ ID NO: 131473 - DNA, 1060 bp, Homo sapiens
ttttttgagttggagtcttgctctgttgtccaggctagagtgcagtggtgtgatctttggctcactgcaacttctgtctctcaggttcgagcaattctcctgcctcagcctcccaagtagccgggattacaggcacccgccaccatgcctggctaattttagtatttttagtagagacggggtttcaccatattggtcaggctggtctctctgccaggctggtctcgaactcctgacctcgtgatccgcccgcctcggcctcccaaagtgctgggattactggcctgagccaccacgcctggcctttgtcaaaggttcttaccttgtaagtggctgagttagaatttcagctgtattacaagttgctgggcccaaaactcatagaatattgacatattttatcagttataaaatgcctccatgtacaagcactgctaggggaggtaattagctctgtgtggagaggggtttacacacagtataggttgaataccagcttgttgggatgttttagaggagattcagacattagccagttgttggatgacatggggtttaaggtcttttccaactttttgatgtcatcatcagtattttgttcaaatttaaaagacacatagaatgttctctaatcttgattaaacaattattttatttcagtgaagaaaatatttggaagctctgtgaatacatcaaaaaccatgaccagtatcctttagaagaatgttatgctgtcttcatatctaatgagaggaagatggtaagttggtgagtgattgcagaaagaaaacaagagatttaggatgacattagaagctaaattaaaaaaaaaaaagctaaatatagcatgggtgtagtactcttctgaagtgtgctttattaaatacagcaacatttaaaagcttgcttttgaatgagatttttttccttacaaggcacgattgagttagaagagttgagtcccttctgtcgcccaggctggagtgcagtggcgtgattcttggctcactgcaacctccacctcccgggttcaagcgattctcctgcctcagcctcccaa

SEQ ID NO: 131474 - DNA, 1035 bp, Homo sapiens
agcctcccgagtagctgggattacaggcatgcgccactatgcctggctatttttttttttgtatttttagtaaagacggggtttctccatgttggtcgggctggtctcaaatgcctgacctcaggtgatccgcccgcctaggcctcccaaagtgttgggattacaggcatgagccaccgtgcccagccttttaaaattttatttttgtgtgtggagaccgagtcttgctgtcacccaggctggagtgcaatggctcgatcttagctcactgcaacctctgcctcctgggttcaagagatcctcctgcctcagcctcccaagtagctgggattacaggcatctgccatcatgcccagctaattttcatatttttagtagagacagggtttcatcatgttggccaggctggtcttgaactcctgaccttaagtgatccaccggcgttggcctcccaaagtgctaggattacaggtgtgagccactgtgcctgaccaataaatggatgttattaaaagcctggcctgaacagatacctgctgtaaagctcagggccaaagccacattctccctggactgccagggtaaaagacatagttcattctctggtgctaggctgagtggtcagcttggagcaaaggggaaaagtatactgtgagctcctgctctcaatatcagacactagacatggtgctttccatatctgcgtttgtgacaagaggctggaatgaggtgcctgccaagaatgtgagagaactaattaaataaatccatggtgttctttgctctctgcaaaagtcattcataacgtgcttttcacaccaaaaggtggaagagtagggcttggagttaaggctgaagggactgcagacaaaaccggtttgaaaaaggacaagatcatctaaaaaaggaatagaatctagtcaacgggaataattcaaagcacaagactttagcagcagttttctagcattatcctgagatccagtggagtggcggacttgatgttccagacccctttggtgacaggagttgttc

SEQ ID NO: 131475 - DNA, 1003 bp, Homo sapiens
ttacttggtatgctatacccttgtagggctgttgtgaagattacaggacacaacgtaatgtatgtaacaaacttatcaaaggcccaggtccatgataagcatcacaattaattccaggtattatttacatgtgtaagcaaaataatgctggtttttcatataagtaggtgatgctactcatcctcttgacgtattaataagacacgcagcacttaatgctcttaagtatctaattatttgaaaagaattgaatagcagtagtgatgattggtgctaaatatatttatattatgcagcatttcagtgaggctgaagatacaataatggtgacagttgattgggttagagagtttgtaaacaagtaaaggaaactggtctacactgagataaagtctgcaatgttgaccgtattaaccattgcttcatagagtctataaaatgaccatataacgtatgtaacaaatattgcaccaaatgcctgctttctcagactcaaagcctgtagggacacaatattaggtaagacttaatccttttgctcatggaatttacagtctagtagagaattaaaaataaaaagaaatctttgcaaattatgataagtgccaccaagaaaataatcaaagagttaagatacagagtaatggagttgggacatggggaggagggtctggatcctactttgtatggggtagtaaagaaaggcttcctgtagtaggtgacatttaagaccagatgatgggaaagaacctaggaagagggaacaacacacacaaaagctctgaggtggggaagagcttgacaagttcgaggagctggaggattgttacccatataatggttgggttcagttgcttggtgggtgaacatctttacagatgaagaaatgaaagtacagacaaggaatttgcaagagtagcaactgacatttgaacctaaatcaatatgattccatataacatatgttcttagttggtatgctatacccttgtagggctattgt

SEQ ID NO: 131476 - DNA, 1033 bp, Homo sapiens
ttctggatctcttactcatcgtgaaaggcagacgctctaagtctaaagtctagggtaggagtttccattctttggaaaaccaaagatggttactcttcttaatgaaactgagaagaaggtatctacagaaaacactgaatttaaacaaattatgaccttgtttgttgaagccatcaaggacccaagatatatcaaagaacaacatctctgtattggcctacaggttcagagtgttttgaggtctgtttaagcactaataggattttaggccagcatccagtcagaagagatagttcacagactcagagttggaaacagattaaaaaaaaaaaaaagatgtcaacatagaaaatgatgatagagtttagttaaaaaaattcacacataaaattacagttaaaaaaattcacacataaaatagagtgtttgcatagcaagacattattgcccttcagcctggcagaaaaacataaactcaggtgtatattttataataaacattgtattgaatgctaagaatgatacactgttgaacatctcctgaatggtttgccttcttgtaaatcataccaattgtttagacaattgaaattccaagctctttctcttctcccatataaaaacaacagaaacaggaggctgttagtagcaagctcctcatgggaaagggtatgtgaatccacaaagacgagaactatggcaatagcataatacacacccgctaccttactgcccaagtgctagtagaacctgctctagtgttcagagttttgcagtacaaacccagtccctctgaaatacgtcttccaagccacttcaatgtaaacctgatcatcattaaacaaaaatcatctcacaactgatacattggggatgctttcacctaatagcttttgttcatttctgccatttgccctcccattcaactgatttgtctgctcaaagtaacagcattgagtgataatgcaatctagtttaaaatgccattggatttttttttttctggatcttgctctagtgtgagcactcctga

SEQ ID NO: 131477 - DNA, 1136 bp, Homo sapiens
acaggatgatagcagctcatacacacctgcattgtagtatatgtgagagcagagggagggagaaattatcctgggagagttggaaggatttttaaggcaggcacttaaattgggccttggaggacgaataagagttaaataagagggaataaagatttttccagggggagggaaagtcattttacaaagcttggatgagtgaaagaacatgtctcatgagtagcaagtgactgtatcaccagagtttggactgacatgtttggagttgaagttttttgagtgcgcggggctggtagcagatgagcctggaaaagtggtcagggccagattttgaaggtgcttgtgtgctttgttttgttggactttatcctccagacaagatgggtttatcagagatgtttcaacaagagtgacatgaggtttttgaaagttaattctcgatttttttagtctgttttactcaattgtttaatagatatttattgaccacctactaggtgctgtgcgttgctctaggtgcaggtaatttgcaacagtcaacaagacaaagactgccttcatggagcttacattttactaaagaaagacgtaaacaaataaatgaataaatacgtaacatagcagatggttttaagtcttacgaaagtagtgatatgggctacagataacgcactgctgctctggtcatagattgaccttcgcttcctcccattatacttggtcgagagtgaaattcagttttctgttggcactcggcagtggcatttttgggaagtttggaatggtggcggtgatggtatataaggattatttatttatttttatttttattttcatttctttgagacagagtctcctgttgcccaggctggagtgcagtggtgtgatctccgctcactgcaaactctgcttcttgggttcaagcgattctcctgcctcagcctcccgagtagctggtactacaggtgcgcgccaccacgcccagctaatttttgtatttttagtagagacggggtttcatcatgttggccaggctggtctcgatatcttgacctcatgatccgcccgtctcggccttccaaagtgctgggattacaggcgtgagccacagtgcccagccagtatgaggattgtta

SEQ ID NO: 131478 - DNA, 2018 bp, Homo sapiens
aatgccttctaatgaggccacaggagattgcatttttaagaaacaatcttacgtacatttaaatgtaaattttccagaaatcctaatctttaataattataaccctcagctacaattatcaaagagggatgtatctgtccttagttgccattcttaaatttaaataaatgtaggggcaggaaaccatctatccaaccacttaatatagcagtcaggaaggaaatctttataagcagaacttagttctttgttaaccaaagtgaagttacactcacctaccggtttttatttgatattaaatacttcggataattttagtaaactcttttagaaaggcagactgaaaatacatagaatttttgctctgaatactgtagcaggaaagttagtataataacatttaagaaaatattttttatttaattctgcaaattagagatgccaggataaaaatgggggtcgtggttttaaagtgtgttatgggaaaaaatagtactattgttcagtttggaagttgtttaaaatctttttgaaatttctcctagagtcttggaaattcacagagagaatatgaaaagcaggttgtcctgtacagtatccgcaatcagttacgatatagaaataacttaggtaagtagagccatgtttatattggggtggaactgaccactactctttcacattcgtaaatctttcttttcaatacatatttcatagtactgagattattccatgtacagactttaagaaactctacactgatccattccacctaacaacaatttgtattagcaagtagatttttcattctaattctgataaaaattatttttagagtactgtttatggactcattttatctataaaataatcttaattcaaatgtcctctttttgcctgaggtaagaaaatatgccataaaagaaaaagtatattagttcttagtaatttttgactttgggttgtctccataaattttccaaataatatgaaaaactttataataattgggacacattttaaacatagttcattccatgatttttttttcttctttctaaaaaaaaatttgtttatttatcagattattttggttagtctattctgttgccctggtagtctttcactcctgtttgttactcttattttaagcataatatttctgacattgtttttcttcatgaacattttccatgaaagtcagagggctttttacatttaaaaactaaaaaagcagcaaataatttttaaaaatagacttgacttcattgaaaacgagcattcagtttggctctcttgtaaggtagtagaatacaattcaataaagctctgttttgtacctttttggggggcatgctggtagttccatgcttgttttctcatttggcaagaattattctctactaatctgtcctattattcattttacttctatactctaaaatctatttcatgtgatatatttctttgttccaacttagaatattttatttgttctcttgtaatttacatacttttcttttaaattactgttggtttgtaaagtgttcatagttaatatataactataagaaacctgaaaaaaactggagaatttccctcttttgtgcagttaaacatgtcaagaaagatgaacgcagatactatgaggaactgctaaagtacagccgagatcatctcatgctgtacccttaccatctatcggatattatggtgaaaggcttgaggataacaccattttcatattatactgggattatggaggtgagtttacagtgtgggtgagccagtgggaatgggatgggactacatgtctgggactttttgcagatgttcaccagctcttcagctgtcgtctgcggtggacactctttcagaacttatagtgtaaaaaggactattggtggcttgttaactgtttgagccacactgtacaagtacttatccttattgatgtttttacattgggaagctgtctatttctcttctggtcttgaaggtgctattgaccctttgtg

SEQ ID NO: 131479 - DNA, 1739 bp, Homo sapiens
acatagaatttttattttttagtttattttacaatttttaattatagcttataattttttaaaaagtaacattgttttcctgaagaaaaggaaacttaaatttaaaatttaaaatgatcttagtagactagaatattggtgagtttttgagatactctttaatggtgagggagacttgacttggttcaagtacagttatctggggatgttaattagatagaagcttcgtgtaaagtaacatgatgccacagctacctacaacaataatactggctaacacttttgaatacctgctgtgtgctagatgtgccaagctctattacaagtgctttttatattgtcttacttaattctcataacagccccagaggtatgtattatttgtacccccatttcacagatgaggaaagtgagcacagaacaattaagtaacagctcatgtcttagtggtagtaaaggtccaggattttttggcagttcaccatgaaacttgtactcttaatcactgcaaagaactgttgtactgaagtgataggtgcttttatggggcgatagtgtcaagatcaagagagttgatattcccagtggtcagaccacatcttagaagggatattggtttagaggaaaggggtggagtaatgagggcacctagagaccaggttgtatttatgcgtagctgaagcaatggaaatgagtatgtgggcttctttttggtctgcatttaattttctccagggtacgtactaaatccattgagtggaaggcttagaaattttacttcagtctaaagtacctcttaatggaactctcaaactgtatcataataagctagtgaactttcctgttactgacaatattcatgtagagtttgactaaatttctggctagagagattctgaattggcagatggatctaattccaattcaatcacaaggaacaaatattactaactagcaaatgttggtacttacagtaagtttgttctctacattctgttggtatgttgcatattttggcaccttaattgatggctatgtgcacagttttttgtttgaattatagagtgataaatatgtagttcattgagctaatgacatgtaatcactggtttcaacataaataaatttcaggagacttgtgaattagttaatttggacagaacttaattaaaaatattttgcttttcttagatatgcactttgcctgagaaatgcgctgttgataagatcatcgattcaggccctcaactctctggatcactagattacaatgtagtacatagtaagtggttagtagaaatggtcttttgtcaacataaaaacttgttttaaaccatcaataattactagcaattacttatcaagtaggtacaaatagtactagtttctaaggcatgttattgtttgaaatgtgaccttagtcttttgttttccagtgtggctataattagtcacatacactagaaatttatgcaactgaatgataagaaaaattttgtacttcagagtatatgcaggaaaccgagatttaaaaactttaattctttttctcttctattttactttttctttcgtcacatagcattcatttgtaagaatctttacagaaagccaggaattagtttttttaaaaaaatcactgttgtgtagtgttccatctaaaacaaggtacttttgtttcttcaggtttgtataacaaaggatttatttatctggatgtaccaatatctgatgacagt

SEQ ID NO: 131480 - DNA, 2095 bp, Homo sapiens
ctagcactgtttcaaatttcttcatgtagagtcaccttactctttttgcttagatacaaattttggcctaggaaaatttctaatctcatagtgccttggtttctttatctctcaaaatagggggtaactggccaagcacagtggctcacacctgtaatcccagtactttgggaagccaaggtatgagaattgcttgagccctggagttcgagaccagcctgggcaatataaagggaccccttctctacaaaaataaaaatgaaaagaattagtcatgcgtgttggcatgtggctgtagtcccagctacttgggggactggggcaagaggattgcttgagcctgggaggtcgaagctgcagtaagccacaatccccaccctgcattccagcctaggtgacagagtgagaccctgtctcaataaataaataaataaatagatacatttaaaaataggggtaattatactactgtacaacccacggagttaggaggattaaatgaaaatgtatatataaagtacttggtaatagcctagcacttagtaagcattcaataaatgctattattatttacatagctgatagtgtagggaaataattaatgttgtcaaagacgggatttctaaaatatttctaaaaagaaaccattgatcattaaaagtacctagatgactagaaatataggtagtactaaattagaaaatgacatgagccagatctgtaaagtgaataacctatcctcagatgtatgtacattgtagtttttcagtgtctcagttttgaccatttgaattttgtcttatttttcactattaggaataatttaaatttttgggtacaattagatgatattagggccaggggacataaagatacccaaatgctactatggcctaggcattcctccttctcaggatattttcagggtgaatgtacccacaggggagaatggcaaaggaaagcatagagcttgttttttattggctgggcagagcactttggtaaatcagattagaacatttggaccaaagagatagaagtgagtatgaatgaacattcaggtggagagtgatggttgggctgcccactgtgctaaaggggatcttgaccctgttgccactgaggcccactggggaggataccagaaaagaaagccccaaagaacgagttagcccagtgacttctggtaaacatgatggtcatgcagatgaatttccatttttaggatggagtagggatgatggggagacagagccaatactttgcatccacctggttttcgtatagcgtagcaactctttcttgcagtcatttgcttttcagctttggcccactcacccctgctgcctatgaggcatcaaaaacacatgtatcagaaaccctttgcaggctcccccattctgaagcagcccctgttccctcacccttctaccaagtccatgtcatccagcatttctgagttacctgtctcagtaactctgagttccatggtgaattaaatgaactctgtggatttcgtgtctaccttcagagtcttctctgtgtacgtattgtagagtttcagaaaacttgctatggagtggataaataaatcaaaagctgcattcagtccctaagttagaggtttctttttttaattagatatgtaaattatactttcttgttttataaaatctgtaccactgagaaaaatctcttctgtttgttttagttccacctcttgaaggttttgtaatgaatcgagtgcaaggtgattattttgaaactctactctataagatatttgtttcaatagatgagcacacaaatgttgcagaggtaagtttgacaacgtctcatgaaaatataatctcaagattgtaagtttgtgtaaagtaagtaaagttatttaatatggtagtatctttttaaaatctccatgtggggagatcataccattattacacttaaatgtcattattcttaacgttcttataaatgtatattaaaatttaagttaataatttatagtttggttaactttttatatgactttttgtactaaagtattgtagactatattgatctatccaggaattttattttaaatgagacg

SEQ ID NO: 131481 - DNA, 1328 bp, Homo sapiens
ccaaacaaattacaacaacacgggcaccaattataatgcttgtagggtgcaaagaggaagagacccttaattggctagagaggtttgggaagccttcacagagaagatgttatttgagctaagaatgaagaagagcctgccagctggtcagggaaggaaagccatttcagcccgagagaatagtgaggctaagcccaaagggaaacacagcatagtggacaaggcctagggttaaatgctttttaatattctttgcgcttcaaaataggtatggctggaacttcttatggctataatagtgcctttttaaaattatgtactttctggttatcaaataaagctgaaatgaaatactttcactccaaatggtaagcaaagaataatttccatttacttgattttaaattatggtgtttttcagctgacacagccagtgtaagcagcctgagtctgtctacaggacacacgaagcgcatcgcattcctgtttgactccactcttactgccttcttaatgatgggaaatctttcaccagtaagcccaattcttgtttaaatatgaaggtgtttaaaataaatactagatataaaataatttaatgcttttatatcttttttaaagtactacatttattcccgaagcacaactgacttagaggagtataataactttcagggaaggtccttttgtaattggaagaattagcccctcaccccccaatccttaagtttaaatatatttgaaaggataatataaatatttgatagtatgcttagcataaaaagggagaagtagaactttaatattttgtttctttttttcagaacttgaaaagtcatgcagtcacaatgtttgaagtaggcaaactctcagatgagtctctggacagctttcttatagaactagaaaaggtaaatgtagattgcatgtaaggggatgttagggcatttggaatctgtccttgcttgacagaatgccaattatacagtctgttgatttggatgggctttcagtgtattcttgctcgttcctacctcattccccaaattagtactcttacagtcatttagacttaaacatattgagtgggtgaattgattttgtgatttttaaagtgatatgtctacctcatctaattcttaacataatttgagataatgaagaaatggggtatagaaattttagtctgtaatgttttaagttgaatttttgctaaaatagcctttcaattttttttctggtatgactctctaagatcacctcttaagcagtttgatttgaagtttttgttccatttaccttgaatctggaacaatatccctgggtat

SEQ ID NO: 131482 - DNA, 1034 bp, Homo sapiens
ttttcatcacaaagtcattcttgggaaagcctttcagtctgaggcttagtttttaaagtggattcttagctattttttaagtagtttgatcttaagattgatttcttaaatgtatgcaaatctgatttagttattttcccgttggtagacctatcattccattttctgtgttgtttctgggatatatgtctctacttattaaaaggtgacttattcagacttattcagaagagcatacattaaactataaggccagtgaaggcaggggttttgtccattactctatccttatctcctagggaggtcatagtccataggaggcactaagtaaatctttgttgagtgaatttaagctgtgtgttcagcaatggtgaacagctatgttgaatcacagactccagtgtctcttgtaactggtaatacagaattgtgaacaaagttatgagaattataggtaaaactggtgaccttggagtactttcctagatggagcagaatacgggttttagagttgtttaagcactctatttgaatcatttggaacatgtaacatataatgctataacttagcattattcaattgctaaaattgttagtcttagttgaagtaatttctatctccatagatgtagtaaaattgggaactcaaccaagactgaggttaataacttgtttcggtattgcctgggcaaatttttgatttactacttttgaataatgtcttatatctctattatatgattattagagtgaatggcataaaagtggtatttttgttgcaaaatctattttctcttggtttaggttcagagcactggtgaaggagaagcacagagatattttgatcatgcacttactctgagaaacacaatactgtttctgcgtcataacaaagatctagttgcgcaaactgcacagccagaccaacccaattatggtatgataaatatatttaattttgaagacatgatcatatgaaacttttttctaagaaattaaacagatcatgctcacttatataatcatcacttacg

SEQ ID NO: 131483 - DNA, 1730 bp, Homo sapiens
gtacatataacatataaaatatgtattaactgttcgtattattggtaaggcttcgagtcagcagtaggctattagtagttaagtcattgggaagtctgaagttatatacagatttttgactgtgcacggcgtcagcctctgtaacttctctgttcaagggtcaacggtatgccactgttgtagagtggctctggatggagagaggaagtacggtaaaacaagtacatcttgttgcagtaaaaagtaacctgaagtagatgattatctgtctagaccagagaataaaacattttagctttgcatctcaaagtgtcttggtggtctcctaggaaatttggtacttcttaatagagttactttaccttaaaaagaaaatttaaaatcttaagtcagttatcaatattgcatcttcaacatttttgtttcacactctcagtcttttattctgtgtgtgtgcttgatcataactcaggttttcctctggatctcttacgctgtgaaagccttcttggtttggaccctgcaacttgcagcagagttctaaacaaaaattacacgctgcttgtttccatggctcccctcaccaatgaaatccggcctgtcagcagctgcacccctcaggtaaagacctacttggaagatccacttggtagtgtcatgagtcccatcagttttgttttcttctctatctgcagataccaactattaaaatcactgaatcatagaaagcaattttgtattttatgcctttgtaagatgatatgttcaatttgtggagtgtaattggtatattttatataagtatcacctagtgacttgtgacacattagattaaaatttattcatgtacagaatattttaaagagaatgttttaggatgctccagaaaggaagctggcatcattttgagagataagataaatttaattaggaaaagttaaatgtcttcgaagtggggctgtgattctgaataagccgaaaagaaaagatggtgcttgaaagctagaactctggttaactgtataatttatatgtgaaaattccttctggacttttacttaaaaaatatatatatatcagttgtattcatttgtatacttaacaaggaagttgtggcctgtgccattttcagagtggggattatgttgctgttcttcagtgctgcatcttacctgggttcctagacaatgcagggtttaatgatgtagcagaaaggaagggattcttgtacgcaggtaatttgcctatgttctagctgcctcagtgagcatcctgtcttcacaccaattttgtccttagtattcaacaagagatttgcatctaactaacctttttaaaataattctctgtgcacaccaccgaacctctcctattctttaacacaacctccagacatggtaggaatccatgaactactgcataaatggtaaaatggatggaagggtgggcgattcctcttgtgaaaattgtatgtgattaatgataataatagctaatactttaatatcgagcttattatattccaagtactgttttaagctttttgaacaaccttacaacatcctcttgaggtagattctttattgctattttatagattgagcaaaatgaggcacagagagcttaagtaaccttcctgaggtgatatggctggaagggcaaaaccaagattccaaactaggcagtcttctccagagtgcattctcttaattgcagtgacaagacataat

SEQ ID NO: 131484 - DNA, 2390 bp, Homo sapiens
aacaaatctttcttgaataaagtaaaatgagagaggtggtttccaaggtcttttctgtaggtggtactctgtagatcaagctaagttaggttttttttttttttggatgggggctagtgcaaaatatggatagaaaaacaaatcagcagacagtacctgtttttatttatttattgttttgagacacggtctcactctgtcacccaggctgaagtccgtggcatgatcacagctcactgcagcctcgacttcccctgggcacaagagatcctcctgccttagcctccagagtagctgggactacaagctcacgccaccatgcctggctaattttttatagagacagggtttcaccatgttgcccaggctggtctcaaactcctgggctcaagtgatctgcccgccttgacctccaaaagtgctgggattacaggtgtgagccaccacaccaggctgacagtactgtttttaaagtgtttgttaaggagttttgcttttgctaaagaaaaatgcctttttaattaaatttgatggaaataaatttaccttattggaatttaaacgtgttacaaattaagatttttggttaaaaccataatttattttagccatcaggtttaggaaataaaagagagctctcagaaatatatttaaatagttatatgaaacaacaaaaagagtatgctttcctttggatatatcagggtttcttgaatttgaataatgtatgggtctctcttaaagggaagaatttggagatcctcagtattaaatttctattgtaacagttctaaatacatgtagacataatgttaagttcttcatgcttcttgttattacacaactacaaattcaaatcaaattttggaattaaatataagcaaagctttaaaacaaaactcaaatgaacaatattaattgaatgtgatagatgaaactgaattatcatttgtaacatgagagtgaagtgggtagactcagattttttaaatttaatttttgaactaatagtacattcacatgattcaaaaataaaacgttattaaaaggtgtagagcctgggcgcggtggctcacacctgtaatcccagtactttgggaggctgaggcaggtggatcacctgaggtcaggagttcaagatgagcctggccaacatggagaaatccagtctctactaaaaatacaaaaaaatagttagccgggtgtggtggcgggcgcctgtaatctcagctactcaggaggctgaggcaggagaattgcttgaacctgggaggtggagattgcagtgagccaaaattgtgtcattgcactccagtctgagtaacagagcaagactctgttttaaaaaaaaaaaaaaaaaaaaaaaaaaaaaaagaggtataggtcgaaaagtatcactcccctgctaaccctatcaagtttccactccccatctctcctccaaatcagataatttcatctgttcatttctcctatatccttccagagtgtctttatgcatatgcaagtacctgcacacagatgtgccccttaccttttccatttagcaattggagatctttccattgcaggtcatagctttctttcatttatgaacctccattgaagatatgtctcctaatttagttaaccagtcccctgttggtggacattttggttgtttccaattatatgtaattatttatcgtagcaagtaattctgaatatattttatttcagggcaggtttttgagttttgcattcttagcctgtggtatgctatgtgattatggggattcttccaccacttttccctctcagaactctagctaacctttgtgtgaataaacttggcctcctcattcactcttcacttggctaacacctgatttgcctgttaaattggcctcctttttttgcattggcctatacattcaatttgagaaacattgccttatagattattatacacataagattgtcactgcttgctgaagaaaaatagaaaattgttgaaagaattttgatgaggtattaatatggaatataccattacatgacacaatcttatttacttttgaatatcagtgattggaaatgaaggtttcttgtataccttttaacttttgtttatgtttaggggcatggtctgcatgggataggagaaactgtccatgtcccatttccatttgatgaaacagaactacaaggaggtaccttttgaattgtatctattgacttttttttttttttaattattactcatgtcaacagtttggtggaaaacatggcaggaaatgaattcttgaaatttttaagttctaggttctttgctactaaagagtgttggcaaaaggtagttttttgtcatgtgctttgccatccacaaagaactgttagaataagacccg

SEQ ID NO: 131485 - DNA, 1568 bp, Homo sapiens
agtataaaagtagttctaagagttgtttaataaagtatgtttaagctgttggcgttgtgttattagaaactgttcattaatgtgatgtccgttctgtttgtagagttcactcgtgtcaatatgggtgttcataaagcattgcagatactaaggaacagagtggacttacagcatctctgtggatatgtcaccatgttgaatgcttccagccaacttgcagatagaaaactcagtgatgcttctgatgagagaggttagccaatagttggattctttggattaagataattggttttgagtttgacacagtgttaatatatgaaaagcagcagacctttgtggggatgctgaattattgaatactcaatattctttcactgaagcacgaggaaatattttggaacatcatttggacaaatgtcagttgttcaaatgaagaaaataggattggggtacagaatggtttgggacttttgggtgctctactgtcatatctgtgtttattaggctttattaggttagctttatagggtgatggtttcaaaactcaagtctctttatacaagtgtttccaaaattgacttaatagtttttccctttcaactttttctgtcaaaaggtaccattgtcttaattatctaggtctaaaatcttacctttgtctcattctttcctttttccactatgttcagttagtttccaagttctgtgaattaggctttagataagtctctcatgtccatttcttcccctttctcttcattttaaattctctgtgactgctcttcttgtctgggtcttgaactttaaaccttaaacatgtgctgttgcaaccattccctgcttagcctttctggcctctcctttctatctccagtctgtcctacatattgacaatagctaattttccttagatatcacttactttttttttttttaatttgaaaatccattttcaaatcaccttctcatgcttactagttgtttctgctctggcataatattggcatatatgtggtttgggttgccgtggtgccagttcttatccattgactctgggagatctttcattatctcccattgattgacagtattccatgagcctcttagtttgaaattctgaggaaatgtgattgattacttgccatccagtagattgggttggctcccattgagataggtacttactcctatctcatttgtctttggccaaatagttgactgccaaatattgcaggagcattttctagagaagagggctatgacttaagcagtcatttcaaagcgtatctactacagctctccttttttatgtcattcattccacaaacatttatggaatacctgcttaggtgctggagcaatttaataagaccaggccaggcatggccaggtacaggctcatgcctgtaattccagtcctctgggaggctaaagcaggagtattgcttgaggctagcagtttgagaccagtccgggcaatagagcaagaccctgtctctacaaaaaaaaaaaaaaaaaaaaaagaaacaaaaaagacaatgttgttccaaggatgaaaaccctag

SEQ ID NO: 131486 - DNA, 1058 bp, Homo sapiens
tgatttattggcagcttctgctaactgctagaatcctaatattgtgtatgccctttaattataaggagaacctgatttggcttctggctcagatgtaaatgggagtacagagtcatttgaaatggtcattgaggaagcaactatagattcagcaacaaagcaaacctctggtatggtgctaaaactttttccaattttattagactaatttctgaggtttaacttttatgttaaggcatttgcatgccatttgtctattcttattattcatacgacttttaaataagagttttctaggaagcctttttacatacttagaaaaataattcaagtattataaaattatgacttgaaaataatcttattcctgtggtaaatgttttgattcattctctcatcttacagatatcttgcaatactcttttttgggcaaatgactactttgaacattggatgaaagctatgtaccttctcagacacatgtttataccctaaaaatgcctatcctgtttagagattaactgacccccttcaatttcttcctcccctgccaagcccactggtggatatcagtggggcaggaggaatctatgaacttcaggttaagaaacccttgtcagttatatataatatatacataagtagatatatatgataaaaaaataagtttatgtatcctttcttaggtgccacaacagaagcagattgggttcctctcgagctgtgctttggaattccactgttcagttccgaattaaaccggaaagtttgtaggaaaattgctgcacatggcctttgcagaaaagagaggtgagggtttatattcgctgtcatattttcatatcaatttttaagctgtcagcaaatagttaccatatcttacttttattccacacatgagcacagtaattgttctgtatatatttgttgattgaatagagatcgctagtttaagggttttgctgtatttttcaaaattaaatttcactagatcagaaattagtcacaggcaaacattttgggcacatgttttgattatatttatttagtaatctagg

SEQ ID NO: 131487 - DNA, 3504 bp, Homo sapiens
tttgcacatattaatacctgtcattgattgctttgggctcacagtgtagatctttgcatctcctgtactgctttgcaatccataaacacttctcaggtaatcaaggtctctctttctcattagttatattaagtggttttggtaaagtgttgaatatcatttctcttgtttcttgatcttttaggaaggtgcttcaatattggatattcacacagagcccagtttttcaagtttgctttcacagtcatcgtgtgctgacatgggtgttccacttcctgcaaaaaacttaatatttaaagatggtgtcttatcagaatggagtggacggtcaccttcctcacttcttattgctaatctccatttgcaataatttggttacaccatttgttgctcacactttctgccttttttctttcttaacgttagctttatagtgtcagccactaaaaagcatcctgctgctgcagtgcaattcttgcttaactaatattaaaagttggggaacatattcatgttttctgaagttttgctcattattgcacatcttattgcgacaaagtgctttttagcagccagcactgtattttttaccttgagacaatctgcatttcttttataaaactaagtatatactttataggctttatgatgactgttatgtttataagcagtcactatgaaaattgcaatggtaattttatatgttagtttatcaaacataaatcttgtttaattttatattttgttacctatactttgggggatcaagggaagagatggaactcttcctctgaaaaggcttcttggtacttaaagtagtaaaactataaaacaataaacatccagtattgagagatgatatgatagggcattatgaattcctatgggtgtctgtaaattatgtatgtcagttggacattgtagaaggtatgtaaatcagcatagttgtgtataacttaaccttgatttataaggtcttaagattatgactattcattgacatctcatgagaagctttagaagactttctatttttaaacaccatttatatgtggacttctgttgtcactgactttgggctttatattttcatagagtctttatggaaaaaatagaatttattttccactcttgtagctatagctgctgcacactttcaccctgatttatttttttgtttcttagctttgatgttttcaaaccaaggattgtgattttaggttagaattacatattagaagcattaagactatgtctttggatcagaatgctttagtgataaacctactttgaagacatactcttaagcaatctggatcttaaatttatgtgaatacttttttagaaaatgataaagaaaaatggaattacttcaaagtgtttcttgagtcattgattcttttagcatctcaaatgttaattagaataattggaatcactttttagacttttcaagttaccttccttgggaagtttgtgcagtgttatagtttagtttagctcctcttacagggtaatggtttgctagtttaaaactgtaaccaaacgaactggtcagacaacatatatctaaaacacttaaaatgttaggaagtttgggaatgttataacctaaacgtttttgctggtaactttttgttatttatagatatttgtgtatttaacatacatacttcaggaaatatatgcctttcctaaaacttaaccatgcattcaataccatggcctatctatagaattgaatattttggaccatgttatctgtggcacagtcagtgctgtgtttgaggtaaatgcagtaacggttagttttctactttgtcttatagaaggtagaaaccatgtgtatgttatgtttgtctataaaagaaaaaatactaatattaaataatttcttacgactctgagtcactcacttatttttccaataattgatattgtacattcctagtgccattaggtatgtatgtatgtaacttttacagtttttcagctgaaagttgtaagtattttttttttttgatcggggctctttaatctcattttaatttcctttgtttgaactgtagttattttatttattcctatattaaccatctaaaccaactgtaatgacatgtacactaatacagaattgaacatttgtagttgttggcagtgaacccagttgttggtgaatttaaagcttaaaatatgggaatgatttgctgctatatttcctttgagagagaaaggaggaagaaatagaacctaatagtgatcatgaattttagggaaagtaccgaagaaccatggggtcccctctggtttcttgtgttgaatgaggcaagggtaatcatctgattccgagctgaagacctctggtcctcttaaggagggagagtgcatttttagagcttttagcaaaatgtgaaaagctgatgtttgcgccttgctttgtgaatttggctttgttttacttatacattaactcatgtaatctcttaaatcttacaagcattgatccatttcaacaaaaaggtaaatttaaaatgcagactttgttatttgccaaagaagattcatgaaaaatttacgtccaattattttgcaaatagttaatttcatttggctttttaccatgttccttcctttctttttcccgcttccttaatgtaatttaaaccctggcaaacattctttagaaaccaagaggaaagaaagaacaaatatcaaaaaagacatagaatttaatattgatacaatttcacctctaaaatggatttgaagaaatgcaactttatatcaaaaaatgtcatctgatttcctttgtttcttttttaaattatgtaatcagatgattttatgtttttttttcaggggagcggaatattggtttcttttacttgttgttttcagttttctctgccattcatgtttcttttttgtgttcagtgtttcaaatacaatttgtatttaaggattttaaaataccaaactgtaactgagtacagtggatcgttttctgttaggatgttaatattatacaatgaaatctataaagtgttgtcaatttgattattgacacatataacatgtttacaaataaactgtggtattgatcaagttactatgaaaatgtgtttaattttctgaaagttcctgtcttaattttaaatacaaccatggtttggtgctgtggctttcctgtacttaaaaaaaaaaaaaacccacaaaaaacttaattattttgtagtaatttcagatttacagaaactggcaaagatagtcagatgttccctgtacccttcactgagcttcccctagcgtggacaccttctgtaaactatggcaggtctatgaaaactcagaagttaaccctggtactagtattttctaaactgcacacttgattaggcttttaccagttttcccactaatgtctttttgttgtcaagatccagtccaggataccacatcgcatgtatttagttatcagtgtctcattagtctcctccaatataa

SEQ ID NO: 131488 - DNA, 1011 bp, Homo sapiens
ggggctcaggatggtcactatatttgtagcttgtaacagtcctaactggaaggttgactaagttgaaaccatataatctcattcataaaatggggatacttaagctgaataatttctgagatccttttagtttgacttagtttaaattgtttgattttaagaggagaatgagaaattcaaattttacacaggtatttctgatccatttggtcttatatccacaagatagacatatggacttcgaagaacttcaaaaaaagaacaggtttctacattatctagttgataaggataatctaatatagtcccataatgcacaacctcaattattatataaacacttaatgagaaaatatatggctaccagtgtctagacagggtcctgctcttttcctgtttgcaataaagctgagaagaattcatatacataagaaaaagaacacatggaaaattgattaaatgccaaagcagaagtaaaaaatggtatgagactctagaggaatgaacggaagcatttgacttgcaagaatgaggaagctgactcagaagatgggccttagagaatgaaaattatttctgttctattagagagaatggaggaagtgattccaggcagagggagcatgcgagcaaaaacagggaggcctggaaacacatgacttattcaggtcccagtgaggcataagcagaatgaaggggttgggtgatgaaaatactggcaaggagttaaatattaatcagattatggagaccttgaaggtcaggtaaatacagacacataggcactaggggaattacttgtttatatctgtatttaattatacatgattattaccaagtggcattattagcaagaggaattgatttgggtgagactggaggcagaggccagtcagagagatctgttgttttgggagagttatactgtgggcccaagctgggggaggcttgagcatgtgtagagggcttcagagtctgttacgccttcctgtacagctgttactatcataa

SEQ ID NO: 131489 - DNA, 1638 bp, Homo sapiens
tgtgtaatccccttcccatgaatctggtctgggtttatgacttgctttaactcatcaaatgcagcagaagtgacactgtgccagttctgagccttaagaagtactgtcagcttctgctttggtgcttccggatgctgtgatctgccatataaaaagtctaattaccttgctagaggggctatataaaaaggccttagaaaaaccctgccatctcagcatctcagcggagcccagcccccatccaactcacactgaattcagccaattagtgatcatcatcaagatcagcagaaaccttatccaactaagcccagtctgaatatcagagagtgagcaaatacaaaggttgttgttttaagccattaaatgttgggatggtttgttacacagtaatagataagtgaaatagacccaattaaaatagttgatccataagcatataacaaaactcattataacaatatctcaaaagcataagaagaaaattctttatggaaaataaacctttggtttcactgaagttaattgactaaattaactcaaccacaatttgagcataaatcacaattgaaaagactgactcggcagagtaaatggaaaaggctcaaagagccgactatatttagcatctacttgggtttggtgtgggatgcaagtgagttttaaaatcaggaaaaggaaaaaaccatcaagtcagagtagagcctagagatttgtttatgctttctcatgccagaaacttgagatcgctttccttctttgaggaagaaaagtatgatttgtaattttgcacagctgagaagaaatgtttccgctatccctccaaacctcactccctgccttccagccacatacagaaccaatgcagctcctcaaatgagcctctctgctttgttcatgttattcttcctgcttgtgttctgtttccccatccatccattaactgctaaacttcacccacttcacccacttggaaaatgaggtgaagcttccacttggggaaaatctttctgacaactgtccctctgtgccctcaagtaggctaatcacccctgccttgggacaccactgtactttgttttcacctgtattctttggctgtacaattattaggatggtttgtttgcttgtcctttactcctccttgaccataaatttctactagagacaggaagaaatcctactgagataagtatacgtggcatttattacatgcttataatgtggcctaacatcagtggttttcaaagttttggttgtatcaagggtgcctattaaaaatgcgtatttttagctgggtgtggggactcacgcctgtcatcccagcactttgggaggccaaggggggcggatcacctgaggtcaggagttcgagatcatcctggccaaccaggtgaaaccctatctccaccaaaaatacaaaaattagccaggcgtggtggtgggcacctgtaatcccagctacttgggagactgaggcaggagaatggcttgaacctgggaggtggaggttgcagtgagctgagattgcgccattgcagtccagcctgggcgacagagtgagtctccgtctcaaaaaaaaaaaaaaaaaaaaaaagcatattttcaacaaccagccccagatagcctcattcattt

SEQ ID NO: 131490 - DNA, 1829 bp, Homo sapiens
accttgcctgtgactttagaaagggcttttgattattgttttttcttcttgctcttgaaagtaatctggtcccagggaattactggtttaactgaacatctccagaattatttaaggtgtcaaaatatataaccttcacattgaaagataattttaatttatgggcataataaaaatttgaatcattcaggtaattttcaaaaaatggagaccatttgtctttaactgaaggtatatgtttaagatcatagtctaccctagtatggtgctttgccacaaagtgatttctgaagaatggttctttttaagataatgacttcatatgatcattgtttcatgttacttgccacaaataactttaatttaggttgaaactggaactgtttgtttctcatattagctacttctctattaggagcacaagaaccatagttaaatgcaacatgagctactttagtcctgtttgtttaaatttgtgttgtccatgtattatgatttattaacttgttgatgcatgtaaattgggtgcattttgttgccatgtatgttaaatggtgaccaatgtttttacaaaggaattgaacaaaaaaagtatcttttaagaaatttggaatgtggttttgattttgaaatttgatttcttactaatctcagagggccttggtatattctgttactaaagcaaacaggattaatgaatacggatttgttacaaggtggcagcaatgtcactgagatagtgaatggaacaatttaccacctccctggaatctgcacctgagatacaacatcagcgtatgagtgaagagtgagcccatagaaaagctttagatagactcacataagtcacactgatgggtatttacagcagatatatccaagctgtttatgtaatagtctcatttactttattctttttctctagaacataaattttgaaggtaatggaagtttatcttttataccaaaagtttgtatgagccattttgaagtaaatctttctaattttagaattatattttctcgccatcttaagacagtatattaaatataatataacctttttcttagtggctaagcattatctttatgtatattattattgtgtggtaatgcagtaccttgagaatctagtttttatagttttcatttttttttctgatcttgcttctggcaacttttatctctctaatctgctttttttctcagttgtctggacttagaaactggttagcctatcttaccataaattatttgggaaatactaaaaaattggctttggatcctgactgagatgatgatgatgatagtagtagtagtaataataatagttcccttttattaaacacttatttggtcctttatgcactagtaatttacacacattattgcatttaatcaccttaatgacaacattaagttggggctattatcattatcatctctattttctcatagctaaattgaggcatgaagaggttagtttgccactacgaataagtggactggaatcctattttgtccaagtatgaagcctgtcttcttaactgctaggcagtagggacatcagttgcatgggctttgcaatgtctgctctctgcctaggttcctttttacctccagattcatggagtcattttcttatctataatttaagaatattgtgcttacaatccaagattcatttaagaaatcttgtgttctttattacatactatgtgctaggatgttcaaggcactgagtgaacaaccagaacatctgtaccctcatgaagcttattcttttggggtgggtagtaataggggaagagaacacagaaaagcaaata

SEQ ID NO: 131491 - DNA, 1050 bp, Homo sapiens
atgaaaagaataaagtttatttaaaactacgtgaagaaggaccttattacaatgctgctagtgttctttcttttctctattatgataggaataaatattcaagaatataccaaaataatgtaaaacaagttgggatgttattataaagatggaagaagtgaattatttaacagtatagtgaattagagtaggttgtaaattaaagctaaatatgaaacgtgatttgctaacaactggcaagttatagaatagtgtttctgagagtaaattgaagaagccacaaattagtaggagatcattatatactagagagcaaatttatataatttttaaaaaaacctaatggccagttattttttctctgacaggtagaatgtaatttatattagagattagtaactttcctcaaataccaaaacaatttaaaaattctttaacacttgtgttcccaagtaatttatgattctcccaccttagattcatacaatctatagttcataatactgtatactattatcattttttgtaggtggtattgaaatttactgtttgtatggctgtgttatcatacctaaacccctttagggctgggaaccaagtcttatttatctttgtatctcaggtgcccagtggagtgctctgtacatgtttatttaactttttgaaaaactatattttttccttttagttaaaataaattataatttttaggacatatttatataggtataaacactaaaaacatacatcgtatagttcaaagtgattgtttgtaacagagtgccttggttttactgaccaagtttttactaagatagcaattagtgtaatcttaacttaatgggcttatcacctaattttaagatatttgtaactggccagttttagagatgctattaaaagaatcccaaaatgctaattaatcctaaccagtttcatcattatttttcagtacttaagtagctttctcttcactgtaaatgttttatttagtgattttttagaatttcattatactcttctaacctgttaaatttgtaatgtgtattg

SEQ ID NO: 131492 - DNA, 1143 bp, Homo sapiens
aggtatatgttgcagtaattacttttaaatgctaaataaaattacaagattacgctcaaatgcctttatgggttttacgtaagacatatatatttagaaataattaaaaagtccttttacaattaaaatttctgtttaaaaagacaggttaattaaaatctactaaattaaaagttaagctctgctgtttctaaagagcttaactttagaaagcttaacattcatttttcaattttgaatgtcaggttttgtaagtatataacttggccatattaatttgtttctttttaaaaaaaacactgctgtgttgctttataaaccacttttggtgcacgttagactttttggcatttgatttgcttaaattattttacttataacatggtttgcattttaagtttgtattctttaatatgttgtatatttattgtaaattttaccttactcatttgaacttttggttctattaaaggactaagcagttattcataatgttcagaattgtgggtaactgagacccttggtccccaaattgttgctgaaactcactagtttaatatctattattttcataaattttctaattaggccagactgtgatttgtgttgtcatgtctacttcctgcacttttgtgggaaagatattagggtgagtttggaataaatattaggtggtcaaaggtcagcaactgcataattagacacttaaagaatactgagttatttgtaataaaggaatagtatatgcattaagctgttccttttctgtcatctcagggtgaagctgctttggtacttttcttattaagtttattataaataatttggatttttaccttcatttgtgatttttatattgctttttacatccatgataataggctgaaatatcacgttaagagtcattatttccatgaaagcataataaaaaaaatagactaggaaataagactctttctttttcagattttcttttatttcaagtatggatttacacaccctgtaaagtgtgtgctatagtttcactctgtgtccccactcaaatctcatctcaaattgtaatccccacctgtcgagggagggacctggtaggaagtgattggatcatgggggtggtttcccctatggtgttctcatgatagg

SEQ ID NO: 131493 - DNA, 1169 bp, Homo sapiens
tttgattttctcctctttattttaacttcaatttttttttaaaaaaaatgtatctgaaggggaattacattttatgaggggaaaaaaagcaatttgaaaaggatattagtattttagctaattgcagttttatttcaatttcaaatactaatgaataaccagtgttttgacaatgttttatatatgcacatacaattgattcttggttcttccatatttttctattgagaatttattaactgaatgagaagtagaatgggaaaatgagaatctgagttctggacctagctgtgtgtctttgagtaagtcacttaacatctgtgggcctaagtggctacatcttcaaagtggagaatgaagtcagtatttcacagtgagtgtgcttctggtatttgggctggataattctttgttatgaagtactctgttgtgcattgtaggaagtttagattccttaatgctggtggtagcatttcccagtcattatcatatcccagacgaccctgcatatccaaacctcttctagtggggagggaccacttcatattgagaactactggcaaatggtctctaagaattctttcagcttcaacattctgtgaaagaattcttatttggggcatgattgaaaaagaaggtaatatatcatacaccgaaaaacctctgctgcttcctggatacgaaacaattttattttaaaatgaataacttttacgaatctgtgtagccctactcacagatctaccatttatgatgttccaagataaattattttattctagcttgccttaggctttttctctacagtattatccatagctatatgattttttaaactaaaaattatatagtaccatctctatatctaataagtaaaagcaacaagatttttttttaagttgtactattgttttaatatcttagcctttaaaaaaggaatatcattgtatatagtaattattttctttatcttccataggcataaaagaagggaaggaatataattttctgtgtttagaagtatatatagttgttgaagcacacaagttatatgtgtgaaactacaggtcagtagtatatctgattatccttaaaaaaaaaaactaccatgaaatgcaataagaaaaataaattattggccaggcacggtggctcacgcctgtaatccc

SEQ ID NO: 131494 - DNA, 1094 bp, Homo sapiens
ttatgcatctttgacaggagtatcacaggattgatgttatattctttttcatcctatcatttggcccatgatttcaatttgtccttggtgatgttaactttggacgtttgattaacatggtatctatctgacttatgcactctaaagttactgttttcctttttataatttataagtcttttgtgaagtgatactttgagtctatgaaatatcccattcattttagcaatttatatcaatatattctattcagtagattataattcattactatcatttttgatcttccagctaccctatatgtggccagtgggaaccccttcaagctggtttctgtgtctttttgacgtgtcttcattactctttgaataattcctggcttgaatactccacaagatgttccagactcatcttgcacttttgctgccctagccttagaatcagccatttatacaagagactctttttttttctcagtgtagattagtatttagaaaccaagatctgggtgttaggtgtgctcataactattaggatgttgccctaagagtggacagagctagtaaataaatgaatatatgtatttatatataaaagctatattatttatagttctatgtgtctttatgtattataaagattcattacagtttcttcaatactaagctaataacacagggcatgttctagttttctcactttccgtatttctaactccattctctgatggagaaattcctagctcctattatttttaatatatttatttatttttcaccactgctcctgtcaccaaaatcccatcaccactactgcccacatattcctatacagatgccctccttgcaccaacttgggcactgacaccctgagccacaatcccttccccttagtgtgtggaagcctgtctcaaccaactggttcttttttttgtttttttttgagacagagtctccctctgtcacctaggctggagtgcagtggtgcgacctcagctcaccacaacttctgccccctgggttcaagcaactttcctgcctcatcctccctagtagctgggattacaggcgtgcactaccatgcccggctaattt

SEQ ID NO: 131495 - DNA, 1118 bp, Homo sapiens
caagtcactaaaaccagttcagattcaagggaagggaaattaaaaggaggacagaaaggtgattccttatcagactcttcacctctctattaaataaacttttgggtaattgttttccttgattgtgttgtctcttcacttctaaattcttgactaaattgtaaatattagaaatttgggaaatatggcttccaggtaagtcaaacacttatatgtatagtttaatttatcagtaattaatttgctgtttttcaccttaatagtcatttattgcctattttttatttgtgacaaattgttatgatcaaatttgtggataggaaaattgaagtaatataaagtcagcaatttatagggtcatccagagggtcaggtggaactacagatcacgatcttgaaagtttgagatgatgtgatattttgccattattagtggagattgttttcatttttctaaaaatagtgatgagtttgcataaccacactcttgtctggtttcctttggtgtgtctgggtataaaataacttgaacaaatagggactaaatccttgagtgtagattttattagcatcttgcccaagtcatctgaattagttagtatgtagctttacaggactgtagccttgtctttgactcacaggtttatgtctgctttaagtaaaggaaaacacataaaaacaagtagttatatattaaaattacctcagacagacaataagaggtaagagtaaataagaggttcttgtagataaaagactgtaggtaacaaaatcatttctcctaagctctgagacatttactttgattgcttttgatgataaaatatttgaacatattgcattttttatctgccttagtaaaaatataatgagcataatttagcttctaccagatgtcggagtccttatatactatattttaatacaataagtttctttgaggttacttctatttgtagacatgctaatcattacaccaaatgcctccagaacactgctgtttcagttggcatgctttttagactctgtcatagtggtagtgaaatgtgctgggcttagtctgcccctccctcctcctcagtgctctcagacttttctactctattctcattcattcc

SEQ ID NO: 131496 - DNA, 1052 bp, Homo sapiens
tgaggttggcttccacattatttaaggtggtgtaattaatgctcatcagagagtttacacagagagacaagaactggctattggagaggtacaatgagagatatgttttgaaaaagggagcctcttagggaatatttttgttataatatgtatacttaagatatttaaaaaatgagattgtttttacatatagcaaataaaagatgtattgaggtgaacagagcagtttttctatcaatgttaggtctcaattagcttgcattttttgattactctatgtgagtggtaattgtgtgcttttgacattttttaccatttatctacgtctgtatacattaaccaaataattctaaactttaatcttgtagtcccccattttttgtgattgtttaaggtagggtgaagagctttgttttgagaacttgccatatagtataagaggacgttgacaaaatgaaagactgaaagataaagagcttatactaaattgagtatctaaaacacttaaaaataaattaggctttcttatggaatccctgttcactagagatcttggacctttaacaagattatccttattttttttcagcccattgctcaggattatgtgagaaaatagaaattcttttcttaaattttttttattttttgagacagagtctcactctgttgcccagggtggagtgcagtggtgcgatctcagctcagtgcaactccatctcccaggttcaagcgattctcctgcctcagcctcctgagaagctgggattacagacatgcaccactgtgattggctaagttttgtatttttagtagaggtggggtttcaccatgttggccaggttcatctcgaactcctgacctcaggtgatccaccgagcttagccttccaaagtgccgggattacagctgtgagcaccgtgcctagcctaaatataaattattttaagctatgagcctctggaatggattgggaatagtttgcttttgtccaataagaaaaagggcaagaaaaacattttatactgcaaataaagatacgtgaataaaga

SEQ ID NO: 131497 - DNA, 1049 bp, Homo sapiens
ccccacgcctgggacggctgggggcggggagactttccgccgcccgagtttcccccaggcaggtaggacgggcgcgggtcgtgccaggcagccgaggccagcgctagctacttcctccccagcctccgaatccggagcttcggcctaaaatgccagttaacgctgttgggattgagttttgatttgccccgtgcctcccctccccagccctcctgtcccttagcccttgctgctttcttgcgagcgtgcacccgtgcaggtggcatgctgtgcctgctccgagaaagtgctgcaaacccgcctggcaggaagaaactttttgaacggttatcaaatgaagacgtatgggtgggtagccaaaagaaggggtgtagcttcgaaagtcagggatgctcatagctgcttgtttccacacatgtctgattgcgttaatttcagcagccaaaggaaacattttctccagaaatggaaagacagattcaagttaaactccagttttggtttttcccagaggttgaaagaatgaaataaataaggaggtatattttttggaaatctgtggctctgtagtaaaagtcagactgatgctcaaaagtaattgggaatgatgaaagcaaaacgatttttaaactagcatgttaaaataggatatttctaaaaggagtccagaatggggtagggcagaatttgagtctaggtgaaaaagctaaaagttcagaaaataaaaaggatgaaaggagcaaacgactaaaatggatgtcttaaaatatttctgccacttaaatacagttatgtaaacaaaacacattgcttcagtttgtattacattctgatgtgtttgaaagttttaaaaaagtttactctcctctctaaacttggtaggtacataaacatctcatagattccaaagtgtagagcacattgattcggatcatgccatttgatttgccagacttgaaagtatatctttagctgatgtgcaggaatggaggaaagaattatctacctcatgtaagcaggacgttatctgtactacttcagaaacttgt

SEQ ID NO: 131498 - DNA, 1049 bp, Homo sapiens
agtgtaaaaccatttggcagtatcaactgtcatttacaactgacttctcagtgttttgttttgtttttgagacagtctcactctgtcaccaaggctggagtgcagtggcgtgatctcagcacactgcaacctccacctcccaggttcaagcgattctcctgcctcagcctcccaagtagctgggatgcctggctcgtacaacttttgactcacaatttcaattctagggaattggcctagagagatagtttgcttaaggactatgggcaagcattactggaaataacaaagcaacaaacttaatctaaatatgtattgatacaaatctgttcattgtattaggtctagccatgcaataaagttcttgaaagaaatgagatagctatttttggtgccgaaaaagacttcagaaaacctctgaagtgaaaaaacaaagccgaagtaattatcactggcagaggaatagacagagatttctcaacagtggcagtattgacattttggacaggataattctttgtttgcggatgggagctctcctgtgcactgtaagatttttagcagcatcactatcccctgcccattagatgccagtagcaccttgcacccccacaccccagtgtgacagccaaaactgtccctggatattgccaaatcatggttgagaaccattgggatagacaaatagattagtacttagccttatttataattacatagcccagaaacagacaccaatgtatatatagaaataatgtgtttcagagatagaattgaagtacattgaggtaaatatggactgttgaattaatgatcattttgttacacctttggaaataaattatactagatgtctaccttatgtcaatatatagacagtcacttctaggttgagcagtgtagtgagaccctgtctctgcaaaaataaatatttaaaataatagccatacttggtggtgggtgcctgtagtcctatcttactcaggaggctggggtgagaagatcgcttgggcctaggagttcaaggctgcaagtgagctatgattgca

SEQ ID NO: 131499 - DNA, 5133 bp, Homo sapiens
actacaaattcatcttgaaaataatttagtaatttggtgccttggacagctacagtgttacttgaaatactttggaaattagaaagtaaggaatgaaattttaaagaataatttagtatgtttggtctgttctcctgaactctgactttacaaaacctttattaccctttaagccttagttgtcttgaggcttaatgttcataactgaaaatattcatatttcctaattaaaggaagaatatcataactcttagtggggaaacattcttacaaatacttcattcaaatgactttttctttctttcttttaggtgtatttgcatccagtattgttctgatcttgtcacaacgatcacttttcaagttttacacgtacagctcagcctttctgttagctgcaacttcagtgttggtgaattattatgcttctttgcacattgacttctatggtgcctacaacacgtcagcttttggaattgagctgcttcctcgaaaaggtccctcgctgtggatggcacttatcgttctacagctaacatttggaattggatacgttacactactccagattcattccatctattcacaattaattattttggatctcttggttcctgtaataggcttaatcacagagctaccattacacatcagagagactttactgtttacttcttccttgattctcacattaaatacagtgtttgtcctggcagtgaaactgaagtggttttattattccacacgatatgtttatcttttggtgaggcacatgtatcgaatttacggattacagttattgatggaggacacatggaagaggattcgtttcccagacatactacgagtcttttggctaacaagagttacagctcaggctacagtgttaatgtacatcttaaggatggcaaatgaaactgattccttctttatttcttgggatgatttttgggacctcatttgcaatcttataattagtgggtgcgattctacactaactgtactgggcatgagtgctgtaatttcctcagtagcccattatttggggcttggaatattggcctttattggatcaactgaggaagatgacaggcgtcttggctttgttgcacctgttttattttttattttggctcttcagactgggttaagtgggctaagaccagaagagagacttattcgcttaagtagaaacatgtgccttttattaactgcagtcctgcattttatccatggaatgacagaccctgtattaatgtctctcagtgcctctcatgtgtcatcttttcgtagacattttcctgtgctgtttgtctctgcttgcctgtttattcttcctgtcttactcagttatgttctttggcatcactatgcactaaatacatggttgtttgcagttacagcattttgtgtggaactgtgcttaaaagtaattgtttctctcactgtttatacgttattcatgattgatggctactataatgtcctctgggaaaagcttgacgattatgtctactacgttcgttcaacaggcagtattattgaatttatatttggagttgtaatgtttggaaatggggcttacactatgatgtttgagtcgggaagtaaaattcgggcttttatgatgtgcctacatgcatattttaacatctacttacaagccaaaaatggctggaagacatttatgaatcgtaggactgctgtgaagaaaattaattcacttcctgaaataaaagggagccgcttacaagaaataaatgatgtatgtgcaatctgctatcatgagtttacaacatctgctcgtattacaccgtgtaatcattatttccatgcactttgccttcggaaatggctgtacattcaagatacttgtccaatgtgccatcagaaagtatacatcgaagatgatatcaaggataattcaaatgtatctaacaacaatggatttattccacccaatgaaactccagaggaagctgtaagagaagctgctgctgaatctgacagggaattgaacgaagatgacagtacagattgtgatgatgatgttcaaagagaaagaaatggagtgattcagcacacaggcgcagcagctgaagaatttaatgatgatactgactgatgaaaatagcatttattaatgattgaggtatttgtttaaaattcagttcatccaaaatggagtaatatccttcaccttcagtgtgtaaccaagcacaaaaacagtatcaatgttgaatctgtgaatggttttccgtttactgtgatgtgctactgtaaatatacctctttaattacttctggtctctttggtgacctgtttaaatttgtgtacattattgtacatagaataaaatgttttcacatttttatgacaaaatttgaacaaatagctttttaatagatgtaatgatcatatggtgcgtcacctgtgccaaatattcttcaatgaaattatataatgtaactttggacctcagtttttctttagaaatgggtgggagaatgaaaatgcaaatcaggaaaccacattaaagtcaaggaaataaaataatttgaccagaggataaaggacatgagagagtattttaaaactaaagaaaaaattagctgccagaagcaactgaggaccttttttgaaacttgagtagcagtgtaattgagctgagtttgaaagtcctgattcagagagagactgagggttgacaaataaactgtatcaactaaactttgatataaaccagaatgtgctaaatgttttttatgtaaaattgtatatttgttagccattctgtgtctgcagtattgtcataaaattgtcctttcattcttttgaagatattacaaaacaaaaatagttttttttaaattgttttaaactaagatactcaatgatataaaaacatcctgatctgattttacgagaaaaagaaggggaatggtggggaatggtgtgtaccgatatatagtatttctttagacaacttgcagataatttctttattgaaactatcaggaagttttactatgaaattttacatacatgatggaaagtggaagacatataccaattatattccaggaaaaaatactttaatagtattgttatatagtgtattggctaattccagtggatcctcatctctcactgctgacattatctccaatatttgactaaaacaaaacaaaaacaaaaatggttaaatctccaagtatacatttagttctaaagctatataatatttttccacacaaaggaaaatattggcacacctttaatataataaagcttaacagttattaagtttttcagcaatatcaatagaaaaacttactgccagtaactggaaacagatttatggactgtcttgcatataactagagctaagaaccaggttcaagtaaattattaaagcagccatctgtattatgttcaccaattatagcattaactgagtggaaatgaagagtccttttcaattgtgagtcatagcatgttcattagtgggtcatgatgagcattttaaacattgacaagtacattgtactcaataagggtaagtactgttccattttttgttaggttttattatgtatgtgtgtcctaagtcacaacgtaatttgtactgtgggacagcagccacagttggaaatctactgctagagaactagtccttgagagacagcaaatgaaggtattaggttgctgcaaaagtaatatttacttggaaaaatgtgtggttattgagggcgagggctttctgtacctctacccttgcgagagaaataagcccaggtgtccatccttcagtttctttctttctctgtctctctcttccttcccttccctcccttcctttcctttctttttctttcctttcttttttttttcttttttctttcttttttgagacggcgtcttactctgttgctcaggctggagtgcagtggcacgatctcggctcactgcaacctctgccgcctgggttcaagtgattctcctgcctcagcctcctgagtagctgggattacaggcacctgccatcacacccagctaatttttgtatttttagtagagacggggtttcactatgttggctggccgtggtcttgaactcctgaccttgtgatccaccccacctgggcctcccaaagtgctgggattacaggtgtgagccaccgcgcctggccgcatctttcagtttctgtgcttacagtaatgatgatccgtagtgtctccatacttattatatataagtggaagatttttaatacatgaattagaaagttccaaagtccaaattgaacatttaaatattctttgcctaagctttttgttcccttagtatcttaaatgttaacacctaaaggaattaaggatggagatctaagattaatgggaatttaaaaaattgttttgtaatgtgacacaaaagccttgcttgatgtttatactaagcaaacactacactaaaattttatctgacagtcaagatacactaaaagcaaatctattaacatttaaattaagacagtgaaaatccatttttcttaggaaactactgaatgtccctctgtatgcacttctcagaattggaactcttgattaatgctgctgatgacacagttttgaaggtcacagcagctttgctaagattatattgcatagcaaattcattttattgaaatcgcttataagaaatctattgggctgggcccagtggctcatgcctgtaatcacagcactttgggaggctgaggcaggcagattgaactcaagagttcgagaccagtgtgggcaatatggtgaaaccctatttctagtaaaacaaaaaaaattagccaggcatggtggtggacgcctgtagtcccagctactcgggaggctgaggcaggagaattgcttgaacctgggaggtggaggttgcagtgagctgagattgtgccactgcgctccagcctgggcaacagagcgagactctctctccaaaaaaaagaaaaaagaaaaaaaaatctattggagcttaggacatcctattttactgtttgataatgcagtttatggaaatctttcttcgaataacccttctgtagccaagccatgctatttccatacatcttcagtggtca

SEQ ID NO: 131500 - DNA, 1068 bp, Homo sapiens
ttgtcataaaaatgtgaaaacattttattctatgtacaataatgtacacaaatttaaacaggtcaccaaagagaccagaagtaattaaagaggtatatttacagtagcacatcacagtaaacggaaaaccattcacagattcaacattgatactgtttttgtgcttggttacacactgaaggtgaaggatattactccattttggatgaactgaattttaaacaaatacctcaatcattaataaatgctattttcatcagtcagtatcatcattaaattcttcagctgctgcgcctgtgtgctgaatcactccatttctttctctttgaacatcatcatcacaatctgtactgtcatcttcgttcaattccctgtcagattcagcagcagcttctcttacagcttcctctggagtttcattgggtggaataaatccattgttgttagatacatttgaattatccttgatatcatcttcgatgtatactttctgatggcacattggacaagtatcttgaatgtacagccatttccgaaggcaaagtgcatggaaataatgattacacggtgtaatacgagcagatgttgtaaactcatgatagcagattgcacatacatcatttatttcttgtaagcggctcccttttatttcaggaagtgaattaattttcttcacagcagtcctacgattcataaatgtcttccagccatttttggcttgtaagtagatgttaaaatatgcatgtaggcacatcataaaagcccgaattttacttcccgactcaaacatcatagtgtaagccccatttccaaacattacaactccaaatataaattcaataatactgcctgttgaacgaacgtagtagacataatcgtcaagcttttcccagaggacattatagtagccatcaatcatgaataacgtataaacagtgagagaaacaattacttttaagcacagttccacacaaaatgctgtaactgcaaacaaccatgtatttagtgcatagtgatgccaaagaacataactgagtaagacaggaagaataaacaggcaagcagaga

SEQ ID NO: 131501 - DNA, 1444 bp, Homo sapiens
aggcatgagccactgggcccagcccaatagatttcttataagcgatttcaataaaatgaatttgctatgcaatataatcttagcaaagctgctgtgaccttcaaaactgtgtcatcagcagcattaatcaagagttccaattctgagaagtgcatacagagggacattcagtagtttcctaagaaaaatggattttcactgtcttaatttaaatgttaatagatttgcttttagtgtatcttgactgtcagataaaattttagtgtagtgtttgcttagtataaacatcaagcaaggcttttgtgtcacattacaaaacaattttttaaattcccattaatcttagatctccatccttaattcctttaggtgttaacatttaagatactaagggaacaaaaagcttaggcaaagaatatttaaatgttcaatttggactttggaactttctaattcatgtattaaaaatcttccacttatatataataagtatggagacactacggatcatcattactgtaagcacagaaactgaaagatgcggccaggcgcggtggctcacacctgtaatcccagcactttgggaggcccaggtggggtggatcacaaggtcaggagttcaagaccacggccagccaacatagtgaaaccccgtctctactaaaaatacaaaaattagctgggtgtgatggcaggtgcctgtaatcccagctactcaggaggctgaggcaggagaatcacttgaacccaggcggcagaggttgcagtgagccgagatcgtgccactgcactccagcctgagcaacagagtaagacgccgtctcaaaaaagaaagaaaaaagaaaaaaaaaagaaaggaaagaaaaagaaaggaaaggaagggagggaagggaaggaagagagagacagagaaagaaagaaactgaaggatggacacctgggcttatttctctcgcaagggtagaggtacagaaagccctcgccctcaataaccacacatttttccaagtaaatattacttttgcagcaacctaataccttcatttgctgtctctcaaggactagttctctagcagtagatttccaactgtggctgctgtcccacagtacaaattacgttgtgacttaggacacacatacataataaaacctaacaaaaaatggaacagtacttacccttattgagtacaatgtacttgtcaatgtttaaaatgctcatcatgacccactaatgaacatgctatgactcacaattgaaaaggactcttcatttccactcagttaatgctataattggtgaacataatacagatggctgctttaataatttacttgaacctggttcttagctctagttatatgcaagacagtccataaatctgtttccagttactggcagtaagtttttctattgatattgctgaaaaacttaataactgttaag

SEQ ID NO: 131502 - DNA, 1058 bp, Homo sapiens
tcttaaaacaaggtgaggccgggcgcggtggctcacgcctgtattcccagcactttgggaggccgaggtgggcggatcacctgaggtcagaagttcaagaccaacctgaccaacatggagaaaccacatctctactaaaaatacaaagttatctgggcatggtggcacatgcctgtaatcctagctacttaggaggctgtggcaggagaattgcttgaacccaggaggcagaggttgctgtgagccaagatcacgccattgcactccagcctgggcaacaagggcgaaactcagtctcaaaaaaaaaaaaaaaatacaaaaaattagctgggtgtggtggtggcacttgcctgtagtcccagctactcaggagcctgaggcacgagaattgtttgaacccgggaggcagaggttgcagtgagccgagattgtgctactgtactccagccttggagacagagtgagactccgtctcaaaaaaataataaggtgaaaagctaaaacttttatctaaaccctgtcaaggctctccttataccatggactttaggaaagtcaagactgagccattctggagaaatcacattcatttccttgggcagtcaggaaaacaaaatatttgattaaaagtacgatgtttgcaaaatgtgtaattctttattaaaaaatattcaaaaccagtttcacattcagtagagatagaaatttgtttaacttatgcaaacctcactacatgcatagcgaaaaagattttgaaaactgaaaaaaaaactgtttaacttaaatgttttcatgttgttatacaattgtatttaaggtttaggtcttttttttaaagcatgctgcacaccaacaatgttagcagaaaaaaggaatagaagtgagtcttagaaggtatttaagatgcaattcaagattttatcttgtgcttttcttagaactgttttctgttgaaataactgtgccattttggaagctgaatcacggtttatcatttagaggttatatattagataatggtcataaaaaatttttaaaaatgtaaaccccttacgaga

SEQ ID NO: 131503 - DNA, 1051 bp, Homo sapiens
aatttaactttttaaaagaattcatctgcttctgagtaatttgcgtaacttagaggtgcttctaaggctgtaaacgttcatttcctgaattttccatttttagcccaagacagattcttcactctactttagcagaattatgtatctgcacccttgccatggtttctttgtaggatgaactctattccttgaatctggcgttggcctcaagacttgctatggctgcctgtggcagcctctatcagccaaaacccagctgactcaaagatccatgaatgcaaacataaatgcttcctgtaatgtggcagtgaggtttgggatggtgtagcatataatgtgatgacaactaatactgttcttatattactttaaaaacacaatttctctaatcacaaatttattttaaattactttttagagcagttttaggtttacagcaataaaaagtacagagattccccaaccatatgctcccactctcaaaattctacaccatagtggtaggtacgtttatcattgatgaacctaccttgacacaaaactgtcacccaaaacccacagtttacatcagggttcacttggtttcatgtgttctgtgggtctggacaaatatgcaatgacacgtatctaccattgtggtatcatactgaatagtttcacggtcttaaaaatctatggtccgcctattcatccctccttccctctaaccccttatcttttgacagtctccatagttttgccttttccagactgtcacatagtttgaattacacagtatgtagtctttttcaggctgccttctttcacttgcaaatacacattaaaatcccatgtttttcatgcttgatagttcatttcttttggcactgaataatattccactggacataccacagtttatccattcacctactgaggaacatcttggttgcttccttatgtagcatttttaatttcagcatttgttattacaaagaatttaagatacacattaaattaggtaatatggacctctcatatagttatcacccagccccatcaatcaacacat

SEQ ID NO: 131504 - DNA, 1074 bp, Homo sapiens
cggcagctaacgttttgcatcatgtcactggagatgatgacaggttgtaattgtgaaaaataatatgaaaataaaaattatagcgactaccacctttgaaaccctgaggtccaaaaacttacagggatctatatttttgcctacaaagtcttattaatgtcacttagaattttaaagagtaattattataataataaacttatacctgtatgtccccaggtgcattcatttgatggtaccaaggaagcagcagctgctttgattgacttggatctttatataggatttaatggttggtacgttcttaggttgctttggtttttaacttttatttaagcagatttcttaaattgtcttacagtgaattgctgatgaagatttattttcattaaagtttgtgtgtgtttgcattgatctttgctgggaatttcagtaattatttattaagaaattaaacagtacattactattaaaagttaaagctcgaaagttatagactactacattatgttctaataatggaaaacaattttgtgttgagatctgcagctggctttctctggtaatccaatttattctcaggtcatttgatcccttgaaaacatgtgttcacagcattatgtatacatatacacgtcatatctgactatggacgaacggtttattctgtgacagtcatacatctctgcagtcaaagaaaccgaggctcaaagaaattaggaaacaggtatagagtttctccaagtatgagaacccatgtcctctggcttctcactctgtgatctttctgctgttgtaccacactaaacttcacacactcagtacagtcagctagcacagctaggtctctgggttggttttgtcacatatgtaagagcttctaccagtgacttttcacaggatgtcagtgtagcctattaaatcagttgcaaaatagtataggagtttctgtccttcttcattgtctcatacccttaaaattattatgtttccaattgcattatttttgactaaaatctagggaaatagaatcatggaattatgtatttgctctagagttcagagtttaaatgt

SEQ ID NO: 131505 - DNA, 1066 bp, Homo sapiens
tgcaatagcacgatcttggctcaccacaacttctgtcttccaagttcaagcaattcttttgcctcagcctcccgagtagctggggctacaggcacgcaccaccacgcctggctaatttttgtattttcagtagagacagggtttcatcatgttggccaggtgggtcttgaactcctgacctcaagcgatccacctgcctcggcctcccaaagtgctgggattacagatgggagccactgtgcccagcctatttctaaataagaatttacttgggttctattaatagtttttaaaattaacaaaagcaacaacaaatccaacctaaatgtttgacttttaccaaaaaagaaattgccaaataattaataactagttttctgaaatggtttatgaggagtcacttttaaaatgatttcgatattaatggagggcatcttttctagtcagctggaaatggtgaaggaaagaataatgcaggcagctgtgtaatgcaggcttctttattgttgagaaatatgttatccatagtgtattcaggctctctggactcagtagtaatgtgatgtcacttgtttaggtgaacctactttttaaaggagggctgttgttatatgttgtttttgattatataaatacatccaaactatgaaaactatgtcttgacccctatatctttgaaggagagaaatagcatctcaatcccttctgcttgctaagctgatattattgattatataatggtttatgcttttttttttttttttgagacagtttcgctgatctcctgaccttgtgatctgcctacctcggcctcccaaattgctgagattacagtttatgctttttaagcaacagtctcacccatttataagaatttcttcagccttgtctctttttttgttttgtttttgtttttgagacagagttttactcttgttgcccaggctggagtgtaatgatgtgatctcagctcaacgcaacctccgccttccaggttcaagcaattctcctgcctcagcctcccgagtagttgggattacaagcatgcgccaccatgcccagctaa

SEQ ID NO: 131506 - DNA, 1047 bp, Homo sapiens
ggaccaaaagtgtttcatatttcagattttttcagattttggaatatctgcatatacataaaaagaaatctttgggaagggactcaagtctaaacatgaaattcatttatgtttcacatacaccttataccacaccctgaaggtaaatattttaaataattttgtgcgtgaaacaaaatttgtgtacaatgaataatcagaaagcaaaggtgtcattatctcatgccagtgcttaaaaaggttcagattttggagcattttgtacttgggagtattttggatttttggattagagatgttcaacctgtattaaaaatgactattttatacttaccactccccctacacaccgatctctatttcttttcattatgtctgtgaattaaaaacaaagaacttttagcaaatagcttgatttctacaaaattcttaagttctgaatgagactttggttttaactcacccaaaaattcagcatgtgagtttcgacaatgaagaaacattggtaattttgtttgttctgacagttcaaactgtttttcaaaatatctgcataatgcaaaaaaaaaaaattctcattacaaattgtattttagcatgaggaaggtaatgatgtcaaaagagcttttaaattaaaggtatttaattctctagaaattacaggacaaaaatcatgaatatttaaagcacatcaggcttatcaaagggcttttataacttacaacttctggaaagaaatacttcattttctgggcttacaaaattatctgggccctttaattttcagaaagtaacaccactggccccttgccactgggagcaccatcagtgggagtcaactcaccaagcgagaagcccaggagagcttcatactgcatgctaatctattccattttgcaaccagttttttatgtgctgttataaaagaagttattgccactgggcaaaatgaacaaggtttccctcaaaaatgaaatctaagtatttgctaaacagcaaataactcaattatgctattaaaaaaagaaaattacatgataaagtggt

SEQ ID NO: 131507 - DNA, 1553 bp, Homo sapiens
tttaaaacaatcctttggggatttaggggaccctagagatgagcaattgaggccatgttgccatcaagcagcttacagaggagggattactacttgtgttgaggtatacccatgaaactcactgggctttttggatttgccttgatcctaattaataacaactgctcctgaagctgaacttttccagctcttgtcgttagatagttaaacctcaactgtaagaagcagtaataaaatcagaagcttcactaagatgagcaaataactcaagtggaaaattattttcatttatgaactttaaaaaaataataagtgagtaaaacaggcagagaagtctcttaatagatgccaattcctaccctgtaacttatacagttatttctagttaccatggcgggtttttcttctctaaagataatagtcgtttgatgttcagtactagttatcctcaatttgtatcattaggaataattttttttaccacatggcttctttatgatacgtagctagcatgacttcagggacctttcttttcttgaattatgtaaaattctgtgggcccattgcttgggcttctgttattttctttttcttttttctttgagacagggtctcactctgtcatccaagctggagtgcagtggtgtgatcatggctcaccgcagccttgacctcgccaggctcaagcaatcctcccacctcagcctcccaagaactgagactgtaggcatatgctaccacacctggctaattcttgtattttttgtagagatggggtttcaccatgttgcccaggttggtctcgaactcctgagctcaagcaatccacccacctcagcctcccaaagtgctgggattacaggcctgaaccacacacccagctggcctctgttattttcataaactgtacttttgcctacattcctataggaagctaattttccatccgaccattagatactgtgaatttgtagcttggtcatgtggtttggtccatggaattgtgtgtggaaaaaataaccagtacagcgtggagcagtgcacacaatgaagagtaccgcctgctgtgtgtagtcagagccaaatatattagtaaagttgacataatgactagtgcacacttaactgctgacatttggtttactttagaggttatggaaatagtgactggttatattatcaaaatctctttttgtccaagttgtcgttaatatttcctacactgcaaaatttcagcactttgttaatgaaaggaaaatatttttgcttattctaacccagcagaatctgaaaaggagattttaaaacccaaacatttggtaatacagacatagacgacctattttaggaagactatttctatttttttaatttttaatttttttttttttttttgagacagaatgttgctctctcacccaggctggagtgcagtggtacaatctcagctcactgcaacctctgaccctgggttcaagagattctcatgcctgccgaatagctgggattacaggcatgtgccaacatgccggctaatttttgtatatttagta

SEQ ID NO: 131508 - DNA, 1039 bp, Homo sapiens
agagacttctctgcctgttttactcacttattatttttttaaagttcataaatgaaaataattttccacttgagttatttgctcatcttagtgaagcttctgattttattactgcttcttacagttgaggtttaactatctaacgacaagagctggaaaagttcagcttcaggagcagttgttattaattaggatcaaggcaaatccaaaaagcccagtgagtttcatgggtatacctcaacacaagtagtaatccctcctctgtaagctgcttgatggcaacatggcctcaattgctcatctctagggtcccctaaatccccaaaggattgttttaaaatcttcttgttgtagtttttaagacctgcacagtgttaacattttaaagccccaagaaaaatgcccaaagcaaattcctcctacccaagagaacagagctctaaattgcaacaaggaaaggagtgtagcataaggccaggaaattgaaaatacagggtatggcttaaaggataaactttccataagtagatcaggcctttccttgttttcactctttgcttctctttcttagtctttaaaaaatactttttccagaaaaggtctaggtactaaaacaagaaaaaagtattaaaaaaaaaaacttttaaaagttccaaacaaaaacaatagctagcatcttcctttagggtggtaattatttctagtatgaggaatgtaacaacagccatgattgtgcacatactctgcatgactcatgtcactatgggctttatgtgccttatgttaagaaaggtaggcagcaatctccccattttaaaggggatgcacaaagggatgaagtgacaccaaaggcagttgtaaatctcacccaaagatctgctgattccaaagctcatccttttaacatggtcatacaccgccttcacttaccattatttttcagacactacatctattgtatattaatttttctgtcttgccccctaattttctatttttcttttctcatacatctcctttttcctgactacatatttac

SEQ ID NO: 131509 - DNA, 1057 bp, Homo sapiens
ctctactaaaaacaaaaactagccaggcgtggtggcgagcacctgtaatcccagctacttgggaggctgaggcaggagaattgcttgaactggggaggaggaggttgcagtgagccaagatcgtgacattggactccagcccgggcaacagagaaagattccgctcaaaagaaaaaaaaaagacacactagtaacaatcacattttgattattgttaaggaaacaaatacccacattctctgcccctcactccttttcccctcgcatatactcacagcatgcaatctgttttgtatacacagcactctacttgtttcagcacttaccatgttgtacagaaatgggttttcattatcccttcctccccgcaacagacaggtgtctttgagttcctcaaaggcacacaccaagtcttactcatgtgacagttccatagcacttagcacagtactctcagcacatggtaggcacttagtaaatgtctgttgaatatttaatacagagggaaggttcttttcttttttattccctttgagcagcatggataaaaagcctataattcagctttcactattgggtttatttttggaagacttcagattttggtctgcacttttctaccatctggaacaaccagtgtatgattgtgtttgtttgtttgtttgtttgttttttgagatggagtctcactctgtcccccaggctggagtgcagtggtgcaatctcagatcactgcaacctccacctcccaggttcaagcaattctcctgcctcagcctcccaagtagctgggattacaggtgcccatcagcatgcctggctaatttttttgtatttttagtagagacagagtttcaccatgttggccaggctggtttcgaactccagacctcaagtgatccgcccaccacggcctcccaaagtgctagggttacaggcatgagccactgcacccggccatgatttgtttttaagtaaatatgtagtcaggaaaaaggagatgtatgagaaaagaaaaatagaaaattagggggcaagacagaaaaattaatataca

SEQ ID NO: 131510 - DNA, 1053 bp, Homo sapiens
attctctcttaagataccatccagctatatcataatgtttaacaattaataattttgtcatatggtgatatgatcatatgattaagccagtgacttgatggcctgaagggatttttttaaattacgcatgaggaaagtgtacttcctcccgcttccctccctgctccccacaaatgggattctgatatgtaccccctggttgaaaatcactttggggaggagcagatctgctagtggagtctgtcataccctagacctcaagctccaaagttctgaagtgtgaagatctataaccaagtagaataggatgggttaacgtaatgctctgtggatacctactctctcttttaggtcgctcatttgtacatcccttgtagaactgtttagtttgtggtatattatttgctgatttgctgtgcctttcagggacattcatgtggttactagcagggttactgaagccctatacctctgtcgaatattatgtaggccagctcacttaaccttaaaagttctcgtgttcacattgaaatagaaaaacagttctctttaatagttctttaggttaagcccagatatcatattcctcaactttcatgtctggttttggtcaggataagccttgtaagtctaatagactgtgttatgacaagcaagggcaatggcagagtccccgtgtttttttgcccatatgacttttcatccaaaatgagttagaactgattctaaaatgcaacctcaatactttaaactcacttttgggattaatcgaaaacattgacagtatcagtttaatttaactgttctgaagattcttcaccatcatcagaatagcgtctgatcttagaatatgcatatcacagcttgtgcttgaactcacatgccaagcgttaattgctaatagagaggttcaaactacattcagtaaatgattaccaagtgcctcctcagcatgatacaaagaagaataagactttttccaagagaggacataaataattaaaataggttggaagtgcttactaaagtatgtgaacagcagagggaaggact

SEQ ID NO: 131511 - DNA, 1559 bp, Homo sapiens
caggcctgagccaccatgaccagcactgattttatcttttatattcaccattcatgtgactatcttgattggtatatttttgtttgtttaacacctattcctccattattgattcatgtatttaatatagcaataaaaatgtattcccttaaacaggttaatagtgggggcgatttaaagtggtggaaagggggatttgtttttctagcaagtaaatgaggttcacttattcggaggagactctgacagcttgacttgcatagaatacaaatgagaagtcaaaaacactttttgaatggcttagctgagcccgaaccatgggaaaggtatcaagctttcctcaggctctcatgtagatgtttagaaaaaaaggaagcagcacttttaaagctgtaagaacagaagttacatggagaggagtggaagagggctggtaatggaggtgggagaactttaaaaagcatagctgtttggggatgaaaagtaaggataaaatgttcttatatatttcaaaaactccctggaagatagtctatctttaatcactaacaaaaagtgtcaatggggtgggtgaggtggcttacgcctgtaatcccagcactttgggagggcaagccgggcagatcacgaggtcaggagttcaagaccagcctgaccaacatggtgaaaccccgtctctactaaagatacaaaaattagctgggtgtggtggcacacgcctgtaatcccagctactcaggaggctgaggcaggagaatcacttgtacccaggaggcagaggttgccgtgagccgagatcgtgccattgcactccagcctgggtgatagaacaagactgtctcaaaaaaaaaaaaaaaaagaaaaagtgtgaatggatcctaaaagacaagtgtggattttagagagatttccataaaaatatagcttttagtaagttttcatacataaaggaaacacatcagtattttaaaatacaaaatttaaaaattatgtggaatgtttaattcctcagtgtctagcacgtaagataatgcaaaaaaaagtgaaattcgtgaatgccagataaatgaggttttacctaactaggattcctttaataatcagtcttaaaacttttaagattttaaacaaatgcaaaatgtatgaacataaagcaaggatatgagagattatatagtgttattatttgcattcctggtaccttgcacagtatctggtccatctagtaaaaatttaataaaatggcccttcacagcttaagttaaaaaagagtaaataaaaagcaactcgtatcttaaacacgttaaaacacacacatgaattccacatcaaaaacacctgaggttggctgggcacggtggctcacgcctgtaatcccagcgctttgggaggccgaggcaggcggatcacgaggtcaggagatcaagacccatcttggctaacacagtgaaaccccttctctactaaaaatacaaaaaattagctgggcatggtggcaggcacctgtagtcccagctacatgggaggctgaggcaggagaatggcatgaaccagggagg

SEQ ID NO: 131512 - DNA, 2166 bp, Homo sapiens
actgggagaggagatgatgccctcttgtcttgccgtttttttcaactatttagtaaagttgtaggtaaaataaaaagtatacttggttagtattttacgtaatttaaatactggatgtaggcatctgttctagtattaaagttttaggtatgttagtaacaagaaagttttcccaatatttttattagtctttttttttttttctggaggcgagtctcgctctgtcccccaggctggagtgcagtggcacgatctcggctcactgcaacctctgcctcccgggttcaagtgattctcctgcctcagcctcccaagtagctgggactacaggggcctgccaccacgcctggctaatttttgtattttcagtagagacggggtttcgccatgttggccaggatggtctcaaactcctgaccacgggtgatccatctgcctcagcctcccaaagtgctgggattataggcgtgagccactgcgccctgccttacatcttctgctttacagatagtcaaggatttaattatggctatgtttccggaatggatatgcaatagctaatcatattaaagatttaaatagctatatgaaaatatctatttatcatttgcaattctaccttcgttttgtgttttctccctaagttgtacctagaatgaattcattttagtgagacttttgaagtatgctttacaaaaatatacatcattatacttgaatcacgtcttcagaagaaggcgccccttacgcagcactgcttcagtgctctcactatcaacacataactctttagtgacattttcattttaacagattaggaaagatggcattctaattactgagcggactctaatgggtctatgcagaagtatgcttatttgccaaaagccatacgttttcctacagagaattcattagcatgcattaactcactgattctcaaaccttttgctctcaaaaccacttcacattctttattattgaggacccccaaagagcttttgtttgtgtgagtcttacctactgatacatactatattaaaaattaaaacaaaatattttaaatattccttttaaaataagaaactactggataacataaatagcatatttttatgaaaaataagtatattccagaacaaaaaaattagcaacatgagtacagttgtatgttttttcaaatctctaatgactgtgttactagaagcctgctgaattttcatatctttttctgtagtcagtctctggtggtgtcaaacatcgtgtagcttcttgaataccttgtggacacttgcagtagagtgagagtgaaaaagacagaaagtgtcttattattgttaggaaaatagttttgacttcacatacctactgggagttaccagactacacctggagaactgttgaatcaatcaacactattgaatcattgatttcgttattcacgctttcataacacctgatctctgtcctcaaggaatgcattgtctaataggaaaggtgggtatataaatacattttaacagagtctagtgatgaattctgcacctctacatgcacacacacatacatacatccctgaggtgtagtcaggcactactctgcataggaggtaatctcccagctgaattttaaagggtaggtgtgtggcagtcacagaggaaagagcattctggaataaggaagtggtaggaaggcatgtttaggaaactgttattgctgccctattaaagtcagcttattttattttctttctatttcagtttatgattacaggtggaaatctacaagacagtaaagatgcactgcatttggcacaaacaaatggtatcctcatatttcttttaccaaaaaaaaaatgaattaagtaattttgaagaagtctttctgaaaactgcttcaggtacaatacaatggatcatgactggaaacaataggaaaatggactgatttaaatgggacatgattaagatgacaaaattcaaagtactcattggtatatcagatgtttataaaactgtttcatactgctcaatgaagattattttaagatttcagctaatgagaataaagttctccaggtacacagtttaacctcaggtgtgttttttttttttttttgagacggagtctcactctgttacccaggctgaagtgcagtggtgcgat

SEQ ID NO: 131513 - DNA, 1064 bp, Homo sapiens
tcaaaaatacatgtacctgacaccaagtgtagctatttatagtttgggcataccatttaaataatggagtaaaactttcatttttacagtaataaaatgcctacggctttttagagagttctactaagcaaatgaatagatatttctttaaattagctttaaaacagagagctagcccacacatacactaagaaataaggttaaattccatactatgctaccaggacacttggtagctgctacctccaagatgaataacttgttttggaaagtgacactgctgactaaatgagtttgcagactccaactctaaacttttatttgttattattcacaaataatatgaaaagataaaagttacattaatttctcattatagtcactctgcttggtaaatcactttaaacaatgcttttctgcagactctgaaatactaggctcctaaattttcatgtgttagccatgagtaatcttaatgtttattcacacacacacacttaggaatgacagaactgaagtgatttttacttggacatggttccaaactgaaatttaattcaataccttgcatttatagtgtagtagttaaaagcatagttagggcataacaaacgtggtatccagcccctacttcatttttcatagctttataacctggagtcttttatctcactagacttcagttttctcatctgtaaaatgagaatgataatagtacttaattaatagagttgttatgaaggctaaataaaatattgagtgtaaagcatttggtattatacctggcataaacaaccttcattatgtgtatgatggaagccaccaccatgagatcatcatcatcgttatcttttttttttttttttttttttgagacggagtctcgctctgtcacccagactggagtgcagtggcatgatctcggctcactgcaagctctgcctcccgggttcacgccattctcctgcctcagcctcccgagtagctgggactacaggcgcccgccaccacacccggctaatttttttgtatttttagtagagacggggtttcaccacgttggc

SEQ ID NO: 131514 - DNA, 1053 bp, Homo sapiens
ggggaagggccgggaggtgcacgtgggatgaatggaaacatagtgattggcctttttggagttttcttcttaaaaaactgaatacattacagatgttgaaaacagcacaaaaatcataactgtacggcttgttaatttttacaaataaatacaccctcgtgaatccagaacctagatcaagaaccagagcattaccagcacccagaaacctccccgcgccctcctccactgagcggccctttcaacccttacaatgccggagggcgcaattcctgggtcctgtgaccttggtgaccgacgcccgggacaagtcagaaagacccaagggcgtggaaaacgctcctcttaccgataaacttgaagcgactcatgactgcgcatggaggacctccccagcggaagcggaagtggccgccggcaactccgcccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtggtgcgtccagaggtaagggatggggacccaggactcggggaggtgaccctcggggccccatggaggtggagaggcccctgggtacctggaggttcaaggacttcgggaacggaattggaaggtggcctctcgcttcacagaatcctatggtagacccgggttcaaatccaggcttcgccacttatggccgggagaccttgtagagttgcttgtcgggtctgggcgtcagctttttgtttagtaaaacggacgcacgaccagcgcagagggtcgcaggaaaattaagtgaaataaaggaaagtgcctaaaattgtaattgtcatgggtccagcgctcgctcaatcgttttcttcacgatcttctcctttccaatattaacagcaataaactatgcattattttcttcagtctgcaaaactctaggagttaggaattatcttaagcttattttac

SEQ ID NO: 131515 - DNA, 1105 bp, Homo sapiens
tatgcagctagtgtcagagtcaggatacaaacctagctctgtatgagctaagcaatactgtttctgccaagtaacacctttcttattcatctttgtatctccagaatttagcatagtgactagcacaagatagaaggaaatggaagttgtcattcaatgaatgttgaatgatcctgcagaggttatagcttttctcttgcgaatgctcttttctttttttttttttttttttttgtttaaatcctcattccattgttggatgtaagaggagaaaaatggttagggtatatatttaatacagtatttttttgctgctgctgtttggtgggctgtagaggaagcagccatgatgatacggctgctccattgggagggttggggtaggtccactgcccatccagaaggtatcagaagtgcagcctcctgtcagacagcaacactgaccacgtgagtaggtaacatttctaatcttcaaaatcattttggtttaagagacaaataccgatactttgcttgtttgatgagagcccggtttgaagaacataagaatgaaaaggatatggcgaaggccacccagctgctgaaggaggccgaggaagaattctggtaccgtcagcatccacagccatacatcttccctgactctcctgggggcacctcctatgagagatacgattgctacaaggtaggtgagaattatgatgactgccttctgagaaatagactttgtttcttcagtcccacacctcagcctcagaaatcacttgcccttcaaggggtagctaggagacttatttcctgacagttgtcagatgcaggcctacctcattttattgcattttgttttattgtgcttggcagatattgtattttcacagattgaaagtttgtggcaaccccgtgctgagcaagtctgtgggcaccatttttccaacagcatgtgctcactccctgtctctgtttctcagtttggcaattcttgcaatatttcaaacttttttttattattactctatctacacacagttgtggtgaactgtgatcagtcacctttgatgttactattgtcattgttttggggcacaaaaaaaccatgcccacataa

SEQ ID NO: 131516 - DNA, 1046 bp, Homo sapiens
cgtcattaagacttttctttctacattcagatttaaggtcgtacagtatactttttgctataacaaagttcattttggactttaaagttaaccaacttggattggtgcttaatatttctgagatactctaattaagagttccaagtaagataagactactctggatatttagagaaggcaggtaggggaggaatgaagccagttctccttggactgatgatggtgctatttttcagcacagtctttgactctaaggtgttttcctttatctttgcttcctacttatcctctgctgttccttgcttagagttagaaacagtctggtagttgcagtggttataaaaatatatcttgatctttgtcttacatctcctgagcaggccctgtcagggataggtaaatgtgtcctgtggattgataccatgatttcctctcctgacaggtcccagaatggtgcttagatgactggcatccttctgagaaggcaatgtatcctgattactttgccaagagagaacagtggaagaaactgcggagggaaagctgggaacgagaggtgcgttctacttgtacttcgttattccttagctatgtagatggagtgaagttttgctccccacaagcagaggtccagattccagccatgacagttactctgggcccttgcttctcagatatactttagtatctaagtgtatcaatttaacatttataatcaccttacaagtaagttaaagtgcattccctggtcgttttggctttgtctttgattttgcttcagatctccttctctttagtcctttgtctgacttttttgccttcttgctatactttccctcaacctgcctctccactattttcttaggcatttttcagtcatgttaggatggtcagttatatttttaaaagctcaatcttgctgtagtgtgaagaatatattggagaggggaagaggagaagcagagagacccttctaggattattgcagaagtttagtcaaaaggttgtcatgactaacactagggtggatgaagtggatatggaag

SEQ ID NO: 131517 - DNA, 1063 bp, Homo sapiens
ttgctaggaagggggcttagaattaacatccccagcatattatgaactgaggtttcttaatggtgcttttggagaacacttagctgagacacaacaataaatgtttttctggtcagtgggtgggggctgtgacaaggagaattggaatgatagttgtcatttttctgtctgcagaataagaggaggtccagataatgaggtgatgaaaaggggtagggggaagaataggaagggtaggctttgctatttaaaagaatgggaaaacccttaaggagacttttctaaaagtgtggatatgaaaataaagcaggtatatgtaaaaaacacttttcaatattgtgatcagatagtgtgtaatgtcagtgacacaccatagacataaagctgacccttcactgcagcagacagatttttatagtcaattagattcctttggtaatgattccttccttgcctccttctaggttaagcagctgcaggaggaaacgccacctggtggtcctttaactgaagctttgccccctgcccgaaaggaaggtgatttgcccccactgtggtggtatattgtgaccagaccccgggagcggcccatgtagaaagagagagacctcatctttcatgcttgcaagtgaaatatgttacagaacatgcacttgccctaataaaaaatcagtgaaatggtctctggtatgactgacgttcttctaagaattactgtgatgccaagtgactgtgccactgtcattgttttatcaatcgtgcatgtaaagaaaatgacaggacatgtagtcagtcagctgtgttctctgcaataaatcactgatagcatatgttaccagtaaggaaaaactgaggcagaaccagattgaggcgaacaaactctcaagtcaaaggcctaattagctgtggtaactagaaggaataaacaaagccaagaacagaaatactgaggatttaaaaataacctttttggttttctaaagatttcactaatggaacttagtttttattagaagaacaactctccctaagaagtacatagtcaacaaataagcatggaatt

SEQ ID NO: 131518 - DNA, 3159 bp, Homo sapiens
aactgctggcctccccaccaccctgggacctgctatggtcactccaggggttgcaactatccgacggaccccttccaccaagccttctgtccgccggggaaccattggagctggtcccatccccatcaagacacccgtgatccctgtcaagaccccaaccgtcccagacctcccaggggtgttgccagcccctccagatgggccagaagagcggggggagcacagccctgagtcgccatctgtgggtgagggcccccaaggtgtcaccagcatgccctcctcaatgtggagcggccaagcttccgttaaccctccacttccaggcccgaagcccagtatccctgaggagcacagacaggcaattccagaaagtgaagctgaagaccaggaacgggaacccccaagtgccactgtctccccaggccagattccagagagtgaccctgcagacctgagcccaagggatactccacaaggagaagacatgctgaacgccatccgaaggggcgtgaaactgaagaagaccacgacaaacgatcgctcagcccctcgcttttcttaggttcacaagaaatgcgccggtggggaatgaactgtttcattaataaaacctaatttgtcttgatccattccactctataataaaacaaaagattttgtaggcaactcggaatatagctcttttgaaagtactcgacacctttagataagaattaaaaccaacctatgtaactgacataatcttgatcttttaatttgtaaatattgacaattttctttctgcacattttaatcttagtttcccttttgatttttctgaaggtgccaaattccatttaacttttttacaagtctttgtaaaattttaaatgcataaagggggttggggcaggggaaccacgaagtagttaattttagaaaaggatttactatacttcactcttctttttttttccccacaagcttttgtagatgcattgtagtagtctagcttagaagcaaatgcaagttattttaatgtacaaactaaatgggtaagaggtaaaatcttcatttaaatatactatgttctggatgaaaagagcaggagtaacaattgatgagcaatattcagagtgaagtaaatctggaaatggtagactgtgttgggattggggggagggccatgggaggggtacatcgtcaacatagccgatcctgttacatttaagagtagcctcgtaggttgaatttcttctggtagcttcatggtaaatgcatccgaataagccatactggattgcagtgtttgtttctgtagggtgtttaaggacttgacttcctttctcccatgattcctctggactgcacacagcacccacaaccagccccatgcatgctgctgcctctgggcagtcgtagaatctcccacttcagtttctcgttgattgtactcacctttatggaatccaaatacatccaaaagggtaaggcagttttaaaaatgtgaaaacatttaaaaatgataatagcagggaattcttagattatagtaaatgccttttacttaactgtgcccagcaggctgggtgcgttaaaaagcccaagtattttgaaaaaactcgaacagatttgacaagggtagccagcttggagtctagcaacttgccaatgtgtttaccaatctgggggcttgtttttcttttcttctttcaaataaatggcagttaactggctttacagtaaacattgaagagaggaggatttgtttattgtcactgggaatctgaccactatactgtcctttttttgtattctgggtaaatgttttttggaaaagatttgtcttttctaagtggaagttaaatttgttatactgcccatcccctaaagccaacagagatttgtagatttaaagggatcacatttgaagacaatagtgtttaagaaagcaagcaagtcccttagcagtcaggtcataacagggcacatttctgaccgaaccctctcaaggcagaggaggagtttggtgggtttcatacaccctgcagattcctgttggctctaaccctcaattacctaatcttatgctttaacacataactgcattggatgtgagagtaacgtaccgtatggtcattgttctatatattaacattgaacactgctgcgattgctcaaggacattttatgttacggctttaaagcaaaggcatgattattagaaactatttaagcttttttctttgaaaaacaagctccttttacagaatataaacaacagtagtgcctgtggtttagcccaccaatcttgatgactaaaagtagctgatgcattgtgcatatgatgcttgagatggtttttgcaaaagcagaaatcgctgcaaggtaatcacaatagataaaagtggtattttaaacctttgaaataaatggatgtaactgtaccttggtacagcttttcacttgtttagtttttaaacgttagtataatctgaataaataaaatgttgccaaattcaatgtagaaagaatgtgacaacacaccttgggtagttctgcttgtgtttttgcatattgtaaaagcagtgtcacagctaaaaagaaagaaatcgtttctaacagtaaattattgtgctttagttgctagtttgtactgagagttgacctctccctgtgcagttttttgttctaaacttgtataaataacaattgtgtaatgtgtctccctcctacattgtaacaattgcttcagcctacgttataaataaagaaccactagattaaaaaagtcctgtatttcaagtcttgttacaattcagtttgaggtcttagtcaaatgttagaagatggactgggactcaaattgagcttacgtagaaaagtgacaaaatatttttgtgatggctataagatcattagttgcctgaaactatttgaaaacagttctagctaatgagggatcaagaactaaaagcagctgttttgggttgaaagttttaaaaactgctttatctttaaaaaacaaaaacaaagcttctgaaacatttaaggagttctgttattcccttacctttgagtccgcagacaatccaagctacggtagcagaagcaaagctggaaaactgcttctaaaataagcgccacaaagttttatcccagattggaccatttaacccc

SEQ ID NO: 131519 - DNA, 1078 bp, Homo sapiens
gagctgcagaagttcgagaccagtctgggaaacatggcaaaactcttgtctctacagaaaatacaaaaattagccaggtgtagcagcacacacctgtggtcccagctactctggaggctgaggtgggaggactgcttgagcctgggaagtcgaggctgcagtgatccatgactgcatcactgcactccagcctgggcaacaaaatgagaccctgtctcaaaggaatagcttcatttttgttttagcactttgcactacacactttatggttattttctcatttaatctttacagccacttatggggtaggtattttcacccctattttacagaagtggaaattaaggctcaataactcgctcatattcacacaaccaataagtagaactggagtttgaacctaagtgtgttagagtgtaatgcccaagttcttaacctattccagccaaatcctctatcaaacctgcctccttcatcctcaagtccactgcacacacaagtcaggcaagatgaaaatctaacagctagaatatatctatgataattgaccaaaagctatgccattcatcattcaaaacctctaagacagtgagtcttattggagggtgattttattccccaggggacatctggcaatgtctgtagacatttctggttgtcacaactggaggggtactattggcatctagtgggcacagggcagggatattgcttaaacatcccagaatacacagcacggcccctccccaccacgtcctccataacaaagaactatccagcccaaattatcaatagtacggtggttcagaatcagggctgtgagctgtttaatctgtaagctcccacatcatcctgagattggtcttacaaggaagtgagcacatgacactgatggaaactgtctttgtcccttattgtcagggactcactgtcagtagctttgttctttgtctagcccttgcctctccagttaattatcagggagatgttatagcctaggctagtctatttgaggtttgatcttcacgttgagttctggactggagaatttgtcttctttcatcccccttattcctcc

SEQ ID NO: 131520 - DNA, 1973 bp, Homo sapiens
tggtaacagaaccataacccaaagcaggtttggggtgatcatgttgaacttaacagtacacgcagactttagttttagtcttgagtgttcaaacatgtttgctttaatataaagacgaactttgaaaatgatcccctagcaagtccgatcaatgctcctccaggaggataatctgctctcttttgagaggaggaccctaatttgaaaagtaggccccttggctgccagcgttttaagcaggttttgactttagccctcacaggcggtgtgggcctctcaaggcttctcggaatctttctactgcccctgggcgccttcctttccttctgagggcttgagagggcagggagcctgccatgccctttgaggctggtttcctgggaatggagggagaagggctgatgttgctttagtgctcgctggtggccattcccctaacgggaagccatctgggttgttaaggagcgctggtcccttcagacaggagaagcacgatgtactgcccactggtgggtccccttagcttacaccggtcacctgttaggtggctgccgggtctcctgctgccacctggtgggtgagggtttttaatctttgggcagagacgaggaaaagggaggtacacagggggctcccaaagggtttccattccttgccctttagagcctggagagggcatgcagagggcctgtggcttgtcccagccggaggttccccttaaggggaccagctgccttctctggggagctgtctatggggtccccgcagccctccagtggaggcagaggccctggctcctgaccgcacttgttttgcataggactgggctaagcctgggccctatgaccagcctctggtgaacaccctgcagcgccgcaaagagaagcgagaaccggaccccaacgggggaggacccactaccgccagcggcccacctgcagcagctgaggaggctcagagaccacggagcatgactgtatcggctgccaccagggtgatgctcttgttctcagtagctggttggggccacctcagcctggctggggatcacattctggccagcaactggggggccaaggcagccttgcagctggagggacctgggctccattccctgacttcctgctctacagcaaagtccctgggaaaaaaaccttgtgtgggaatgagagaggcagaactttctagggtcagagtgggacccaagcaagtcaatagccccctggccccacagacatgtagtgctcacgggggcagaacaggagtgctgttgagccccccccctaaagcaacctgtgtatttctctcctccaacctgcagcctggtgaggagatggaggcttgtgaggagctggccctggccctgtctcggggcctgcagctggacacccagaggagcagccgggactcgcttcagtgctccagcggctacagcacccagacaaccaccccctgctgctctgaggacaccatcccttcccaaggtacgaggcagcctggggtgtgcacttaggctttctgagcagcaccaggtgaggagatagaaaactgctggtccattttaaccacaacccaccactcgctaactaacaggtgtcaggattgttttcgtcatctgggaatgctttggggagctcatctgtagttgtcaggtagctgccatataagaaagggatctggggtcgggcgcagtggctcacgcctgtaatcccagcactttgggaggccaaggcaggtggatcacgaggtcaggagatcgagactatcctggctaacatggtgaaaccccatctctactaaaaatacaaaaaaattagccgggcgtggtggcaggcgcctgtagtcccagctactcaggaggctgaggcaggagaatggcgtgaacccaggaggcagagcttgcagtgagctgagatcgcgccactgcactccagcccgggtgacagagcaagactctgtctcaaaaaaaaata

SEQ ID NO: 131521 - DNA, 1003 bp, Homo sapiens
tggaatttttaaatttgcataatgaaatgagcaaatcactatcaccattaaatgaggcttcattagttacattatcaaaaaccattgacaaggccacaaattgagggcactgatcaatttccaaacttctaaaacgtaggtcaaacatagatgcttatttgctgtcaaactcatgtgcattctttgcaccccggctcttttctcttgcatcacagatcatccgtgagcagcagagccccaatgtttgttttatttataaatattcaggtttcccctcccttgaatgtcaatgccattttgtatctccgcactcatcctgttatattaattttttttccttccccccccctttttttgtttgtttccagttgtctaacgggttttctcactatagtttatcaagtgagtcccacgtggggcccacgggtgcaggccttttccctcattgcctgcctgcctcccgcctgctccctcgggtcacctctgtccaccttccagactacgctcattattacaccattgggcccggcatgttcccgtcatctcagatccctagctggaaggtttgtgtctctccccctcctcctctccccgtcattgcctctgtgctcacccctcttctgttccaaccccctcaccccgactatcccctcatccccttcctttcacactctgccttcttccccataatgcctctccctcaggaaactcccattgggggagaagcagaaagcagccggcagctctaagacagcaatttccacaggtagctggggctgagggtcttccttcaggggactttggtcaatccctgatggacggcagtgcagtgtgcaccgcaggcagcggcaattccaagtccaaaggcccagttttgcatcaagttgaaatctatgggttggtccctcccgggggccacctgagggtgtcagcatgatcagagcttctagggggtttaggggggactttccttctggccatgtttcccattttccctaatgag

SEQ ID NO: 131522 - DNA, 1168 bp, Homo sapiens
caattttccctgaccctttctttcttcagaccaaatggttcattgcatttaatgttctctacatcactaagagggatagatggaaactgcagggcccttcctgcgaggcggtggggcagagaataggttcagtgttaagggaattaggcagtgtggctcaaccctgcctctgtaccattctttctgtgaccttaggtgagtcccttgacttctctaggacttggtctccattgaaacatgagcagattggcccaattggataaccccttccagctctaacattttgtgttgaaactattaaacagacatttatcaagcacctgctgtatacacacatgacattgtactaggggctgtgctgggaaagaccaaaatcctgccctgaagaagtttaggaagtatctctctggtttgagtgataggtaaggcccctgcataggcagcccaaggtggaagctcatgagctggtgtcccctgctgtcaccctgctgtccccacctacagatcagatttgtagtagctgctcctttggacacagtgcctcttggtccatgtttatcttttagggcagcaggcttcttttgcaagaggccatggtctgggggccatactctgtgtcacactactctgccattgtagggagaactggtacaggcaatatggtaaataaatggatttggctgtgttctaataaaactttatttgcaaagatggtttgctgaccatgtgttagtcattcaaaagactaacaccctgtcttaaactccagaagtggttgcctgcacctaactggggtctgtggacctggccagataattcctaaacatgggccaggctccgcatagaccccactttcagtttttcatcatcagagacctgtctggaggtcttgttattactgggcttgttctacagcaagagcattcaagactctccactagagagtcaaaggaactgccaaggattcccatgggcccccagagccaggagagcggatgcttgccacctttgtctttaggagcagatccttctatccagacagaggctctttgattgagattgacccaacaaagccagcccgtgcccgtttttggaaacacccacaggctcttaccttgtttccacatctcttagcctcttcagaatgttctgcaaggaaagaatgctg

SEQ ID NO: 131523 - DNA, 1031 bp, Homo sapiens
tggcccacaaaggctgaggctatgaggtagacaggcaatgacctttcatgccttgcagggcaggccatgttaaggatattgttcttttcttgcgagcaatgggagctgttgaaaagcagtgagaatatttgcattttgaaagtaatccacagccgggtgtggtggctcatgcctgtaatcccagcactttgggaggccgaggcaggtggatcacttgaggtcaggggttcaagaccagcctggccaacatggtgaaatcctgtctctactaaaaatacaaaaattagctgggcatggtggtacatgcctgtaatcccagctacttgggtggctaaggcaagagaatctcttgaacctggcaggcggaggttgcagtgagctgagatcacgccactgcactccatccagcctgggcaacagagcgagactctgtctcaaaaaaaaaaaaaaaaagaaaagaaaagaaagaaagtagcccagggctgctctgggcgagctagtccaagtgcagtctggggtgagacattaggggctgttggcatctgttcaggtgagagatcgtgatggcccagtgagggtagaggtagcagaggtgagacgaggatggagtcaagtccgtgggagctggaatagccaggaccagcgctcaaggagtcagtggtgactctcctaacactgccgatgggagtgaagagaatgggcttttgtatatattaaatcagtaccaacacaactctctgaatttgtggacctcaaaagatcactctatcttaaaaccagtatatccaactgggacatgaaataatttctttcacagtttttttttataaatataattacatgttgtattagtgaatttaataaataaacattgtagttttagcttatcatctatcctgaatggaaatgtcttgactataattatagcaatctttacagagtatacttattttagaatgctacaatttgagagtcctttaattataatacacatttaaaataactttgctataatcataggataacttaaa

SEQ ID NO: 131524 - DNA, 2203 bp, Homo sapiens
aaaataaaaaaattctggtaaagccttctgtttccatctgtaactacaaaaagtttataagggatttttaaaaataataatggccagcattcattaggtacttattatggtcactgttccacttattaccatgacatcattaaatctaagaagtcttgattttttttttttttttttttgagtcagcatctcactaggtggcctaggctgacctcaaactcctgggcttcagggatcttcccgcctcagcctccctagtagctgggattacaggcacacaccactgcgcccagcagggacttttcttgagagagagagaactggaacattataatatgttaactgcacagctgacatgtaaatagttgactctctcactttccactagaggctgcaaagccaatgttataaatgtaataaacagactcacagagttctatacgagcatagtatttgctgttatactacaattttaaactctttaattttttttttccattttcatcccaccctaagctttgtttcctaggaatttcctagatatttttcaagtgatggtaaatgacactcgaaaggttttcttgccaaagcttggcttcttctgggtatatattcttcatctctctttttaaaaatccttgctgtcttctctaggggtggtcattactaactgggaaggttttgtttagatgagaaggaaggaagatattagtaaggcagagaaggggaatgtggatgtgggtttaatcagccctaatagaaaatttggtggcgagccatggactgtttaacacatgaaacaaaggtaagactgctgctgcttgaataccagtttgactttattattttcctttttgtgtcaattgtgtatcctgcactttctcaccgtgtgcccccccgccagtggacactcttggtaagtctaccatcccaaatctctggtggctgctcacggtgtggtccttgctgtgggctttccgtggttgtccagacctctgctagctgcccaggtttttctaccagctcaaaacaatcaactgtgcctacctaattttccacaactttaagaaaattgtgtgtgcgttgtgttttaattgttttcttttttggatgtttagccatttacgatgttagcacaacactctgagagcctttgaatcatcgtaattcaatattagactcatggaaaaaagaaatacagagtgacttaaactgtcatttccacagtcaataagcatttttgcatacatatatacctgcgtatgtatgtatgtatatatttatgccacaaacagagctgcaagcctcaaaataattctcaaatcagatttggttgtgttaagcttgcaaaacatctttaactttgtcctgtctgcaagaccatatagttctttccataaccaatgattcattttttaaaaaataaatcaaaagtatttcttatttcagtagagtttgtgaaatgtttcatttcagaagtatcagatcttccaattaagtaatcagaatgattcttcttgactgaatgttgaacttcactctgtggatgatcatgctgccaaaacttcaagttgcttttggagtcttgttgctgtccctctgtcctgggaggtctgtctgcgaggtgtctgtgtggtttatcttgcctgagtgtgcccaggtgttccctgagcattttactgaacagctccaaagaggcttttgaagtggcttctgtcatttacagcaaacccagtgcacaaaggtctcctttgatggttggggctgacacggcctctatttcccctcatggcgatgttgggctagtggttccccaactttaaaaaggatcatcctttccagttctcaacattgtgattatgaaacagcttgcacagtttctagtaaacctttggaaggaaggtaagacacagtcactgttttgcttattgcagtaaaattcacatcacagaatttatcattttagccgttctgaagtataagtttcagtggcttttagtacattcatggtgttatgcaaccatcgccactatctaatttcacaacattttcattatccccgaaagacacctcatgcccattaagcagtccctccctgtttcacagtctccccacccacgctgaccctgacaaccactcatctgccttctgtctctggatttgcctattctggacattttatacaaatggaatcatgtagtac

SEQ ID NO: 131525 - DNA, 1033 bp, Homo sapiens
actcacttaagggctggaagaaatctggtcatttgaggctttcagttgtttaggggtctggttagctgacatttccctttctactagaacacctcgagggatctgtttcatctccttcaagtggcagattcccggaccctcggtttgtaaaagtgttagcagttccttctgacgcaccacgcgttcggatggatgaaggttttggatacatttttttttttgtcctgatagacggaatctgatgtatgcagccagataatcacttcctttttaatatgtttccaggagattctcaagcagcttcctgccatgcctttttcaaaaactctgatctttgatctaaaaattctctggactctccttttagcatttcaagtgcctttgtgcatgtaagcatggttttaccaccatccttgacgtgggcagacacacacggatgtgatttttgtgagcggctcactttccttcttactctgcagataccaccttttatcacattcttcgactctttcttactatatagagaggtggtttgtaatctaaaggtgtttaaatatttccttcaagaaactttcaatggtttgcctttggtaggttttatctcaaaatcattttttagcagcttgggatatgctatggctgtggatgagtgtgcctgtttttcttgaaggcaagcttgtcagatgcctactagaagtaaacacgaggcaaggagttagccagtcctcaccctcagagaaattctgggctcgtgcacagggtcaagagcacggggcagagccagcattgccgacaggtggagggacggaggcggcaggatgctggggagatggtgtggagcggacccagtaaccccaggctctgaacagtgtctcttgagccctcttcctgctccatgataatcagcttattgccttggaggtcttggagttgaccacgacccaatggggaaaagtaagagagagcatcagaaatgagaggcgttttacattgtatttacctacgtgtgccacccaaccgtatgaactcagca

SEQ ID NO: 131526 - DNA, 1018 bp, Homo sapiens
agaccagcctggccaacatggtgaaaccccatctctactaaaagtacaaaaattagctgggcgtggtggtgggcgcctgtaatcccagctactcaggaggctgaggtgggagaatcgcttgaactcgggaggtggaggtggcagtgagccgagatcatgccactgcactccagcctgggccacagaacaagactctgtcttaaaaaaaaaaaaagtattcccaaacggagcctcccttcaaagctggtatgagtgaatatgacagggcaagaccactgtgcattttgttttcgtgtctctagcccctttgttgtaaatgtcatcatgagattatcatattgtattctgataaagccattgacggcatgtcacagtttatgctttctgtgataaatgtaatggctgtttcctacctaacatattttctgttaagcaaagtggtaaaattgttccatattctgctttctcttagaatataagaaagcccgccaagagataaaaaagaagtcctcggatacgctgaaactgcagaagaaagcaaaaaaaggtaactcctaaaattctgccactgatgttacttcctgatggagtacttgatttgtttttgaagtgaaaggtgttcacttcagagacttccttaagtatgacggccctggaaaacaggtgggagcaaataggacctatctgagttcacattctcaaagtgcagaataggtattaatttgaggcctttgccaagtggtacttgacgtgttccttcccccacctttgtcttccaagtttgacagtttccatgcctattgtgcttcgtaatgatacctataaatttcttagaagccttgggataatgcagaaaggcctttatgcaaatgttctctagtaattattacagaaattatgtcattttctcctgcagctttcacagcctataatcttcaaaaccctttattaagtcttgtgagaatgctaggaatgggtgcaggggaagctgggagtcatggccatacaggggattttc

SEQ ID NO: 131527 - DNA, 1015 bp, Homo sapiens
gcatgccagggactcgttgaggccctggggatgcatagacaaccatccggccaggcccctgccctcagggaacctgctctcctgcgcaggtctctcctcaccctctgtctgtgtgaggagccggtgcagacttctgaggccttttgggccccaccaccctgcaggagcctccttctactctgttaaatgttcccctttgctggtacagcaaagctgagacttcaaataggatgtgtaaggccttttataagagtagttgtgctgagcccattaggagaaggcagcaggtcttgcagagaggtctactcatccaataaaacacaggttccttgattttcttggaatatttccccctccttcccattcccactgcatacagagaagcacgtctcaattttcttctttggggtcacatacagagatgaagagcctaggcctgaatgtgaattgagacccattgtccggcctgcatacctgctaagtggcctgtctgcacaggggccaagaggttgtggggtacaaagctcctaacccccagcctcggtgacacagcacttccttcatcttttcgattcagcctttaactcagggagcgcgacccgagtagcagccacacgcaacccactctgctagcccaagatgctcagacatgacccaggcactgctgcgtcccctggggagcttgtagggggagggaggagagactgtagggcagagcacaggatgttgggggagagagatacagggagccccagaggttggagaggtttggttgaggaattagaaaatgaggcaccatttggagggatcccagtaggtgtacatggtttcatcacgctgacgttagagcagtgaaggggccctagccagatagaaaactgtgcagataggcagggaagatgggggagtggccagaaaagagtggagagctgccacgctgcacagtgattccaggtgtgtataaataggcttagggccagtagaagggaaacctcagagctggctgcaagggagc

SEQ ID NO: 131528 - DNA, 1198 bp, Homo sapiens
gggaagccaaaagattggacacacctggtcgaaatctttgggtaaagcattgtcttagctagggcatcatgattgaacttttccaggcctaagaattgagcttcctcttctcttattagaattcaggttcacactctgatgccatttggaaacactcttactttcctttgaagactgtgttctgtcacttcaccttataaaataaaaaaatcctgaaacatgccagtgcgattgcagaagaggagtgcccagcttcatggtcaagtctgacgctcgtgtgtgcgtgtgtgcagagctgtgtagccgtggctagtgctggcctccaggcatcccccggggcagcagatggtgtacccagccttgccctgctcggtccagccagagtggcagtgatgcacgctgaggcaacttctgtgatgcaacacccgggcagtcctccagcccgccgtcaaggtgaaaagacccctgccaatttaggacttctgggctctctgagagcaggggcttgagaggaaggagagactattttctcatatagtgaaactaaaatattacaacctgccatgagccattgcagcagtgtccctaagtggccctgagcgtcccatgacacagtcccgagccctggattttgtaggagctttccttttcattcttggctggaaggaagctggtgatgcaactgttgtgagctctgaaatataaaaattaacagtcaagggggctgggcacagtggctcatgcctataatcccagcactttgggaggtcaaggcgggtggatcaccagaggtcaggagttcgagaccagcttggccaacatggtgaaaccccgtctctactaaaaatacaaaaaattagtcaggcatggtggtgggcgcctataatctcaggtactcgggtggctgaggcaggagaattgcttgaacccgggaggtggaggttgcagtgagcggaggtcacgccactgcactccagcctaggcaacagagtgagactcaaaaaaaaaaaaaaaaaaaaaattacagtcaagggaaacctagggtcaaggtcactttaaaaagctgttcagccaagggcaacggccttcctgttttgaaggggtgggggcagaggatggaggctcactggagttggttttcatgagcctcccggtcccccagctttcacttcccattaaataaccacgttgtggatgc

SEQ ID NO: 131529 - DNA, 1034 bp, Homo sapiens
aagccgccagatggtggtaggattgtgtgtgggttttgtttcctctgctttttgaaaagtcgtgaagtgggagagactgagaagtgggagattggctggaagattatcatctgataacagtttgcagtgtcttccaccctgtgtgtgggcacaatggtgtcttccaaaaatgtgatgctgaccctacctagcatttgctgaatgtgcagtattagctgtcccgtaaacaccagctgggttattcattacatactcagctgtatacagtagctgaataaaacaggttttttaaaaaaaaaaccacacaggaaattttctgcatgtttttctcttccttgaagattaaaatgagttgttaggattgccattgtagcaaaagggaagttgtacttccttttttgggggctttatgggtttatttttgaatatcttttcaagttcttttacctttgtcctaaggaacctattttcacagcttaaaggactaatgtttctcttctcttagtttccttgaaatcagattgtgtgtttgttgtaagaacatttagatcaagcttgtccaacccatggcctgttggccccatgcgccccaggatggttttgaatgtggcccaacacaaattcatcaactttcttgaaacggtttttttttgcttttattttattttattttatttatttttaagatggagtctcactctgttgcccagactggagtgcaatggcttgatttcggctcactgcaacctccgcctcccgggtccaagcgattttcctgcctcagcttcctgagtagctgggattacaggcgcctgcctccacgcccagctaattttttgtatttttagtagagatggggtttcaccacgctggccaggctggtcttgaactctcaaccttaggtgagccaccatgcccagcctgtttgtttttttagctcatcagctatcattagtgtattttaagtgtggcccaagacaattcttccatgtggcccagagaagccaaaagattggacacacccgactgagatg

SEQ ID NO: 131530 - DNA, 1077 bp, Homo sapiens
ccccgcctgcctgaaaatcatttttcttgccgctggtattctgggaatgattctggaaaaaacattaggcatggactcgaagtctgacacactcatgtgtggtagcggtagacactgccctcgttctctgaccagacagcatttccatctgttggtttaccacttatggacagcatttccatctgttggtttaccacttatgtaatcctaatgagaaaaacagtgggatttgtggcaggccaaagttcaggtgaattgctagtctctagatgaaatgccagttaatctgattgttaatcgatccctatttttgtaaacttgaaatgaaaggttcaaatttgaaatgaaaaagcaatcaagatttcagcaactcagttgcctccttagcgcagtaggtagcacgtcagtctcataatctgaagatttcaacaagtgagtgcctcgttgctcaaggagtgaattgagaagggcttagttctgtccctgatactgtcagtctaggttctaagttgtagcaacagaaatcactgcagaatcagacagggaagttgctgaagaatgtgggggagtccaaaggatccctttctctcctatgttttgtgttcctctactctaatacctgggaactatccgtttccgtctgcttatgtgtctcactctctggtgagacctggactgacagcagggacagtcttgtttgcttttatttttcctctgcccagcactgacatatgggggttgggtcacataatctagccatgggcaggatgtcggaacatactgaagcatattggtgggctgagctcaagtaataaagctgattttttttttttttttttttttttactgcctgaaacaggcacacttaacaacagccgcagcaatgacaaaaacctcatgagaagatgcctgggtcaagggtcttacttccagcagcttccctgcaaatccagtgcaaataaacataggctctcctttgcagtttgttgcagtggaatcttgtctgttgcatgctgaagcgtaggatgttaggcctcttctgacatcacagcagagcgtttgcatgttcatgttgaa

SEQ ID NO: 131531 - DNA, 1025 bp, Homo sapiens
ttcctctttaacgtcattcagcggtattttttgagtgctgctctgtgccatgcaccgtgcaagagaggggagccccacctgcaagaagcttagtcttggcagaggagacaaaaagtaaagagacaatggcaggacgggtgtgacggggcacaggggtctggtttaggcagagaggcgggtcccttggaggcagagcatgggaaatgctgctcagtctaggtgatacccaggcgaggtcttagaggtgcacagaatcctgtgagaagggcaccatcccagcagtggagtgtacagaagctgggaggtaagcagctgaacggtgtgtacagaagctgggaggtaagcaggagcaagaacagagcatttgggagctgccgggacgcctgtcacctgaagtgcgtgtgttggcaggttgtgatgatcttgtttcctgcaaagactctcagatgccagtttaaaagaacacttacagttctgcctttttgtctgttaactttaatagatgtcaactccatgaaattctggtgaaaacctccttgcatgaatattaatcacctgccgttaaccacgtacaagaaaattttagaaaggcaaacttagtaaacatctgtccaaatcatttggagcaaagcactagctccttagatcttccagccatgacactgttgtgttagtgtaaaatgacactgaggatgtgcaaaagttactgaatctaagattgctttgcatctgttttcctgtgttccttggaacctgctttttgtatttgttttcttctccttttttccaagtatctgggaaaagcccctcttctggtctggtgtttgttgtactgtggatgagcagacagctacattatggagagctgccagctaccagagtcattgcagagccagtgtgaaggcaaatgcaggaaacctcatacttggtgtctcctttggattggaaagaatgactctgagctcctgttcctagttgctgtccttcaacctggtcccaggtcataaagagcaagtgtggtttca

SEQ ID NO: 131532 - DNA, 1084 bp, Homo sapiens
ctaagaccattaaatatttaattgaattatttcactgcagggatattgtgactcatgttgaaaactaatcacctgcttttttatctggcccttaatagatctctggttcaacatttaaaggtcagagtcatggcgatcgcagtattgtcattgttttctttcctttgtgggtttgggtggaggaaaggggaagagtgggatgcgtgggaaggaagaggagtcattggaagttgcctttatcagtggagggattccaggggatcataggagctatgcttcttcttttctggccttccctggtcttgattccccagagggataccaggaaggggctggaatgtgggtgcggatgacctctgaactaggcgatcctgtttaatgcaagaaactgtattccctgtccagccattcacgatactgtttcattcgctctatcagagctcagtgaggcgttgaaattccattgttcttctttttaatttaattttttatgcaggaagatgaaaagatgttttaaaatcctcatggttttttcttcctcttctcagtgttattactatgttaacaagatagccattcctgccactaacatctgtgctcagcctgtggtcaggtcctgacttgagtattctagcaataaaatcggtgtacttaattagctttttaggtgactccagcctgtgctgctgcttgtaccatttgatgggaatttcaggaggaaggaattaaggcctgtggacgtgaagacatgtggctgacacagggtttatgttggtaaaagatcaactgtgaaatatttggagtgtccaatgcatgccgtgaccttgctagacacccttgggagttgtagagccagtccgatgccctccacaaataccttggattttctagagaggagcaaaagctatttctcttagaagattttagtgtagcattttcccacagacaaaaatgcccaagtttgggtatgaagccccaactgctaactttctttgcatctgttgaagatgatgaacaggagaaagttaaagcagtggatagaaaaacagttgtgctggctgggcgcagtggctcattcctgtaa

SEQ ID NO: 131533 - DNA, 1046 bp, Homo sapiens
agggagaggtcagatctcgggcttcagagttaggtaccgctatagctaagtatccagctccagaatttcttttttctttttcttttctttttttttttttttttttttgagacggagtcattcaggctggagtgcagtggcgtgatcttggctcactgcaagctccacctctgggttaacgccattttcctgcctcagcctcccaagtagctgggactacaggtgcccgccaccacacctggctaattttttgtattttttttagtagagactgggtttcaccgtgttagccagcatggtctccatctcctgaccttgtgatccgcccgcctcagcctcccaaagtgctgggattacaggtgtgagccaccgcgcctggccatctagctccagaatttcttagctgtgtaactttaagtggcttaatctccttaattcgagccttagttttctcatctataaaatgggggtgatgatagtgcttatgcacagggctgttgaaagaatgaagatgaatgaatgaatgaatgtgtacacagagcttaggcctaggcctggctcatgagtgcccagcacttgtgagctctcatgattaactcatttccctcctgccccaaggaccctcttgggaaataaaacctccctgaagatactttgggatcctgtaaaatccgtgtgtgttactttcagggtctgctgtggtgtaatggaagaagtgcagacttcggagctagacaccacctggctttgagtcctaggtctacccacctatggcaggtttctcttagcctcagtttccccatctttaaaatgaggatgggcaatgaagaattgcctcagagggttgttgcgaggattagatgaaattacacaaggtacttcttggagttcctggctcactgtaggcatttaatccatgcaacttattatttagctgacaaaatgcctataattagatgttagggaaattgctgtcatcgatggggaaagttccccaatggagttggaactgttgactctgctgtcctggcttctccaagtcctgc

SEQ ID NO: 131534 - DNA, 1155 bp, Homo sapiens
agggagattggtgggtcaaggtagtgacctttgtctgtgctgtcctcgggagcacccagctgtggcagcgtgcctggaatccgagtccaggagacctggcctgtccccgtgccccaccttcccaaagctgctgattccttactctttgcctttgacctctgtgctgcgtgtatgtttcaggctcaagggcgaatcctcagggtgcaggccaatgaaatgctcaagtgctctcagtcctccttattttccctttcttatacacatgtttctggctccaggtgtagttggtaactttttatctcagtgatgatgctgccttaaatacatgtgtatttaggaacatgctggtaggtggcacagcattgcaatataccaagcaggttcagaatgccatggccaaaggcctccaaaggtttccataatgatgagaagtaatgagaggcagaatctggtgacttgggttctaagctttatgtgttgatagcagagccagctggtcattttttttgtattagattttgtgctaagtactttatttgcattattttaatttcctcttaaaaccaccttgtaagtaggtactgccctacaaatgagacagtggaggcaggttggggctatgtagctcattgtaggtcacatagaaagtgagtagtgtggctggggctggtacccggatgtttctgactccaaagcctgtgctgtagaccagtgcttctcaaactgtccagtgcctgtgaatggcctggagccttgttaaaaatgtgggcggtgatgcagtgggtcaggcagtgctggggctccatgatcttgctgctggcccataggccccctgagtcacaagtggcctttttcatcctcttcttcctcccagcctttctccacctcctctttcaggtcctcccctctgttcctgctcccaccccacccccacctttcctcccatgtggctgacagtctgctcgggtagcccaggctgcttgcctgttggtgactctgttgatggatggcttgccaaaagatgtggtggcccccattcagcccagtggcatggggtgggcttagactggggccctttagggtccacaacctctttgggctcagggaggaaataggtcacttctgaaggtgacctcttccaggggaggtagaggg

SEQ ID NO: 131535 - DNA, 1368 bp, Homo sapiens
aaaactacaaaacaacaacaacaacaaaaaaaaactagccaggtatgatggtgtgcgcctgtagtcccagctacttgcaaggttcaggtgggaggattgcttgcgcccaggaggttgtggctgcagtgacagccatgattacatcactgtcctccagctggggcaacagagtgagaccctgtctcaaaaaaaaaaaaaattaaaaataaataaataaataaggactggtctatattttatccttcctactggtctcaaaggaagccacctagagtgggtcattgtttgacattttgatgaatttatactttgatacataaattttgaaccagaccatatcttgaagtgtgagagaagtaattatatgaattgcctttggaggctaattctacctgttctctcagtgtggccattactcaaacattttgggaaagcacttctagaaccaccgtcagaaatttaggcggtactaggatcaacaaacattacttcagaaggcactgaagggtttttttgttgttgttggtttttttttttttgagacaggatcttgctctgtcgcccaggctggagtgtgcagtggtgtgatctcagctcactgcaacctccgcctcctgggttcaagtgattctcctccctcagcccctcgagtagctgggattacaggcgtgtgccaccacacccagataattttgtatttttagtagtgacggggtttcaccatgttggccaggctggtctcgaactcctgacctcaagtgacccacccgcctcgacctcccaaagtgcggggattacaagcgtaaacccactgtgcccggcctatgataggttttcacctactgagaatggacttaatttttccttttaggaataagagtcagagctaaggcccaagactaaggcaagtgacaaagccactcaatactatatgtgatcaggagagtttgtgaaggacaaggactccttttattgagtcacttagaaacctaattctgaatgctgttcttaaagatgagttcccaagaggttttgaccaaacataaaattattaaggcctttgatgcctaaaatgacaacaaccctttggctggagaaatttccaggttgtggcaaaatccatctttaaaaatttttttttaattttgtaattttaatttcttatacagatggggtctcactatgttgcccaggctggtctcgaacctctggcctcaagcattcctcctgctttggcctcccaaaacactggaattgtagatgtgagctaccatgccccgcgccaccttattttttactgaccttatgtatgatatgtatgggttagtgaaaggcaggattgaggccgggtgtggtggctcatgcctg

SEQ ID NO: 131536 - DNA, 1066 bp, Homo sapiens
gctcaggacactcacacaaccagtgattgagctcccgttgtctactagatcttgcagtgctatggagagtgtaaagatgattaagctactctccttagcctcaagcaacttagcatggcagatgggagataacctgaaagctgctgattagaatagaccaagagtgataaggaccttctgtgctctgggtagggaggcatgggagatcttataggaacagaggcgttccggcatttgcctgggatgtgtcaagcattacagatgtctctgttgacatagatttctctgctgagctttgcagtgaagaagtcctgagtcttctcagaattagataaccacatccatgtttctacaactaactgttgcacctgctacctgaaggatgaccaaaccagagcttctctgtgtacagactgctgactttaagagtttattctctaaggtgatctagagtttcctgtcatttgactctgttccctgtatttattgctttcttccttttctctgaaatgctattcctttaccttctcttacctttttaaaccctaaaagcaagaaagaactttacttataggaagaaagagctagaggaaggaagtgatgtttggagggtaaataaatggaagtttgggcagctttaacgttccaggctttgagctaggcattgagcgttaactcttacaataacctggggagaatagacagtcatttctttttgtagataagaacagagaatcagaggacagttcattatttcgtacaaaacaaaaagtgcattaagactagtaatgttttaaaaaatcatttgctgtcttttaaactcacagcatagaacggcacttcccaaactccaatgtgcatgggaattgcttgggatcctgtcaaatgtaggttctgattcagcaagtccagcacagatgggtccccaggacactgcatttccgtcacactcccaggtgattctgctgctgctgattcagggagcacactttgaataccaaggacatggactgtgcatttgctagcattttttttttttgaagctacaagagggaaaaatatttag

SEQ ID NO: 131537 - DNA, 1070 bp, Homo sapiens
ataaattccaccccttctagggtgtgaacggaggaggtgaccacctgtttcctgtaggccccagcatgaaacagcagctgggccaaggccaaggttttgcgagtgatctaaccccctccctcctgctttctgcaagtgttcagcacccatcttcccaacaccagatacccagcttaccaccagcctgcccatgttggagccgtgggtctggcttcccctttcctgtgggagaagggccttctggggtctcagcccccaccccatgctgctcaggtttctctcctgtatattcctcactctagattggccatgagtgtgcatcactttaatgtcaccatcccaaaactcccctgactctgtctccctctctagttaccactccattttcctggtccctttcaccgaataaggttgaatgaataaataagttcactttaaagtctagccatcttatttgagctcttcatattgagggagtaggatggctctagaaaagcatgaaccaacacggatgcttcaggatctgacagttctggagccaggtgcttcttttgtggtcttaggcagggctgcgtttcctcatcttttagggtacacgtccaactccctgggtgatcatgctattaaataagggaacatgtaagatatagggcacacagcaaaagattgaaaattaattccttccgtagccatctttatggatgccagaggaaaatcccctcttagttcagagctggacacttctgaatttaataagtaagacctgggagaggataatttcggcagagtcagttgctattggctccttgcccgcagcaaatgctgactgttggttcctctgcagaggatcaaaggtcatcgtgcaaggtcccgatggggccaagaagtccttgtgccaaatgtaaagtggttacccttcaagggcaccctctccaatggcgatgggtgcttaggtactttcggattgtcaaggaagactttgagactcttggtcagctgtacctctaagtggacagctgggtacatttcctgagcaggagtatgaggcctcagtgatcatagataaatgg

SEQ ID NO: 131538 - DNA, 1655 bp, Homo sapiens
ctaagtctgttattgttagttctcacaatggctggctcaagtaggtttcattgctcctgtttcacagatgagaaaactgaggtttaacaccgtgcttaagaacccagaagagccgggcgcagtggctcatgcctgtaatcccagcactttgggaggctgaggcaggcacgtcacctgaggtcaggagttcgagaccagactgaccaatatgactaaaccctgtctctactaaaaacacaaaaattagccaggcgtggtggcatgcacctgtaatctcagctacttgagagtctgagccctgagaatcacttgaacccgggaggcagaggttgcagtgagccgagatcatgccattgcaatgcagactgggcaacaagagtgaaactcatctccaaaaaaaagaaaaaagaaaaaagaaaaaacccagaagaaacatggggctgtcttaacaactcatatttccaacttaggtggatcaatataaatatgttactagctaaggagatgcctagagatctaatagttgtaaagcctccttggacttaaggtgggtgattggcaggaagatgggagctaactgaaacttcaaagggtaggctgactttgggctccttctgttgaaaatggagatgtttttctttccacagtatagtgtcccctccctagtctttgggtgtgtcatcctagcatgtggagcttttgtaaacagaaaatttacagtgagtgaaagctttatctgctgattgattcgttaaattaaaaaaagccttcaatttctgcctactttccattcctatcacatccacaattgaaagcatgtattctgcacctgcctcgtttcagagtttaaatatcttctcagtgaactgcgcctgttatgaaatgctaagtacttgaaaccaaaaccacatggtggttattctggaactgttttcctttcaacttttggagactttctatttactgaaaactaagggtaaatgatttatctttttgctggatttagctgtctataaatttctctgtgccttgaaaaaaaatcacacttattctaatgtgtcctcattcttaataaccacaattggcgggaagaggggaaaaaagatttatctgccagtgagccagttttttgtttaacatctgggtctgatactttttaaattctcttctgtttatctcttccttttattcctactctggtctctccatgcttattggtaaaattagaatttattttcaggtggggaacactctgactccagctacagatacttgatttgttttaggggggccatttgagccaagcaaggtgataaactgaaggatttttacagttctgacatcagaccatctgtccgtctttctgtccagccatcagagcttcttacttcacagcatgttgctaggcactgtgggagagagataccacgataaatcaggtaaagagcccgtttattgagtaatttctgtgttccaaggcctgggctgggcactttccatatgttcttatttaattcctgcagcaactgcacaaggaatcttgttttaactgtacgtttcaaacaaaggaattgaggctcagagagaccctgggactagaaaagacttgtggttatttgaacccatcttaattgtgtctcaatccttttattctt

SEQ ID NO: 131539 - DNA, 1096 bp, Homo sapiens
tccagtttgacatttgcaggttagatttaggcctggaaaccccaccacgtcctgctcaagggacctgaagtggagagagcaggtaaatatttagacaccagtactatttagcaaaattggaggcttaaatgtaatttccttgtttcattcacttggtgaaaagattaattatgtttacgtgatgctaaaattaaattgtggtaatatgaaaatcagacagctcagaactcaaatggtaaatgcatcaagaatctgttctctaaaatccattgtggaatgagcttggtgtgaagaaactcattaattagaaattctttcttagagaatgagcattctaccatgttctgctactgtctagctggcaattgatctcagggactttggagaaccaagactttttcatctgtggttgagatcaaagaagacagagataaggttgccaaggaaaccaaaatgctacagaattatgtgctgctcatgcatttcaatgtggtttgaggtttgggaggctttcttttttttcttttggcacaaataatagtacatgaaaatgagcaatgcccatgttcccaggtcttaaaggaaatgaccacaggcttaatgtaactcaaaccgtgggcctaaagggaatcctattctttctcttctttctgtactcaagcatcagcaattaatggcgtgcttccagttggcttctctttagtgtgctttgtccctctccatcacagacacatacccacacccacaaactttttaataactttttcctgactttaaataaattacttgcacagaatttcaaaaatacaaacaattctctgacaacatataaaagttacctgtaattttgccatttggaaatacctaatgtagtattttgttgtacttttctcctaatatttatagacacaatgggtacatactattttaaatatatttataacatgaaatcccaaagttttgagtacagattttcgtggttttttttttttttttttttttttgagacggaatttcgctcttgttgcccagggtggagtgcaatggtgcgatcttggctcaccacagcctctgcctccccagttcaagcgattct

SEQ ID NO: 131540 - DNA, 2060 bp, Homo sapiens
ataggcacctgccaccatgcccagataatttttatatttttagtagagacggggtttcaccaggtcggccaggctggtctccaaatcttcacctgtttctttttacgtgactgtggcctttagaaatttttaaacgactcatgtggcttacattgtggcttgttttgtatttctgttgggtattgttaatgtatagaagacattcctcggctgggcatggtggctcattcctgtaatcctagcactttgggaggctgaggcagatggctcacctgaggtcaggagtttgagaccagcctggccaacatggtgaaaccctgtctctacaaaaaattagccaggcatggtggcatgcacctgtagtcccagctactcgggaggctgaggcaggagaatcacttgaacctgggaggcagaggttgcagtgagccaagattgtgccattgcactccagcctgggcaacagagcaagactccctctcaaaataaataaagaagacatttctctactggctaagaagttggaataaatgtttaccgagtcccatccaattattaaacagcttatgattcttactaaacagggaggattaggagaagggaacccctggggtggttgaaatgggtgaatctagccaggagaaggtttccgaggggagaggtggccttggaactgagttttgaagttggagactgaaaatcctttagggagaagaaaattgacacaaccgggctttctgacagacaaggactggcccacccctgcctctaaggaaccctggggtctgggagaggacccaaaagccttcttctaggggagcacgcctggcagctctgagatatgaaagagagaacccagcaaaaacaggatgtcactgggtcctcgagtctggggatcagggtaacccaggctcagtgaatttttctgtctctgagcccctcagatgaattagcgagttcttcagggagggtctttttctccatggctggtactgtctgactgggtggagacttatgtcccaggaaaaccgaaataactgcttttcttgcaaatgctttcacatagctctttatctggtctgtggtttcagggaagggcccttctgcagtcaggaattgtccccagcctttatttagagggctaagctagggaaatggttctgaatgtaacatgtttctaactgtagtaatctatgcccctccccccccaccaaaaaaaaaaagaccatgtggactgtatttggtagccataggtaggtagagcagtaaaatacaatttatatgattgtgctgtgtgtgctgtgtatgtcaaagcatgctcttcacacggcatgtcacgctcaagttcttgaactgccacacgtgactgcctggtgctatcagcatactttgtggtatgttatcagctgaaaccagaagtctttttgaaaaatgtcattgttgcatggggctttaatactgaaatcctaggaggtggcctttcttaggtcataattttttaaattgctgtaatgcatgtttaaagaacgacagtacacacgagaagacaaaaagtggcctgaagctttgggtggaagtcaggtagatttgattcagcaagtaatagaagtcaacatttaatgaacacttgctttgtgccaagcacactgttgtaagcactttaaatatattaagttatttaggtctcacaactttgtatgatagtttattatttccatttcacagataaatgagcttgggcacagagaggtaaactgatgtcctcaaggtcaacagctactaggtggaggagttgaaatttgaatccgggccatacaccattgttaatcgagcatttgtgttaactaccaagtacttactgggccctggggatggctctggagcagtggataagtcagatagctccgatccttgcttgccaagccataccatcattctcagcttcagtttccccaaccgtaaaaccagcacccaaaccctgccctgcgcacctgctaagatttgtttgttaggatcagttgcattaatgcaggaaaatgtgatgttcgtgcatggcagaa

SEQ ID NO: 131541 - DNA, 1027 bp, Homo sapiens
cgtggttgagacctggaaatgtacgcagctggccaaggtcaccttctagtagcaattacgctgggttaggatcagtgttggtgacttcctggtgttcttggcataaggatatacatcatacttcatgtggtctagtatgaacctttcaatgtttatacttcatgaaactcttgtttttcttaaaattctccagaattttgattgatcatttctcctgatctttgaggagggaggaagaacttctctgctatagaactcgttaatatgcctcacattttcagaaagtcctctcaccgtggaaagtgacagaggtggagagagtggatgggaacatgtgcttctgtgatgctttgcgtgccagggaattgtttctttgctaatgatctgtgtcattaaaatgaacactggatgagcgaagacggtgaaacatttaactgtaggttaataattcatttagcaaatattctaaccttcaggattgtatcagcagctaccatcaggagcgcttcaggcctgtccctcctttctttggagtcgaggcttgaggaacttgctcctcccacagctacaggtcagcgacgatgatacacctcattaccctcgtgtggggtagcagtaagacgtttccagaagcatccgtctagcaggagctctggaatgtaagtaacccaagaagtggctgttctgtaacttctctgtgatggaagtctgtgataggaaggaggccttttcctgcaaccaggatgtctaaccgcttcctgatgggcatggaggggatcagtgagttaaagtttccggcatctgttgaatgcgatttgtgtctagtagttctgtcgattataggcatctcccagcagcctcaaggaaagtcacacatgcttgtatatcctagggggaaaagggagatatttttatgcaaagtaaatgttatgaatccctgttttatttttttgtgtttgttttgttttgttttgttttgagatggagtcttgctctgttgcccaggctggagcgcactggcgcgatc

SEQ ID NO: 131542 - DNA, 1048 bp, Homo sapiens
ctcactgcctgaagtaattgcttcttagaaatagccactgcatttgttgctatcttcatgttacccaggtgggagcggagcggcccaggtgttgtcccatcaatgcacttgagtagagaatccaggatgaatgctaggcacattacatggtccccttggatgtgacaacaatcatatctggtctgtttcctcctaagaatttctgaggactttaaaatttaaccagtgggaccagtacagtttaaatgtattagctgcttgccagtaggagccaaatcataattcttagcctttaatctcctgagaaatgagctgagcagcgccatgtgatttttaggtagcttttctggaattagactagagtggccattcatgtgtttcaatctaagtgtttcactttaaagggcgaccttcctaaatattatcagctaaaggcataccctatatacacatgattcccgagatgcaagtcacagaaatagattgagtgtcatggagaaaaacttaataaactataaattctcagatacacagaatgtgaactgttaaattactatggtaattgataccatttagctattattatttaattatttaaagtcccctcattcttctaaacagggcagaagggtactttaataatgcactttttattgtgcattattcatttcatcgaatcatccatgattctggttatatctcaggttcttaactagtgttgagttcttgtaaaggaattgcttactgagttcagttggcaggttaatattaagaggtatcctctaaaacaaagttcaaaattgctggggtttgttcagattcatttgaaataatgcaaagattacagcaagctttataaaatgaaaattagttgaggctcctaaaagaaaagcccgtagcctggatggtgcaaacaacagaaatttacttctcacaactttggaggctgggaagtccaagatcgaggtgctggctaatatgatctggatctgtgtccctgcccaaatctcatgttgaattgtaatccccagtgttggagatggggcct

SEQ ID NO: 131543 - DNA, 1881 bp, Homo sapiens
tgacaggtcctgaatgtatgctgagcaaactgtgaacaggctgtcgcagctatggtgagttgtgggaaagaggggaatcctttatgggacagtgctgattggacttcccaggttcctccctagccccggcctttgaggggtggtgtttgtagcgggtggctgaccaggaaggaagccttaccacccctcacctgggctgaggaggctctgcttcgtgcctctcccagcagtgtctgcacctttggcgtggctaggactccactacctgaccctgtggcctgtccagttttcaagctgatggtcacacgtatcttcccagctgcggggctccttttgtgttcacctgagacaatcgtagcttctgtttctaagagctagtgctttgatcatgttttcatcagaaaaacatggttcatgaacttgctctttgtctagatcctgtaataatcaggttgtgcaggcatgaattgttagtaaaaattcatcagtttacagaaaaaaaaaaaacctagaagaaaataaagggacacgtctaacattggtgttgtttctgggtagtgcgtgtatggggaccattttcctaaggtttttacttttcaggttatcctttcattttggaaaaagacgataaatattatttcttaaaacctacatgtgttggtgagctgttgttactgaaaccctttcctccaaggatgaaggttctgaatgataaactttttaatgatcacactcatcccactgccctctggcatcttattggtggctgggtctggttttacttttcactgaatgttccattttctctgttgattgacgatggcctcagggccaagaggtgactactgtcagaggatacagtgtgaaccaaattgtgcgtgtgtgtacgtgtgcgtgggagggtgtgtatgtgtgttccactcggaccttggggcacaagtccctcatcctttgctcttgtgggaagacactggaccaggctgcttagtatagaggagaaccagagtatcacagggcacccaggaggaagagaggcatgggagagttgaggggcatttccatactgcactagcatgaaagctgtaccacattcagaattttagaacactgatatcatgtgcatttagaacaagcttcgtagaaatattgtggctgctctgattcctccactaagccagagcctcatatttggtgtgtagtgggaggcatctcagccccagcaagtgggagggagggttaatgctctaaacaaggaacttcctcttctgttggaggcgtgggttagtgatctgtgctgttgtgtgggaagccttgttgatttatccccttgatcttgcctccacccttcagcttgagggtgtgtgtgtgtgtgtgtgtgtgtgtgtgtgtgtgtgtgtgcatgcgcatgggcaactttctaaataccaaaatatacattctaattataaactagtgccattcgttccttgcccccaccctcccttgtttactttcttttggataaagtgctgcttctttcgaagggcccctgtttctgtggcacagcctattccagatcactcaaacgggtgtttgtgcttttctgattcctaactctgggctgccgaatgctttttcatctcctacaattgagctcagagccagagaagggcttttgaaggttcatttctgaaatgtacacatgtgtactgtcttgaagtccaagcatatcctcgggacagctgtgtggctttgagatctactcagagtggccatcctacctgccatgtttctggggggtggtacttttcagtatgtgaaaagagactgcttctaatactctatggctcttattcaagttcaagttccatgggaactgaatcacaaggtctggttttagga

SEQ ID NO: 131544 - DNA, 2738 bp, Homo sapiens
tgagactgagcgagtgggtgaactgtggatgaaatgttacgaactcaggtctgcggagatggaaaaaggagagaaggcagtgcccacggaatgaatcgaagagaaaaatagaattagtcactgaacagattatcgaattgagcaaatctttaaagaattccaaagatagaaatgtcttggacacagcaggactaatttttgtttcaacattggaaggcagccctgcttcttattatagacatgttcaaatagtttaagtgctggttactgaccagattatctggtacaaacatttatattacagcaagttacttaccctctccaagcttagtgttcatatgaataagatggggataaaaaaaatgcttatttcctcaaatccaagaactatcaatttagttgtacctttagtttatgtagcactaaggaaaaaaaaaatcctgccaactaaaatatgaaatgcctttcagagttgttaacatgtcggggggaaagaatgaactgtaaaatggattctaggattggtcttagaaacaatgaaatagaatagtctacttcctagtgttactgtgaacagtgccagatgtgtagcagttgctcactgtatttgatgatgaggatggtggtggtgacggtggtagtgtttgtgtagaaggaaacaggcctggaggctgaagcaactatgacttgatgtaagcaaaagctactagtcaagtgctctcgttgcggattttgctattttagagtagaggggtctcctgacacacaagagccctgttgcctgcaattctatgttaccagaggctgtgagtgtgtatgcttttaggtataatatgaccaagtggtcatatgcctatttaaaacctaaggggaaatgaagggctcaattttagagtgtggcttctaatcttgtgtgctcctaaactctggtctacatactcccaacgattaaagagacattttgcaacctgaaatggttgggttcagactagaatgcttgggtgctaccaaattaaaggccagtaggaagctacttggagaagcagcctctggcactgtggtagaggagcatttatctagagacgggcctcgctggaaggagatagccacgcctgtgtctcaggagactttaattagggccattggcttggctgccccatgatgacaggttgaacttacgcctgtggttctaagtcatgaaaccacccctgggaacagcccagcagaaccatgggtggcacctccaaggactggagagggggtagccctgcaggcgctggcttctgcctgctggcttccagctgctccctcctggggttccccacctggacctcacctgcttctcctgctgaagtgtcttctcaccgacctgggcacaggttacttctgtgctgtgctttgctttatttctcctttgtctgcagacaccactgggccagcaccagtccatcccgggtttttagactcgaactgaggtgtcatctcctgaggagcccctgtgatctgcgctcctctctgtgctccgtgatgccctaggcttctctctgtcatggcgtttcctgtcctaactttctgtctatgtgtgtgtctctgccctccttgaggaatgggaccacgtcttactcatctttgtattcactgtgcttttcctgtaggaggccatttacaaaaggacacgggaatggacagaggggcaaaatatcgaaagctgatatttggagggtctgcagaggaggtgggaggaggatggcttttctaagtatcctcaggaataaggagccacatatgcaggggagccaagaaagggaaaaggaaaatttacagaatctattgctttaaagagtgtggggagaaaggggaggtgggacggttctactcttgaccttggtgggagcatggattgggcgggtgggggttctgggctgatgatgcatgccaaagctgggtttcctaactggcctcagaggcttccgatttgaggaagggggatgggagggccgagtgagcacaggggttggtggttttcctccccttcagaggacacgtgtccttggcttcatttgtaggtctttgccaaggtgtctatgggaagcctccttgagcaaaggggctccaaggctgtggacgtgtgtgtctgtcagtctgtctgtctgtctgtcttagcatgaggtttagcaggcagcctcaggaaaaacttacagcccgaaagggagtgtctggccatgctgctggcactccctcttttcctagagacacgtgtgcaggtgtctgagtgcaggctaagtacaagttgcccatttcggctccagaacccagccaggcagctgttggcatagcatccctgagggaggtttcagcgttgggtggggagtggggcccagatactgatatccagtgttctcacctggctaaaggagagcagctgccccttggttacctggagaaaacaatcaggaaaggctcgtggtcacgtctcggtcccttggatcattaggtagttgcccttgatttccgtgagctttatctgactgcaagggtacattacacggtccccttggataccacgacaattgtacctggtctgtttcctcccaagaattttggaggactttaaaatttaacccgtgggagggcagggagggaagtcttggtacttacaaataaaaaagcattactgccttattctcccaccccctcccccaatatttacaaatataataaataatagctttcgttta

SEQ ID NO: 131545 - DNA, 1135 bp, Homo sapiens
ctttccttagttcagatctgatcacccctcttccctctttgaaaactccccaggacccccattaatggtcacatgataaagctcactatctgccaactggtatgctaaccctcggccagctgggctcactctgcgctgatgacccctcctcattctccctccaccctccctatcccatgaccaacaccctatcacaggggcccttcatctttttggacctcagaccccttcaaggaacagacagctatggactgcctccctagaaaggtacatagtcactcagttttccattcagtttcaaggggtctgtggatcccggtggcgaacttagccggatgcccatgctagaccatgcattctaagcctctttgtcgtggcttgtgccattttctcttatatctttgttcctttgtctttgttcctgtgtttccatcagtatttttcttcagtgcactttcctgtcagagttaatttttccctctatcgtgcttgtacagcacattaccagaacatctatttagcatttgtattagagttgatagtttgcatggctgccttgcccttgtgttcctgagcacagtgccttgcatgtgttatacacacagtcatgtgtccatttattcattgattcaacagtttcttaagctcttgtgagctagccacagtgcttgtcctggggctgtgctaggaaatatgatccagtccccaccccagggagatcagtttaatggagactgtaaacagataagcagaatgttatcatgcagtgagactattgaacatttactgtgtgctgggtgctaatgagcacattgtattaatatgtgtgttgtctctgaattctcacaacagctttgtgaaatagggtctaatattttatggatgaaacaatggagaccacagctaggttaagtaacttgcccaaaatcgtgagactcatcagcagtagagtggaacttcaacactgtagactgtctctgggggccagatttttttttttttttttttgagaaggagtttcactcgtattgcccaggctggagtgcaatggcacaatctcagctcaccacaacctccgcctccggggttcaagtgattctcctgcctcagcctcctgagtagcttggattacagg

SEQ ID NO: 131546 - DNA, 3025 bp, Homo sapiens
aactttgggggttgctgtgcacgccatgcaattttagagtagaaggcagccaggagggcgagactagtgaagggggcttcgtgagaaagtcgtgactttcctggcccttgaggacttggcaagtgggtggaaagagggaggacagtctagcaagaggggccccatcattcgaggtatggtgtccagcttggtacccatgcatgactgtgaggagacaggtctctggagtggagaacgggggtagaagcaatgggagaaagaaggttggtgcgggtcatgaggtcaggtgaggatttgattctggaggagggctcagtgggaaaattttggaggtcagaaatcttatggggagaaaagtatttgagggagcctagcctgtcatggtggatgtggaagggaggtcagtttagaaaggcagtggttggagcaatctaccccaatgagcttattggcattggcatgcaaaggcttttcaggaaaaaaagaaaaagaaaaaagaaaaatgttctagaagatcatagccatgatcttgatggcttcatcaggactaatcactatggaaaattaaggatgcccatttcttatatttaatgcggtagctgtgttttcttttggttgacctggccttttggcactcctgggctctgtatcttaagccattttagagaaattatttgatgtcctcagagggaggagaatgctaaaaccacctcttttaatctgcggtctctggacttttcctctttaaccactttggagacgggatgaattggtttcttagtaattaagagccaggagctctttttattgcttgtccttaacctctgacttcactgccccagtctaaacatccaaatgagatgatgttatgaaagctcttggtaagccctagggtgctgtacaaatggtgtttatctgaagctcacttccttgcttttagtcatgttgctgaaatgatcaatcctaagtgtatcatgtttgctgagctcatacatacatttgtatttaaatttgtagctttttattgattttcgagactcctttgcaagtacgacgacgtcaggagtccctaaccatacctgccaggctgtgtggggtgccgccaggctgtgtggggtgccgccaggctgtgtggggtgccgccaggctgtgtggggtgccgcccgcctgagtgtaatctcctttgccaccactagtcccttttgtttgttcaaccatattggccaaattcctttccatcccaggatcacaatatttgctgttccctctgtttggttgctcttctgcagatctttgtgtggtttcagctcaaatataacctcaggagggccttttctgaccgcccagcaaaaataccccatcctcctcccactgcacaccccatttatcctttctgttccttggcagtgttttatggcacttagaattctatgaaattcttatttgttttcatgacctgttttgcctgtttccaccctcccactagcatgtaggctccatgagggcagcactttgtcttgtgttctctgtatccacagtacctggcgctcagtaaatatttattgagtgaatgaaatgaataagaagtttacatgaatgaatgttaaaatagcctgtgcttgcagacacatcctactgcagagatatttggatgctattagtagagcaggagcaagacgcgcgtaccatctgcctttatctagtgtagggagattcctctagtgttctgtagctatccactttcttttaccagtactaaactcaaaagagtaaacattaactttgcttagccaaatgaaaccagcagattttagcacatgatctataaaggtcattgctttgctttgtgtccctgaatgtatatagacaaagacactgaatgttagtagaaagcagccagaaatatgtaggtcactgtctttgactcatttttggctggaaccttctgcagtggtcctacaaaacaaaccccaaaataaacaaaactaccttcaatatattcactagccagctctcttgtttgccccaagtccaagaaatctggccttcatctaaaggaactgttttcttacttaggatgtcaatcattaaaagtgttcatttcatgtttggagtgagctgtactgtaaatgctgggctgtgtggttgtatcagtttgtgcaaacagtaggagccaaggacgttttattcacccctgagttagcatcatttgtcacactatctcagcggagcgagacggtggacacctacacagtttctcaggctgtgctttctactaattgtttgtttaattagaaaatgagtaattatttatccagaaaatagaatccaaaaccgtggggctgaaatcttctctaattgcaccatgtgatcatgcttttctgaggattgtatttttggtgtgtgtaggtggtaggggagtcttattttgtggctggtgtttactgagagatccatcttttgctcagcacctcaagtggaacaaaatgaagtcagtggcaatcaacctgctttgtaaaaaagtttaaaagccaggtacaatcagaatatctgtctaaacagtgaggtttgtattcattcaatagctttggggacctgctacatgtaggacatcattgaaggtaaactaatgtgtgggaaagggcccctgtgtacaagaaggtggtaatggtggtttgcacttcacgggaacaaagggagtcaaaccttgacaagctttgtggaatttgctgggcaaaagcttgtttggggtgagatcctgtcgatatagctaagaatggagtttgggttctgggtataggtcagctttttgatgggtgaccaaacacactgaggtcttcattgtggctaactgctgatgccgtttcatctttcttttctggtcccgttcagaggtatgaattttcccttcctaatagccgagtctggcatgctgtcgaagagtgtcacgggtaggtgctaagttgaccttgtaggtctgttttccatcctgacacaaaggggctactgggaagtttttagccag

SEQ ID NO: 131547 - DNA, 1022 bp, Homo sapiens
tgaggctccatctcaaaaaataaaaaaataaaataatatattctgtacctgccccttagacagtctggttcattaagtttcttggaaaggttcagggaagagccttgtgccctccgaggtgaccgggtgagatgtggtttggagccccttccaccctggatcatgctgcagcttggatcattgaccctgtctcctgctctctgaggaagaggacccttcctgtgtctggagcaagggccatggatttcacagttgggtggcactgacaaagctgcaaaggctcgatggctttattagcaactcaccttgtgccatttttcaggtagatctggctgttggttccatgaaatatgggcacgttggtgaaatactcttaggcttctaaaaaagagaaaggaaaaaaaagaaatagtgctttcctctgctcgacacaccacagttccagcttcaggatgccctaacacaaggcaagagaaacgtgcagctttgaatctgggtctccttctcttcttgtagtaacataaattgacgcggcccatctgtgctgcttcagaacaaacaagaatgaagtcatggtgcttaaaatagcacagggtggagtggctgagagcaactctcactcttccacctcccctggggactttcacgcagggttttggaatggtggctgtgggttcggttcccttggcaccacatctgggtcatgcatgtgcttgtgaccagcttttactccacgtgcaggcagtactcttaaagagtgatttttttttttttttttgtgagacagagtcttgctctgtcacccaggctggagtacagtggtgcgatctaggctcactgcaacctccacctcccgggttcaagcgattctcctgccttagcctcccgagtagctgggattacaggcgcctgctaccattcccagctaaggagtgattttctctgagagggacatttgctgtgaaagtgagtgtggtctcttatttaatgttatgtggctttcccttcttcatatctcctgt

SEQ ID NO: 131548 - DNA, 1486 bp, Homo sapiens
gcctggctcctaaggtgagattgcattttgccccttcaagtaacctactgtgattgcactcgctttatactgaatttgaagccccaaaccttggattaaaaaagaattcaagggaacggagaccttttcacttgatacttgaagattcttaacacctagagggagttgagactctttgttttgctgagaagttgtcttggaagcagtgacaatattgatgttgacaacattagcctctccattacctgagtttagatttgagcacgttctttcatttgcccagacctgtagcagagcagcagaaggctggccaggttgcctcacatttgcgtctgtccacatgaggttttgagctcagagtctttggatggtcgtgagatcttgacttgataaaaatggctctgttcaaagaaaggtctgagtgttctggtcactaaattagatggcaaagatttggagatgaagagctttgctttggtctttcctgtatcatttttctttccatgtccctgcagtgtctttactttttaaagaatttaatctttaataccatctttgcattttccatgcatgttaggaataatgtccagttttgagacagtcctgttacacattctgagttatgattaatttttaaaaatcaaattattaatcaatacctttttattccttcacaaacgcttcatgtgcccgacttagccttagaagttcttcattgtttttcttattataaaagtggggtgggattagaaagtgatggcttaatgaggaaggaagcacagctcaaatgccattcatatgaccagggtctacctcacatacttgttagaatgaaatgtgaaagtgccttaaaagacgtcacctgctacatgaatgtctaccgcaacattattcgtgataaccaaaaggcggaaacatctcagctgcccattactggatgaatggataaacaaattgcggtatgtacataatggaatattattcaaccgtaaaaagggacgaagtgcagatgctacaacttggatgaacctcaaacgtgttagtgaaagtcaagagacaagaggtctcatatcatataattccacttatggggaatgctcaggataggtaaatccatagagataggaagcagtttccaggttgccagaggttggtgagagtagggaatggggaatgactgcttagtggccatgggggtttattttggggcactgaaaatgtttttgaactaggtagaggtggtcattactcacattgtgaatgcactgaacgcttctgaatcgttcacttcaaagtgattttgtcttatgtcaatttcacttcaaaatataaaacacacacatgcataatctgcatcaatgtcactatatatggtacaccctattcatcaccaggacctgtcagcctggatgtacttggtccccaaccctgtgtcagagggagaaccaaacacacctttacacataggggacccgaacagagctca

SEQ ID NO: 131549 - DNA, 1048 bp, Homo sapiens
aacgttaaaacatttgtgtataagaaactttttttcttttttttttgcttactttaaatggaagtgctgtcacattaaacatcaggtttaaatcacatggaaataaaatggggccagatagttgaatgtactgtcatttcactactttaggaaacatcaggagaggaaccaagatggtctgaaaaggtcatagactggggaaggaagggctgggatgaccatttgtcagctttcaaaaagcaagacaaaatggttatgcctggttcagatcccagccatttttgttttcttcaagaaagtggttagaaatgtgttttggtttcagaaaagccctggttttctttgatgtttagtataaatttggcttgaaatgccatattccatcattgtcatatgtaggcatgtgctttttgtgtgtgctgtaaggacaatgtctacactgggtcatttccctccccacccagttccccttcgttgaagtaggagctgctgtttcagttagctgccctgagctggccttgcagttagccactggcccattcagcagcctggtctccccttgctgactccaggcttccttctgcatcacgagagccaaaccggccactttagcctcctgtctactgtattcttaccctgcaggaatggaggctgtaggctagagcctgcctgttccgtgaggctcagatccaaaggcttactctcctggaatggggcctctctcctgtctctgtgccgcccctcacacctgtggccttgtgcactgatggattatttgcccgaggtgaagaggaagcgttgaagggatagccgtgttagttttggattccagctactttgctgctgatggttgtgcaacctccagggacctgctatttagcaaatagggccgagcacagcctgggggaggctgccgaagatgggggtgggcacaagttgatgactagtgtccccacccctgctctgacttcacttaaagacaacccccaaaatggctttagcgtaaaatggaaaagatggtaaattattctggcgtgagggctaccct

SEQ ID NO: 131550 - DNA, 1023 bp, Homo sapiens
tccatagacatacctcttaaaccaaacctaactttgtagcttatctgcccccacttcattatctttagttgacatttggggccagtgatggaacccggtggtatctgtctggcacactcacaaagaaagtgttattaaatctctcaaatacatgtagcaggtcaaatatatgccttttcttatgatgttgaagttttcaattactgctgcttttatgagggagaaggaaaatctacccatccttttagaaatgaatgttcctaatctcattgcttccttgaaacatggccgccttgtcattcgttcttttctttatgcttgcaactcacaaaatcttgttcttttctgttgctctataatttataaaaccgtgttgcagttggcttggttagaatttacttaggcatagttgagcctttagattttccttctggcatggacaaaagcgtcattaattatgaatatgaattcctttgcaaaatgacaagattgaacatttcctcatgccagtaacccagctgtctcattctgatgtgcaacaaagactttttagagattgtttttaatggccgtggtatcagacactaaaaaataagaagcttaaaaggaatgcaaagtagcttacagttcattcgtctagaaaaaaagaaataaagaaaggtttttgctatcctgtggctgtctttactctgattgtacatttgcaatctccaagttttggccgtggctgcaaaccaaatggttgtgctgctctgctgttgtcagatacaagattctatttgttcagatgatcagtatttgagaatcctatggcccaggtcactttttcggtctccttggtttgataatggaaatgggagtggtgtcagagcccccaccgcatgtgggtaccggcttgttatggcctcaccaccatccacttggtaacttctcttattgacactggaagaggctgcaactgggctctgattccagagcctggaggcttttaactgctgtattatggggtcttggtcctgagtg

SEQ ID NO: 131551 - DNA, 1070 bp, Homo sapiens
aacatctttttaaaaatggcccgggcatgtgaagtttgtcttacgattccccattttttttaaagctgtcattgtttggggtgtgctttctatgaaacttcagactttgtgttgagcccaggacagtagggtgtcatgcatttttagcatttttacaactcatactatacataagaactagaaataacaaatgaatctgtatatttttaaagagtgtttttattttataaatttaaaaaaataccttgtttttgatgtttttcagttgatggagttatggttgcttatgtgtttgattattttgacgggcaagtacgtatatttaggagatttgtaaccatgagcctagcattactgctgataaaacgaatccctcctttctaatcccattgctcttttcttgatgtaaaaactgatgcctggcgacagcactgttccccatttgacaagtggccttttattattgatctttggttgggtagcagcagttgccagagagaattgttcattgtggtcaaccagtgctcctgcctcagtcgtgttttgcttttaaccatgtcttcctggaatgacacttgaaagggcagtcatcatgtgttagcccagaatgaactcaccggaatcccacatttaccaaaacatatcctggatcctcagggcaggatgtcaccagaattctataatcctccagcagggacagtgagggatatcagaattccacacccaagcatgtgtgtctgtcctgctcaggattgtcttacccctaacagagagaaagtcttgctccattcaatggggtttccccattaggctttagtgtatttccccagatgatacttgaattacatctggatgtgtgtgtgctgttccctgtctaacctcggcagccttcatcaatgccggtgaattatgcgatggtggtggcggcggcgggagcagcagcagtggggaggaaggtccaagcttggagaggatgtgtgtttttatgggtgactgagttgatttgtgtgcagcgtggttatttgtgttgttaggcagtttacataataaagtggtttactcagcagttg

SEQ ID NO: 131552 - DNA, 2581 bp, Homo sapiens
atgcctactttttagggtaacaaatttaagattctggacattaaagatgatctagtctgcctgggatccatttccttccttctgagaatctgaaatgccttcctcaggcattggatgtattaccatctaaacttccctgagatggttgttcaaaaccatgaaagtaattacagaggcagatgaaaatgagagtcacacaacactgctcttcaaaggcccttgctgacacaagcagatggcacagtggccgggatgggccagtgctgactaagagggagtgtgtcgtccgctctgtactccgcgcaagtccctgatgtgtaagggcacaggcttacaggcgtacgaattttattccccattttgatcccattttgattctgaatgcattaaaaaaaatctgtgtagcacaaaaaataatctatgttgttgaaataacaaaagtctatatgcggtagttagaataacaactagcttgggatctgggatacgtaggtttgacttcgtgcctttgcagctatgtgaccttgagtaaatatttcccttctctgggcttccattttcccacctataaagggcctaggagcctagatcatcacaagtaatttttttttggctctaatattctatgatttaaaatcttgccttggttcttattagctatgaatgaagtgtaaatttccttttctatattatctttagagcttccaatttttgctctgagtacaaaggaagtggaggaagcaagattaagccaaagataatggagagagaaggttagaagagaaaagggaaaattacagatgggcatttgggttgaggtcccctctcagacttggagtgtgtgtaggaggaaggcaggtggacgccggaccttctaggacaggcatcgaaggctggtccatcagacatgcgctttaatcagtgagtctggatcgccgaggttggtgaagcatgttggtgaagaaaattgctgatggcttagttcttacaaatgtgttacacatttgcagtacagattttggtaaatgccatggtctccagatctggcattaggcatcacagtcactcaagaagttcactttaagggacagatttcaaggccctgccactcccatggaatcagaataactgggtgagacccaggaatctccaattttgaaaagctttccaggagatgttgctctccattgaggtatgtttgtgctgtcctgtaaagcctcttgccatcttgccataacccacctgtccgatgacatctccccacccatggccggcaactgcacccacaaagaactgctcactgttttctgaaacccttaaaacccttgatccctatctgctggcacatgtgcattccaggcccagaatgtcctttccagccctccccttcttcaccctgtttgtatgcttgaggatctgctgcttgtctcccaggagtttaagagctgtatcacttgtgagacctttgtcttccctcaggaagtaaactgggtccttgctcagggcctcgggggacatgctggggtcagaggattcccctagctgtgctgtcactatcttccccaccagattggagacacctctaacaggacctgctccttcctgaggaactcactttcccagatgctgagtatctggccttcagcagggtgcagacccatctgctgaatgaacgactgcgtgcaaacagtagcttccacttttatgcagccctcatggatcctggtgggaagcccgtcagttctcgagcaaggggctgttgggatggggtcttggcaggattcctccctggagttcagaatttgaatcttggtgacccctccctgaggtcaagtctctggtgcaaaggacaactgggtagaaggcactcaccctgcttcatggatggagtggaggaggggagggaatctttcctctgaggggagaaggtgctgggttgtttgggttcccagctgggttgtttcctggctccagccagactgctcttgtttgctcctgagttttattttaaccagattgtttaattgagacttcactagcctttaacttctggattgcctttggtgttcaagcccagaactctttcgtgtaattagagtcttactatttctacctagcaaactttttttttttctttttaaaaagattgatgcatccacatgttatgggggcacatatgatactttgataaattgatataatgtgtaaagttcgaatcatttgagaggccgaggtgggtggatcacttgatgtcaggagttagagaccagcctggtcaacatggcgagatcctggctctactaaaaatacaaaaaaattagctgagcttggtggcgggcctctaattccagctactcgggaggctgaggcatgacaatcacttgaactcaggaggcggaggttgcaatgagccaagatcatgccactgcactccagcctgggtaatggagtgagactctgtctcaaaaaaaaaaaaaaaaaatcagggtaattgggatatctatcacctgaaatatttgtcttcttattactacttaccaaactctttagcctcaaactgaaaacaattttttttcaaatt

SEQ ID NO: 131553 - DNA, 2754 bp, Homo sapiens
ttgtatttttagtagagatggggtttcaccatgttagccaggctagtctccaactccttacctcaggtgatctgcccgcctcagcctcccatagtgctgggattacaggcgtgagccaccgtgcctggcccagaatatgtctttttttttttttaagctgctctactgttttaaggaacttagatatctggcattgcatgtttgaggctctgtgataataatgtttttatattttaatgtttaattcttggatggatcctgtagatggactggaaagagattcccagattgtccataagttcctgtagtgggaacctgggattctgaagatgctgctcccagaatggttcttggcgggacactgcagggcctggaaattgtcatctttgaagggaagaaaaacagccattatttgtgcaaaaagaaaccaaagagcctcactgcagaagtgatgggggtagagtaggagtttggaggtgatgtatttcaccaaaggcaaataatctcatagtgaacaaactcctgctttgacatttttttttctttttttttttttgagacggactcttgctcttgtcacccaggctggaatgcagtggcacaatctcagctcactgcaaccttcccctctagggttcaagtgattctcctgcctcagcctcccaagtagctgggattacaggcgcccaccatcacgcccagctaatttttgtatttttagtagagacagggtttcgtcatgttggccagactggtctcgaactcctgacctcatgatctacctgcctcggccttccaaagtactgggattacaggcgggagccaccgcatctggctgctttgacatatttttagaccatgggatttcagatcatttttagtgatgccaggatactttctgtttaaaatccatacgtgctactattttcattgaatgtgggagtgtgagaactctcaaataacctaaaagtatatgggtgatagaaagaaggtatattttacagagataagagaaactcgaatgtccttcttagtaagtgtcagaagtgacttttattaatttttacttaaaaatttaaaaaataggacatgctctttagtttaaaaaattgaaataagtaggctgggcgcagtggctcacacctgtaatcccagcatttgggaggccgaggcaggtggattacctgagatcagaagttcaagactaccctgaccaacatgttgaaatcctgtctctactaaaagtataaaaattagccaggcagaggagtgggcacctgtaatcccagctacttgggaggctgaggcaggagaatcgcttgaactcgggaggtggaggttgcagtgagctgagattgcgccactgcactccagcctgggtgacagagcaagactctgtgtccaaaaaaaaaattgaaataaatatataaactaaaatttatcctccccacttccccgcccctcccgggaattgggtttagtgtcatttacagatgtttttgcatatataaacaaacatgctgggaggaaaaaaaaaaaacaacactagttttccacaatatgtggaatgacacatggaataaaatatacctgtgtgacctttttcagaaggtagcccctaagaaacattgttctgtgctttttactgcatagtatattatagttatctttccagtacctataagtccaccttattctttctagcggccaaatggaatttctgaatgtagcactgtctgaatatagcacaactgagtcattattctcttgatagatatttaggttatctccaggtatttgctactacaagctctgctgcaattaatgcccatgtatatatccttttggagtcctacaagtgatctatttttaatgatgtatggatcaccaaggaaatgataatctgtaaaaagtgcttcaagctgttttggtcagcagcaaatagatttgggcttagggttggtgtaggccgtgactctaacagagtttgtggtttgatatctaccttctccagaaagaatatccttggttactcccttgcttacagcctttacatgtatttttttttttttatccctcttgatggaagtggtaggagggaattgcagttatcattaagtgcatctcttctgggcaagtgcccagcatttcaagctagcaggtcgctctggtttccaaaatattagcatctcatattgtttccaaaagggaacagctctgagtggtctttgtcctttataggaaatcttttgcactagctattaataaaatttacttaggaaaaactttgaatactagtcactataagagcaaaatcaatctagttgttatgtacctattgttaaacagaatgtggaaatatgttagaacttaattgctttcattttttttaaatgaaagtgtataagtggatattataatgtgtatatttgggttaataattaaactataatggaatttcagtttattagcactaggcgcagttccatattttgttgattttagactctggatgaatatacaatttgttttaaatatgaaagtacgattttctgtattattgaacacaaagaattggtttctaggtatctggtagacttggaacccgaggctttgtggagcagggtctctgcttccttcacatccataatggaccagcacgtggctattacaggagctgagaaatatttgaactgagtggcatgcatttgtctgggctacttaaaaaaataagaaaaggaaaattaaggaaat

SEQ ID NO: 131554 - DNA, 1213 bp, Homo sapiens
ccacctgtcctggggaagagccccagtcactctggttccctgcttggtgttgtttggggcaagtgggagaacagccagggccatgtttcatgaacaagtggttcagggtggagctttaaatgttctgtacaccttaaatttggacccaccatctaccaactcaaaagtgtatgtgtcagattctgccaaactagttcagttgatgtttgtagtatttacaagattataggaactgagcacattctaaactgattcctgagccaatacatgtatatagaatccgggaaacgtattgcagacctgcaaaggaagagaacatacacagattgttccctgcatgattggaattgggtgctctgttaatgtagtaatcagatgtctatcgcagtgtgacttactgatgtctttgatgtgttgcaggggagctatccagtttgggaagatttcataaacaaagcaggaaagctgcagtcccagcttcggtaagtagaagcacatgttctacaggaaaaggacaacatcctcagacaaggatggagtgggacagaccaaaatgcagattgattagggttgattcaggaagtgctgcagatagggaagcctgtgctgggttctgattggagcatgatcacctatagccatatatcctgggccctgattgccatatgtaaaatgggactcattcatgtctgctttcctccttccataggaattttgagagtcaaatgaggtaggtactgtatgtaaggtagcaacgggtaacatttatgtattgctcactatgtgccaggcatttgttaacttgtttaaatctcataaccccacaaggtacataccattattatccccattttactgatgaggaaactgaggcacagcgaagttaaataacttatccatagtcacatcactactaaatggcagagcaaggatttgaacttaggctctctggctccagagtccatgttctcctccattctgcttactgcctctccacaaatagagtttaaaacctcctgttggctgggtgtggtggctcacacctgtaatcccagtactttgggaggcccaggcaggcagatcacaaggtcaggagttcaagaccagtctggccaacatggcgaaatcccatctctactaaaaatacaaaaattagctgggcatggtgacgagtgcctgtaatcccagctacttgggaggctgagacaggaga

SEQ ID NO: 131555 - DNA, 1032 bp, Homo sapiens
tacaggcgtgagctaccgtgcctggcctggtgttttttttttgtttgtttgtttgtttgtttttttttttgtatttttagtagaaatggggtctcgccatgttgtctgggctggtcttgaactcctgggctcaagtgatcctcctgcctcagcttcccaaagtgctaggattacaggtgtgagccactgcccctggcccacctttttcttaagaaatactttgatcgtcttaataatatttctccagggctccctggatgggagtgtttggtgtttgggagaggagggtctggctctttggtccttcttccttgtgtagccgagagatggtggcacctttgcctagaagtaggtgagcagtgtttctgaatgctcagatttctcagaaagcttttcatcgtgtcttgtggctcagaaagagaaggaatggtcggacgaagctgctattggttggttgagcctttgtgttcttagaggtgccaactgctgtccctctggacagagatctccagtggccatcctgaggactctgatcttggccctcatctctttaattggatgtaggtgtacaaggggtgttcttatctggactggattaaaaaaatggtatgtatgttgggtgtcataattggagtccccactatgtcttgatgggccttgaatgatagcctgagctctcacaagttttcatttgacataaattaatatacagttctgctcttgggtggaagtaacccccagggcacacacttgggatggaggtcatgtcgtgacaagaccctcacacaggtgttggttgacagtagctcaggtgtagctgccaaagggcctctgccaggagccagccagacacgattcttgcccggctgttgcttagtttcccataggggcaaattgccacttagaggaataaatccagaaacctgtgcttgagccaagcaggtctccaatgcatgaaggcagaactgatgaatgtggtgtagcagcatgcgtgaaacagactttagagttcgggtggattgtaaattcatg

SEQ ID NO: 131556 - DNA, 1833 bp, Homo sapiens
ctcagccagatccactggtgagccagcctctgtctggcaccttttgggcagaacaaaggcctttgagctggaaccccactctctagagcctctgccctcctggttcctacttgattctcccctgaactgaattcttcctcctcacgtaagtcctccccagctctgtggctcctcccaagttgccctttctctggcagttcccggcccctgtgttccttgtgtggcagcgtggtgttgaattccctcagctgtcccagtggcgctgggctgggagaggcagttgctgcattatttatggagcaccggtcaccagccgtgctgatgagctacacacagttattctctgcaccatgtgtgggatgccgtcctgggcctctgttcaataggaaacaaaacgaagccaaacaaccctaagccagaatggctgttggccgattgctgtgccttgctttgtgttaggcaaatggcctgccatgggtcctggctctagggaaagtggaggaagaggaggaagatgaggagaggcactcggcggtgtctcctaagctccactttgagggtggggtgggggagaccaacttgtggatttgtttaggtggccaccaaactcttcagttgaaggagatttaggaggcctttttcctaaaaactaagaaaatgacttcattattttcctctctctcccaggaactagagtgatgccaggtatgtgaccattagccaggttctcccatcacctgtctggtctggaatttatgtcactcactgtctgaatgaaggccaccccggtcttcctcacctgtcccaagtccccaccctgggtcttgccctggaaggctgcccttgcccacctgggccacttcgcccatgtcctgcctggaggagtggccagcataaatgtgtcactccagtgtcccttggagagagctggtcagtgttccctgcctccttttgtgtcagctgcaccccctaccagaagtacttttccttcctcccttcatttctcagtccttgttccacagtccaaaggggaagccctcaggcttatagacagcaaactgtatgatgtgataagttggggagtaggtgcagctaaaccagagggtaggtgggaagggggtgtgtcagagaatgttccagaagaagtgtcacagctgggtagtgacagctgaataggagttttcaatattgctgaatccccctggagatttgaagagaagcagccacagggtgtggtgtgtgtggggagtgtgggtgagatcacgtgttcagggaagccccatctctcacccaaggaagtgatggagggagtcctctttacacgcttgtaaacaaactggctttctcttcccgtttctttaatagggaccttttcctttcttagaacccagtgtaatctgagttgtattttcaacgaacgcactgccaagggctccagaaactcctggctctcctctctgaagaaattcagggggctcctggaggaggtgcgccttctcattttgccttgtgactttggacttggcagaagccggggcgtggcgggagttttgttttctttgatttgggtctgtctggaacgttgtgaagcctttatgtgttctcaggtgaaatccacagtggggtctgtgttgaattgttttcacggctctgggagtgcattccgagggatttcctcaaatggggacagagctcagccagcaacctcaggaatgaactttctggggacttcttggtgggtggatgcagatgcaaaaaccaaggacagttggggaattgctttctaaagggctctaagagcttccagtgtcttgggttgcgggtttcttttga

SEQ ID NO: 131557 - DNA, 2022 bp, Homo sapiens
gggtgggagttgaggtcacagaggaggtgctatctgtctccgttccaaaggggaaatctgcttcgtggaagatggcagagcacactaagcgtgtatagcgcagcaaggccagtgcttgccccagggtggatgtgacaagttcatcatgctgcccttggctgcggagaggtctcagtttaaaagggaatatggattaaaaaaagtaaggaaaagaaaacaaattaaacaacaaaaattaaaaaaaaagaagaaagagaaaaagaaaagaacataaaaaagggaatatggaatgaatacagaggtatgtgtgtatttaggggagcaaaacctcaaacatgatcctctctagggtagagggtgtttgtgtgtctgttcagggtattggagagattggccccaagaggaactaatccctaaaatgcagaagcagttttggagttgggtagaggcaggtcagagcggacacttccagggaaaagaaatgggtgagtgtaaatggaccaacgtgaagtcacgcttagaaggtctaacatttcatagggtgtgcaagccactaggtgttttgctcaggttcaatatctaatgtggacatttatagacaggaataaacacatggagcaatagctttggcctctggataggaggacaaaggttagagggtagatatgtattattctggggaggattaagcttatacaaatgctaggtaaaagcagccagcccctgtattaggtggttaaatattgagttcccaggtttccagatgtggagaatcagtcagtcttaggtgaacccattatacaattttattttaaaaagaactgggcaggctgggagtggtggctcatgcctgtaatcaatcccagcactttaggaggctgaggtaggtggatcacttgaggtcaggagttcaaggccagcctgtccaacatagtgaaaccccatctctactaaaaatacaaaaaattagctgaacatgatggcacactcctgtagtcccagctacacagaggctggggcaggaagatcacttgaaccctggaggcggaggttgcagtgagccaagacagcaccactgcactccagcctgggcaacacggcaagactccatctcaaaacaaaaacaaaaacaaaaacaactgagcaaactcaggagcaattaaccattgcttaggagcaaataacagttaatgcagttaaccgggcgtgagggcaagcccttccctgactttgggcaaattacttactctttctgtgcccgattttcctatggttagtagggaagtgttaaatgcctgttctaccagctgccctttcagtggtgttttgaaagacctctgtactctcgaatacagcatacatgtgaggcggtgccttcagtgcccatcatgacgtcagtttagattcccacatggcaggttttcacctttgaaaacttggccatacaaatgtcaggtggctgctgatgcaggcagtgactaaccataaacctcttcctctctcttttgatgggaggaactatctgaaatcataaaggaaatgtcatggccgtaatggccatggctcttgcttgtaatcccagcacattgggaggccaaggcaggcagatgacttgaatccaggagttcgagaccagcctgggcaacatggcaaaacccatctctactaaaaatacaaaaattagtcgggtgtggtagtgtttccctgttgtcccagctacttgggggactgaggcaggaggatcgcttgggcctgggaagtcgaggcagcaatgaggggcctgggaagtcgaggctgcagtgagctgatattgtgccactgcactccagccttggtgacaaagtgagaccctgtctcaaaacaagaaaacaggcagggcgcagtggctcatacctgtaatcccagctctttgggaggctgaggcgggcagatcatctgaggtcaggagttcgaaaccagcctggccaacatggcaaaaccctgtctctactaaaaatacaaaaattagccagacgtggtggt

SEQ ID NO: 131558 - DNA, 1013 bp, Homo sapiens
ggagtttctatccaagctctgggaagggagggctccatgtctcaaacagcagctttgtgcctttgcttttgagtcattgaaccggcatcgattttggtgatgtctggggagttcttaagaccaggagactttgctggccaaaattgaggacagctcactctgcggatgtctttcttcttttaataattaacttgggttaaaaaaacaaagttggatgtctgaaatcaaatattttcttcacccttgttgctcaagaatcagcatgtcgagagctgaactgggcctgctgcggggagaactttgtacgaggttaggagtatagaatgtgactggcgcaagacaaccccaaccacacctggttcctccaccccatgtgtcactttagacaggggtgtcctgttaccagcacctgtgctgagcagaatagaggccttgttcagttcctccccaccgccccccacctgtgtttgccatcactatcctctttcctaagttctgcctaaaattagaactgctaaagggacttcttgaattccatggaaatctttttgtggttcgaagccatgtcgtgatattttccctcccatatcataggatggagaatgtgggtagtgggtccaacactggatagtgatttcaggattttttttttacccctcactgctttgttttggggttcccatcagaagagagatacacttccttgctgtttatggagggcaattgtgtagaaggccttttgctaggctctgcccttggagagctccttgtcctgtgggctgtaaacaggtaatatgaatccaatatggtggtcatgaaggaagggctgtggttcagcctagagaagagcatcagtctctgcaggagttcccttggaggcctcaaaaaaaaagttttctccaggacagcactgaaaacccaaccaaggcctcagccaggtgctctgagggaggtgggctgctccctataaacggtgacagccaccaaaggcaggacaagcagagcacttgtaa

SEQ ID NO: 131559 - DNA, 3838 bp, Homo sapiens
cgcagccattgtaggggtgggcgctcgccaggcagggtgccgacacgccctctccgcgctgcgacgggcggccgggggaggagagggtgcgctgtgcgcaccggagggagaggctccggcccagcgccgcctgcccgccagcagaccagcaggctcctctttgcggcgggtgccccacgcgcctctcgggcgcgcgctcccagccccgcccgcgtgcggcggccgcacggccgcgagagcgcgcctccgcttggcgggcacggccgcgagcgcgcgtgcgcccctccgaacgtccccgggagcccagccagagcgagcgccggggccgggcgcgcaggagtgaaaaggaggcggcggccgcagctgcgagcaacagatccggacgccgcgagctgacccgctctgctgttgggcgatttttttttaattgcagaaaaatttattaaattggaaaatcttgcgtttttcaatggcgctggccccgggtcagcgggcgattttctctgcatcaagatgggctttgccgtttccgtagtgggcaccagtggtggcctgattgtcagtcttctcccggcatttttaaggccaggagccgagcgctgcttgtaggcgaataccctacagagcggtttggctttttaaattactgttattattttgggcagagaacagtcggtctggtgcaccccgtcctcgctgcagaagaggctgcgagtccgaggtgggtctctcggaaggtgaaattccttctggggtgagcgagccccggccccgcgcgcagtccagcggccccgcgtgtgtgccctcgccctgccggagccgggaaaatggaggctgtgattgagaaggaatgcagcgcgctcggaggcctcttccagaccatcatcagcgacatgaaggtaggacgccgggggtgcggctgcggcgccggccgccgcgctctgacctcgccgccgcgcttcgcctccaccccgggccgggcacccggcccttccctgcagtgtggccaccggccacctgcgggagctcccggccggagtgtcacctgctcacccggggcgctgctccgggctctgcggggtcactgggcgggtggcttctctggggggtgtctgctgtcccacgccatctcccccgctcattgtcccagggggcggcaccatttctttccctcgggggctcaaggcactggctgcaagttttcccattgtctgtccctgaagtaagtgtctgggacccgcgggggctggatgcccgggaggacacctgattcctccgggcacggggtgggggcgcctggcgcggtggtggggaggaagtgggggctctgcccgctcgcaggaaggagtcccctagcctaggagactgagagggaaagccagtccctccttggctgtcaggtctacttggagtggggtatctgagcaaattagttattaattgggccgttccgaagctggtaaaggtgtgcgtgccctctcttagccctcccgcggggcgcggggccgaagttcccgggcagccttgcaggggccccgccttctcccagctgagcctaaaggcaagattggggcccccgaaataactgtatcctgccctcccagacccaaacggacacacactctaggttttctcttggaagggttgtgaagatggtgtgtgtgtgcgcgcgtgcatgtgtgtgtgcgcgcgcgcgcgtgggggcggggaacaacaccctggttttttcctgcaaagggtgggactggggataacctgatcctcggatgtggattttctggtgcctagagatagaccagggccccgtgttattcatccagaggaaataaaaccagccgcgcgagctggctggaggtgggaattgggagcggtgggggaaattatttttttaatgtgtatttagggagcttctctttggctctggcccagccccagtttgcctcaacagatccagatccggggaggtggtgtttaattaaaagctcgcttccaaaacgagtgggcaggtttggaaagctgtgcaccgagtgggtgtggacagcccctcttcagccgctgcctgggcgcctggaggagcttttgtctgatgaagtgtaaggtttagagaggcttcgtgcctcggagatggtctttgggaaggaatgctcagctgtcatggcctgcttccacctttcagaaccaactgccacctcacccagggtgaactttatcaagctgcctctgtcctggttttgtccattttgaaatctttctacagctctcgtgccttttgtcacaaattgtccttagcatagcataatctgcagccagactctgcttgcccaggaatgcttatagtccaggcacttggaattagatggattattccctgttgaaagacagcccctttcattctgttgcccccagtgcacactgacggatctgtccactgtagtcctggagtgatcacatctggagttttttctctttgttctttaatccagaatccaggctcggttcttcccattcactgtttgaatcgaaagccgttcagaaggtgacctgcccaaagggtgggctgtcctgctttccacctgccatcctgtggctgcgtggcactatgccctggctggggactcacgggtgccaaggtggtgttttttcccctgcatggttccagttaaaaataaagacattttctttaatgcccagtcacggcggaatctagagtttgtgtatcctgacttctttcggtttgagtttagtaggtttgttcagtatcctatgggaaatcatttattttaaagttttttttttttggtttgtttgttttggcagtaaaattttaaaagcaaggtggaatggaagactaaaacatgccttgggttctgcagagttttagacttttggagactcgagagatgaagagagagggaatgtctgatttccaagattgtttatgcataagacaattcttgaatattttcttggactttgcttcttaaaagacttcatcatggattagatgacagtgacattttaaatggaaattaaaaatttttaaatttgaacagatctgataagcagtatatagtgtgcagatgcatgaagtcaccagcaacaaaagtcagtttttaatatctgaaatcaactgactttctaatgacctgcttatcctcttgttctcttctttaaactcccataatgggtttataatgcctttggtctcctatctgtttgctctgagggaaaagcgtaaatgtcggaaacccatttggaatgccatcttgataaaaatttttaggttattttctcagaagtgatgttaggctgggtgagaaaaggataaggaaaatggttttattagtagcatttgattcttcaaaatgtacagcagcacaggaagggagtcaatttcctctttggagaaaaaaagaaaacaataaaaggaataatttcaaggcctggcaccctccatcttctgaaaccagagaacctcaagacatggaaaagcaagagagagaggattctttgtgctttcctctaaagatgcttcatctaagtcctcggctggctgtcagggcatgggttttatccttttcaggcagtaaggtgtggaagaaatcctgactttttctccactggggaacagcaccatgtaaagcaagcagcagctagtaaacaacatatcgattccttgacgagaggaagcctggtggtttgtttcccgtttattctaccctgctgtggtggtggtcgctaatgaacggtgttgtgcaaaatcacctactggctgcctttcctcccatccatgcaaattagtaaatcgctgatcaaattggctggtgtgagttggttc

SEQ ID NO: 131560 - DNA, 1056 bp, Homo sapiens
ctatgtatctgggactccaggcaagtgccaccatgtccagctaattttttccatattttgtagggacggggttttcaccacattgcccaggctggtcttgaacaccagggctctagcgatcctcccacctcggcctcccaaagtgctgggattacaggtatgagccactgtaccctgtgtaaatgtttcttttcattcaacagggcatccaaacctcacaagagaaacaattagacatcaggaatatacgaacaaaagcttgatggggcagagtaaatgaatgactgtttgtgtatagtgaaggctttctctttggttgttgacaataaccatggcctagggagaaaacagtaaatgaatcagggagactacatagtattaacttccagtgtgtatgggaggttatgttagaccctgtgcagattagatagaagccattcattcgttcattcagtcattccataatacctgttaggcctgtgtcatgtagtaggccttgaggtaggtaattgctggggattcagtggtgaccaggcagccatacctctgcccatatacagttgacattgcaggaggtagagtgatagccatgagcctccacattctggacctggcatcaaattgcctctgtagaattctggttccatcatactatctgcatgatgatgttggccaagttacttacccctgtcatacctcggtttccccactgcaaaaagcgaatactaatagcatcccccttgtggggtcagagtgaggcttgcatgagataatgcacatgaaacactcagaacagagtgccattctgtgagttctagttgtggtggctgttgtcattattatcagcacaggccagaggggctgagaaggccagcctggagcaagtaatgacaaatgcgctgagaatgagcagagctgtgtattatggcaacacttaagaggagctcatctgagagctagatgtgcatttggtggcagaatctgggctgggacccagcctcctgggttctgacctagcttctttcctcaggctgctggagacctcctcaaaacaca

SEQ ID NO: 131561 - DNA, 1699 bp, Homo sapiens
gaatggaaacgttccgacccgaggcagcggatcactccaggcttctcctcaaagcgagcacacctcagtccagggagggcgcaggagctggggctgctgcggtgaaccaaccccaaccccgaccccgacgccgatcccggccccagagcgcctcctaggcgacccctggccccacccacgccggagccggcccgcgcccatccccacgccccaacccgcaccacgcaacatcgccctagcgcctttcggggcgtcgccgcgcaggttgcgccgcctccgattggccaaacgcggcatagcgccatctcggcctaccgcgcggtgcgcgccctcattggccggcggcggcaggagcaggggtagggggcggggcagcacgcggggcgcgcggtatgggcggactcgcgcctgagccccgcccccggtccctcgtctgggccgagcccgcccagctggctgagacgcgtggagcctggcggcgagtgggggcgtgcgacggttactctggttactggggccgcgccgcgctggcgagagccgccgcccgcgagggatgctggtgaggaagccgtcgggagccgccgccgccatctgagggaggtaccctggaaaccaccttttatcggtggggaagtgcagtcgcggtgggcggctctgggggccagcgaaacgggaggcctctaaatctttaggttggggctgcattgccctggagccgcactcttgagtccgaggccatcttttgttggagaaggcgtcggcgttggcgttttcccgaggttgggctgtacagtgtctccgtccgcggaaaaagaagcctctgaacccgcgccggcccgcagcccccgtgccttccggccgctgctcgccgtcgccagaggctaggccacgtttcccccagtgccgaggtgtttctgtgaccctccctccactcccattcccttctgaaagggcacctgctcttggtgagaaaagaaattatagcacgaagagccagtatcagaagagtatccatcacccgcagcaaccgctcagggaacaccatcaaaaaagaaaaaaagggaatatctggatttcctgggcgaggaggagcgagtctgctcgggagctgttccagcaggcgatttttaaatactgctttctacgccctatacaacttggcttcacatacttttacactaactttatatgatttttaaaaactggtctgatcggacttctcgtcctgggacactgtttactggagtctggccggctctccgtgctcctcttggtacctcattttggggagaaccttaaacccactcgagcagataatctccgccttgaccggtgccaccaaagaagccttggaaccatgtggacttttctgggcattgccactttcacctatttttataagaagttcggggacttcatcactttggccaacagggaggtcctgttgtgcgtgctggtgttcctctcgctgggcctggtgctctcctaccgctgtcgccaccgaaacgggggtctcctcgggcgccagcagagcggctcccagttcgccctcttctcggatattctctcaggcctgcctttcattggcttcttctgggccaaatccccccctgaatcagaaaataaggagcagctcgaggccaggagggtaggttgatttcaaagcgggcagatgaatgtcttatttaggagtaggatt

SEQ ID NO: 131562 - DNA, 1100 bp, Homo sapiens
agaaaatgtctaaaaggtgccgaatagtttgtaacatgaactcaaatcagaagttgtaagtgatttgcatcttgtcgattcccaggatatatttgaagaatttagttattaatgatacagtttgccctataataagtctttgaagccccttataaacatttattatattcggcccagtgtggatttctaaatatgtctgtataacattttccaaatatcatgtttagaaaacaataaatatttaattttattgggataatatgacacacttttatttaacgaatattttgatatcattgatttttatatattatctagattttaaaatgtaacaatttgtttggtttgataatatttagtatctagctttagcctaggatgcaaaagtccagtgtgtccacatagcggtagcatgatttgaatctaacaaatttggatacctagtttacctttttttttttaaacagcgcagaaaaggaaccaatatttcagaaacaagcttaataggaacagctgcctgtacatcaacatcttctcagaatgacccagaagttatcatcgtgggagctggcgtgcttggctctgctttggcagctgtgctttccagagatggaagaaaggtgacagtcattgagagagacttaaaagagcctgacagaatagttggagaattcctgcagccgggtggttatcatgttctcaaagaccttggtcttggaggtaggttcatattgattttcaggagagttacgtggtatgaacaagcactcttcacttagaccatcctatgaccagtaagaaggtattccattttattttcatttataaaattttctatactcatttaccaacaaatttgcatgaaagtgagagcaaaggataaaataagcatttaatagtatgattagatgtgaattagacttaatgagatataataaaatggccaaaagattgtaatggtcaaaattaaggactggaaaatcctagaatgagggcattaaattttgtgaaaggcgaagggaactgtcatttgtagagggtatgttgtatacttgttacagtgttattacttagaatcttttatttaagcaccattcatc

SEQ ID NO: 131563 - DNA, 1057 bp, Homo sapiens
tctgtataatatggaaacagtaacaaaagcaccaaaataatccaaataagtaaagggtgaatgcattgttacttgtgcttttcaacagggacaagattaacagcttgtattcattttataaaatactactttaaaaagaaattgaaactagtgttaggaagaaaaagactacattgccttttaatacatggccaaaaacaccttccatcacagtcttgtgtgtgtgaggacaagcatgatctagtctgcaccagaggaattcaaaataatgaatatgttactgaggcattgctattaatgttgtctaaggaaattccactaccttccaaactaaaactaaaactacaactattgctcaaaatggaattttaaaaaactaccaacttgggagttagcaaactcaggtaacatttttatttctggacaaatcactaacttgtttattcctttcctacgctaaaaatctgcaattgagtaatattcactaaaaagtgtctacacttaccatctgtggcagaaaataattcataaagagcctgagcaaggatattcacgacaaaggaatgagatgtttttcttgcccagtaaaatgattttttggcctaaaaaagaaatagctcatttattatatggtaaggataaaaaagcacaaactgatgtttataatcccctcaaactgatacttatccttctaaggactatctgcaagtaatattgccttatgtttatcatttacaaaaaaaataaaaaatcaccttcagagcaatgggttatatgacactgaagctaaatttacaaccactatgagctaagtggcccatagcaatcaagtgttacataatattcaaatttagaaattctctaagattcacaggttgcaagtcaggttctttaagcctaagcaagatgcctaagagctattataaagcatcaggttccttagtacagatctccccatcagagccccactgctcttaacccccagaaataaatccattttgagacatttttgtcaaaataattgatcttacctcgaaaatagctgcatcatcataaa

SEQ ID NO: 131564 - DNA, 1018 bp, Homo sapiens
agctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtaggaaaggaataaacaagttagtgatttgtccagaaataaaaatgttacctgagtttgctaactcccaagttggtagttttttaaaattccattttgagcaatagttgtagttttagttttagtttggaaggtagtggaatttccttagacaacattaatagcaatgcctcagtaacatattcattattttgaattcctctggtgcagactagatcatgcttgtcctcacacacacaagactgtgatggaaggtgtttttggccatgtattaaaaggcaatgtagtctttttcttcctaacactagtttcaatttctttttaaagtagtattttataaaatgaatacaagctgttaatcttgtccctgttgaaaagcacaagtaacaatgcattcaccctttacttatttggattattttggtgcttttgttactgtttccatattatacagaggtcacggtcaatgtatatattagagaaaacacaacttagcagaagcagtgttagaaatggaggaaaagaggccaggcgaaatgattcatgcctgtaatcccagcacttcaggaggccaaggcaggaggatcgcttaaagccaggagtttcacaccaacctggacaataaagcaagaccccatctctacaaaaaattaaaagatcagcaaggcatggtggcgtgtgcctgtagtcccagctatttgggactatatagctcactacagtgagctatatatagtgagctatatgaagtgccactgcactcagcctgggcaacagagtgagacttcatcttctaaaacaaacaaacaaaaaattaaaagaaatggaggagaaaaggcaactgtgccacctcc

SEQ ID NO: 131565 - DNA, 2306 bp, Homo sapiens
ttgaaaggtattaaaaactttatagatataaggaattattatttatcgctactcacagctctcttcacttgataatttactgcttagttagagatactggttggacatcttagagactgggaatttggtttctagaattgtgttaaaaagagcttccaaagtattttgcatcacttaatgaattaacagcaaaatcaaggaagtaccttttaaacaactcttccaagacctaaatattagtagttatttactaacagaaaaaagtttattcatatttatattactctccataatgctgattatggaattcagaagaaatcctggttgttgaaattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtcctgttgggctgctttctgtgtaagttgtgatggcacagaggatacaaacctgccagattttcttaggactgttcagttgatgaattactgcaaatctttcttccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacggggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactgatatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaaggggggtggggggtttgctcctgccatcaaacttaacatgcagacatatttgtgacgtcctctaaaatgtagaatgtttcatacagaattatgatgcttgggtaaaaaaaagtaggatgtttgttgagcttcgtagattatatgtaattggaacctttggagtaaattttagtttctgagtcttaccaatatgtatttttttctattacagattgtctcctaaccctctagttttaattggacacttctttgctgttgcaatctatgccgtgtatttttgctttaagtcagaaccttggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagatttggattaatttgtttttgaagttttttgtatataaatatgtaaatacatgctttaatttgcaatttaaaatgaaggggttaaataagttagacatttaaaagaaatgattgttaccataaattagtgctaatgctgaggagaactacagtttttcttttgaatttagtatttgagatgagttgttgggacatgcaaataaaatgaagaatgaactttcgtgtctttttgtttcttgttgtgggctcgtttacatagcttcatgataatgaaaaagaaaaccaaagtgggatgaaaagtgcagagggaaacctgttctattaaataactggggaagttgccttaatgtcttgaccttgatttcctcatctatccagtgaagcaatttgataaggttattttctttaaaaaaaattacttatttatttatttattttattttggggctgtgactcagatttgaaccgaaaggttctttgctgagttctctgaaaatatcagattctgacaggaaaggcaatcaagggctttataagttccactgtatagcaacatttat

SEQ ID NO: 131566 - DNA, 1213 bp, Homo sapiens
tcaggaatgcatgcctctgaaggccttcctgctcttccccttctggccttggtatctcattctcattcctgccctcccctacctctccaaccccatcacttgccagccatcctgttcttccttgttggtcatcagttaatgaagtgtattaggtgacctgagtacttgtcagtacttcccagaggcaagaacattcctcgcagatcaaggtacctttaagagccaagaagctcagatttggaggcgggagagctgtactgcatcccctcaaatgttagcagtgccaagaaatgagacgctagtctagggggcaccacaagcagaaaggggctgtttcaaggagtcgtccgcccatgggagtctcctcttctattattcaccttgctccaaggatatcttttcttttacgtatgaaaattttgtaattgttcaactataacaccatgaataatttaattctttaatttttcaggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaagtcgtctcgcttatgattcaaaaactgtgtattcaccctgtaaaaaaccctgtttggaataagagatgactctgctaggtataatagctcacccccaacaagctggcaggcacgtggtgatagccagactagtagcaaatgtagtggccacacaatctgtgtcatgtgccattgaagtttcttggtgtctcatcatcctcttccaatcccacatgccctagggggtccacagcattccttctgtaggactccttaacaaagctgctccttccggtatcttcctcagcaacctgagtcctgccccaagtccccacaaccgtatcatta

SEQ ID NO: 131567 - DNA, 1027 bp, Homo sapiens
acttcaatggcacatgacacagattgtgtggccactacatttgctactagtctggctatcaccacgtgcctgccagcttgttgggggtgagctattatacctagcagagtcatctcttattccaaacagggttttttacagggtgaatacacagtttttgaatcataagcgagacgactttgggtactagtaatactattttactgaaaatctggagttgcacaaatagttctttagaacataaaactaaatggatttatacataacagttacattcagcatttaagagaggcagtacaaaaatgtgttctgcttttatctgatataaattgcatgtaataccatgatttaaacaatatcagttatattaactaatgccatgagatatatcttactcagaacgtctgatgtttcccataatagacagaaaaaatgcagttgtatgagcaactgagtttcttttcatcttcaaattcatttgtgatggtgggaagatctaaggacaatccttccattgaagaagtaggaaaaacagttacagcactgttctgaactcatcaaaaatgaaattaggcacatgtgcttcagcaacctgaaaaattaaagaattaaattattcatggtgttatagttgaacaattacaaaattttcatacgtaaaagaaaagatatccttggagcaaggtgaataatagaagaggagactcccatgggcggacgactccttgaaacagcccctttctgcttgtggtgccccctagactagcgtctcatttcttggcactgctaacatttgaggggatgcagtacagctctcccgcctccaaatctgagcttcttggctcttaaaggtaccttgatctgcgaggaatgttcttgcctctgggaagtactgacaagtactcaggtcacctaatacacttcattaactgatgaccaacaaggaagaacaggatggctggcaagtgatggggttggagaggtaggggagggcaggaatgagaatgagataccaaggccagaaggg

SEQ ID NO: 131568 - DNA, 1056 bp, Homo sapiens
tgtggcatgaacttaactgtgcttgctgtgggaaccaggtcagtggagagagaaagaacaaaccaccatgattatttctttcctctggccacttaaggaatccctcctggcttgcctatttcacttaactcctgaaccagatgagttgctgacaggagtacatggtggagaggaagaagaggcgggaggggcattgtgttaaactctgcaaggcaattcccatggtggaaaaggcaaggacatttcagagctgggggtagagcagtggcgagaggcgcagaggcatctactgtgaacgacctattgggcttcactcctgatgaatccagggccactattattagcatctttttacaactattaatattgttctttactatctatcacttaccctcctgggtagctttgtgtaccgaacataatcctccaggaacagaagggcacccacaacatctgcaggaatttcaggtatcttctggctgtgatagagaacagtttagatcaattaactgctttgcacatcataagcccttttggtcagaatcctgaaagactaaattaccaacagattacctaatgaagtcaaagatgaacaaaaacattgagcatgctcttaattcctgtcaagttgttaccttgctcatgtattttcaggagcccaccccatagggtaaatgtgagcttctctatacggtttccatgggcgtttacaacacgatccctgctatctatccagactcatctccctctgtttacatgattcaatacctagcaggtcccatactttcccatccctgcacacttttttttttttttttttgcgacagacttttcactcttgtagccaggctggagtgcagtggtatgatctcggctcactgcaacctccgcctcccgggttcaagtgattctccagcctcagcctcccgactggctgggattacagatgcacgccagcatgcctggctaattttttgtatttttagtagagacggggtttcaccatgttggccaggctggtcttgaactcctgacctcaggtgatccacccgccct

SEQ ID NO: 131569 - DNA, 1053 bp, Homo sapiens
ttcccggtacaccgagcagttcctggcgctgattggccagtttatctgctccacggtggagcagtgtacaaggtacagaagaccaaccaggactacgtgggacttcttgtcacaaaacctaacttaaacctcacattaccaaattcctcttatcgccctaatagagatgggaaatggttgctcacccttctctgtaaagcaagtcagggcatacctccttgtttagagcaattacaggtgtgtccatccttagtcaccctgccaggggaactccatccggtctactcacattgattttccaggagtgactcaggaccatgaatagtaactaccatggggaagaaagtgcagccctgttcctctgcactcttggatgcagctcttcaatctcagcgagcccctgcactcctgctgggccactgccaagagatgattccactcacttcagtgggagtcagagaacatatcagtgtgtcaaagcctgggcagtgtctgcatgtagagaagcaaatttcacaagagttgctatttgatacaatgcttataaaactttaattcctgccagttcttttcccctgcccctaaatgtggcttttctgggataaagaaaaaaaagttatttccatgagatgctgggtcctgtgcctccttctctgctatcctaaagggtcagcctggctacataacctttgctgtcatgtttgcttggtcatttttgccactataatgtaaaaaacgaatcaaagcggctgggcacagtggctcaagcctgtaatcccaacactttgggtagattacttgaggtcaggagttcaggaccagcctggccaacatggtgaaaccccatctctactaaaaaaacacaaaaattaaccacatgtagtggtggccacctgtaatcccagctactcaggaggctgaggcaggaggattgcttgaacccaggaggcctcagaggtgcagtgagctgagatcatgccactgcactccagcctgggtgacagagcgagactccatctcaaaaaaaataaaacgaaccaaagtgatcttcta

SEQ ID NO: 131570 - DNA, 2583 bp, Homo sapiens
acacatcagagtgtacttggtggcagaaggagtctttgaagcaagcagatggaagttgtaagcagtttgggaatcctcttgttttgttctccctatttacttcctgatttaaaacctcccttgcttctaggctctttcaaccccttctcacgcctccttctggtaaaggtatgtggtggctttggacaataggatatgtcatctgtggagcttgctgaaaatgcaaaggccagagctctcccccagaactattaaatcagattcgtcaggaatggaagctgggcatctgtatttcagacaagctctaccagggactcagggtccctctctcagtgtttgaaaaccattgaaatggtggttaagggtggtggtcagacctatgagagcctcaattatctataaaatgaggatgaaatggtttgtattccacagagctattatgaggatgaaatagcacatggaaaggtcttagcacacacagcacctggtgcacaataagtgcccagtaaatatggttggttgttgtcactgtcatcatcacacttctgagtctaaaaagaatcatttggagaggaccagaagatggcatctacaagtttaaggaactgggaggaaaaagcaaattgctttgtcgtcatagtctcaaatgttaggtagcatatggagattctaggttccttttttatcaaatggaaatgacacaaggccttgttttgtctccaaactggaaatttaaaggaaggctgcatagagagacaaatgggctctaaagtcttccagcctgacagctgaacctaaccttgtcttctcagcatgattccaagtcaacaccctaactcaatggaaataaatgactgaaaccaatgatatggcatagggcaggaaaagggggtcagactgaattttaccttcctgttccattgggtgtcactgggaagacgcattgggtgcctgaatacagaggttagaaaacacagatcatgtaactcctgttcttcatatttggtgccgcatgtcctgttgagtcctaacatctctttaaggatgaattctgagccattctggggtttttgcattgttttcattttagaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacaggtgagccttttgactttcatgcctgttttctgccaccctgggggagaggcaagaacatattttagtgggcagtttgaactcacttaacctttcttccatgatttcttacactgactttaggcatatgatacctactgggtagatcagagctgggaataaactagaatttgtttggccagcatagtacttttaggattagactgtttttgtaagtttcaacttgggaagataagactttttaatccttgaagccagtgacttttcctagcaagggatgtttctaacaggaacctgaagttgcttctttttgctgtcatcctgtttagaggttttgtgtgacttaggcccagcctctgttctgcatagcattttaggtaactggagaatttgcttgtttaattcattatgtttggttctttgaccgtgccttcttgtttttagaatttcctcagtatgtttcagaaaattatcctgagagacagaactgttcaggacactttaaaaaccctcatgaatgctgtcagtcccctaaaaagtattgtcggtgagtgtcctgaaactacctgaggcggggatgacactgtagcctttacgaatgtactaaagagaaaattatgttttaacttttcagcaaattcaaataaaatttatttttccgccattgccaaaacacagaagatttggactgcgtatctcgaggctataatgaaggtatgttgtagaagagagggtgtacagtcaatacttacatttttaaattttttattttcttgtaactttgttgcccaaaaaaagctactcttctttcttttgtcattaaatcaaaaatattttaatacttcagtttatcattttaaaattcattttgtttatctccgtttctggatctgttcttgattaggctttttaggagcctagcgttttccttttgttcaagaaaactggctctttgtaaaatgccttttggctagaggtgcttttatatatgaaaattgaacttttccttgcacagtaatactccctttttacataacaaagttcatttatacacacctcatctgctccaagctgctgttagaacagaacattgtctctctgccctcttgtgtctgcatagatgttaggaagccaggttctttggggcataaattatccttatactctgcagaaagcagtcttactttggaaatgaataagaaagacgaagagattaatttgctggatggaagtctaacttattttagaatccagctgcctagtttcctgcctttactcggcagtaggagctcccagggacccctgcatcttctgcgagtcttctttcatcatc

SEQ ID NO: 131571 - DNA, 1064 bp, Homo sapiens
cagtatagctagcacctgcctaccttatcaatgtctgctgctattgcttgcaaataatggggaggccagggaaggggaggttaccttctcagtctcatagtcttttctagccaaaagggcccatctagatcattgaattctgccccaaattttagacatgagaaaatgaagcctaaaggagaaatgctttgtcaaacatgaaagaataaactgttgtcttctgactctgttacccaatatgtctaacagtgggctttcagttgtaccacagagcctcatttctgtccagaatatgtggacacaggtgtcctaaagctacaagttcttttcctgttatctttgttcattccaggactattagacagtgatttttcatacctctttttctttgttataggttgccaagcttactcatgctatttccatttttactgaaggcatcttaatgatgaaaacgactttggttggcatcatcaaggtaacagttttgttagtctgcgtggcctcgcaccatgactcttagctgtttgggtttttgtggtaattatcatgtgtgcaaaagggagtgacatcatctggctgtttgacattccaatttcggtcttcattttactcatttattttattttagttgagttttttgagacagagtctctctctctctgttgcccaggctggagtgcagtggtgcaatcttggctcactgcaacctccacctcccgggttcaagtgattctcatgcctcagccccccaagtagttggtactacaggcatacaacaccacacccagctaatttttgtatttttaatagagacgagtttcaccatgttggccaggctggtctcaaactcctgacctcaagtgatccatctgtcgtggcctttcaaagtgctgggattataggcatgagccacggtgcccagcccgttttactcacttattgatggaggaagagaaagcattgtaatctttatttctcttagtacttgaaggtagtgggaatttctttatcttgtagttctgcagaaaatgtgtggtgctagtactgttttatcaaagagt

SEQ ID NO: 131572 - DNA, 1085 bp, Homo sapiens
ggtaaaaagaaaaaaaaaatacccaatacaaattgctcaaagaaatgatacatttgaatttctgacatttcagctgggttctttaacctgtgcttcctctgtcctacttcccatcctgcacagttcatagagtcactttctgactatcctatagacacagtaattggacctgtgttttttctaatctttatatgacagcacatttcctaattcagggaccatcccctatcccaaattccatcctgtgagatgtgaaacctgtgagttcatgtgaatgagtgtttgaagggcttgacgccatgtagtctcttacgaaggcttcagggtgctcttatgttgttgctttgccattatcaaatggcattgattgatccgagggactcagaaagttagggtagactctataaataatttcattattcctcatcctctccgtcatcattttattggttagtcattctgccagatcactaagattcttcctctacaggccccgcaaaattccacagagccctgattctccacctgcagatggagtctccctatcccattgctcagcttttcaagatttattatgatgctggcaagtgaggaatttcttaagcgagaaatcagagttcatgcctgtttacctcctaagagcccggtgtaaaagaccatctacccttgtctgagatggcgtgtcctttagtgagaaataagtatgttttttaagtttgtttcagaaaaaaaaaaaacccaaccctgagttacacccgtttcttctctgcccaagactttgtagaatttaaatgttatgaaggagtgaattaataaacagaattaaggcggtacagtggctcatgcctataatcccaacagtgtgggagaccaaggagggaggatcacttgacaccaagagtttgagacaccagcctgggcaacatagcaaggcccccatctctgcaaaaaaaaaaaaaataaataaataagaaaattaaccaggtgtagtggcgcatgcccatagccctagctacttgagaggctgaggcaggaggatcacttgaacccaggagttcaaggttgtagtgagccatgatcacccc

SEQ ID NO: 131573 - DNA, 1151 bp, Homo sapiens
agaagtgtcagaaccagagagatagcattgtgacaaaaacctgactggccattgctggctttaaagatggagggggccacaagccaaggaatacaggcagcctttagctgctgaaaacaagaaaacagacttttcccctagaatgtccagaaggagcccagcgcagccatcaccttgattttagcccagtgagccccatctcagatttgtcacttctgggatggtgagagaataaatttgtgttgttttaagccactgagtttgtggtaattgttaaagcagcagcgggaaactaattcaaggtccaaggcagtaaacagacaccaggtgtgtcaaacagacagttggtgtgatttgagttcagagtagagagggaaacattgcttgggataggggagcagaggaggtcaggaaaccccatacaggaatcaggagccaaccaggcgtgtgatgaggttttgaagcaaaaagcagaagaaattctagactacagaaatgatggaataagtgatacgattttgaaagtacagaaaaacatatgggcccactgagttgatgacctggctggaccagagtgcttatttaaggtagattggatcttagctttttatgagtcatggtctcctccgagaccttctgttcacacagtttgaccatcaagttcagattgtgagaaatgcttcaacctctggtttaatggtagaaaaataagtaagttgaattaacatctctgagcttgttcagggctggcacagtttcttattcttcgtaaatgctggatcaacactaattaaccaatgcattccctcatccaggactgtatacccctacccctaagaggtgtgtcattcagcaggcctgtgaagccctctgctttttgtttttcactcaacaaactttccttgaggaccaactctgagacaggcactgtgtgcagcacttctttgttcttccagataagactgtgtctctttaaaaaactgtgcacacaagacttctctgtagccttcctttgtaacatggtagcccctgtctcacagctcttccagccaagatgacttcacagtccttctagctaccgtctgcttccacttcctatgggtggtccacagtgaaaacagcagttggacttcctcatccttcgtatcttt

SEQ ID NO: 131574 - DNA, 1040 bp, Homo sapiens
gtaatttaaaattttctgctgtccttattacaaaaagtaagaagaaagaggaaagattacttttagaaatgttttatttaaacaaatatgtctaaaatattttaacatataatcaatatgaaagttactaatattattttgacttttttgatactaaaattagaatcttacagtacatgtcaacctggactagccatatttcatatatttagtagccacatgtgaaaagtgggtactgtattagataacagcacagatataggttatttcatttgtcagtgactgtgtcagagaagggcaagaaagcataaggatatttaaatcaatcatcatgtaacattttagaagttttggagagtactcaaatcaaaccagtcggtaaaacgagttattatctgttgatttcttttgtatttgtcacttttctaccctaggtgtgattggtattttaatacataaaatgccaattttaaaaatagtttagtcagcctaaaatgacttacttctgaggatcctgctagtatttgcttctgtttgaaatgtcatgataatttgaatccacatctacagtactttcatattttgtggctgatgtggtaaactagtttcttacgatattgggcaagccagaggttaagcctgttaacttcagcagccagaatactgtactctagttgctataaacaattaggcctgtcagcaattgaccttggaaatgctaatttgcttgtccctgggtgctgcctcaggcactggctttctctctgtgggtgggagttatgaacctagtttggaggagaacttgaggcatttggggcaagctccaaacagatgtgcttcttgcttcatttttgcatgtgaccaagtcgcaagaggcgcattccttgcatgaatttctttgaaggccttgtagaatcagacatgtatgccttgactaaagttgagaggaagctttattacttttgaatttacccttccctcttcattctactgcacatctgccataacgaaggttgattgaaaaatgctacacagtgatt

SEQ ID NO: 131575 - DNA, 1034 bp, Homo sapiens
acatgaccagtaatgtcaaccttgatcacctggccctagtagtgtttgtcaagtttctttactggaaaggtacttttttctttcttttccctctacatactgttttttggaagcaagtagctcgctgtatccacactcaaggggacataattaaactctacctcctggaggagtaattatctacataaattatttgaaattctgtaaagagttttgttttctctgcttctgcccctgccttaggatcagctatttttccaagggccctggttctttttgattggaaagtggtattgagaaaccaagatctgggctccagatgtgcttgctgctaccagaaagtgactgcctctaagccctttcagcagacagagctaggaaatatgtgtatgtaggctaatgtatgtgtacatacatacctgtcacttgtatgtgtattcatctgtatctatattaaggggaacatgtgttcacaccattatcttcaacgctaatctagtgctgcgtggttaaattcttttctttttccctgctgatttgtaatttccctcaccaacattaagaaactggactcccaccgtccactgtacatttgcttctgtgtgtgcctccagtatacatgtaaagcattttcagaattattagcctgtgcttctgtgacaaacaagttcatcagctagcttagggtttacggacagttcttttgcctttagtgttatggttttcagtcagaacaccatttccaaggttacttaggtcatttccctttgttctccacttccttcagtgacatttgtcatgcatttgcaatacagttacattgttgtcatagtctggattctattacaggatcccctcattcctgattgttggcattgtggtagtttattattattatttttggatacattataattctttgtgagtgaaatttacatgggtcttgacatactgcaatctctttttgaaaatatatacgtacttggaaaatatacgcactgaagacatactagaatgtttgctggcagcagtgt

SEQ ID NO: 131576 - DNA, 1045 bp, Homo sapiens
tactaaaaatacacaaaattagtgaggcatggtggctcgcacctgtaatccccccagctactctggaggctaaggcaggagaattgcttgaacctgggaggcagaggttgcagtgagccgagatcacgactgggcaacagagcgagactccatctcaaaaaaacaaagcaacagagcaagactccatctcaaaaaacaaaaaccaaaacaaaaaaaaagaaaaagaaaaaagaaattctgtgaaatcagaaagagtctcagagaaaacgccgtttatgatttttaactttgtatcatacattagaaccgtggatctcaaattttatcactaatcagaatcacttggaggacttgttaaactgcagattgctgggctccaacccccaaggcttcagattcaggcctctggggcaggactcgagaatttgcatttctaacaagttcccagttgatggtgatggtgctgttagtccagcccaaccacactttgagaatgactagattagagaaagcaaattatagtacaaagcaatcatattctggtgaggggattatacattaaaagctggtttctttcatatttgttatgtaaaaaatctgtattgatgaatgttttcatacttaacagaaaaactgtaacgaggacacccagacattatgttatgaagacttctgagtcattatgatgagatttcattatattaaatgtggtttaaattatatagttaaatgtacttttttagtaatagagttactattagaagtggaagtattatggcaagtctgaaaatatgggatctatgtgtggagtatattaagggaactctatagtcgctccccatccttgtcaacacttgctacaggcagtcttcttacttttagccattctaatagatatgcaatggtatcttatagtggttttaatttgatttttctaatgatcattaaaattgagtaccttttaatgtgcttatttggcatttacctctttggtgaagtatcttcaaatcttgtgttgccatttgttattggaccagttttttaa

SEQ ID NO: 131577 - DNA, 1064 bp, Homo sapiens
aggattacagttgtaacctgctgtgcctggcctaaaaaagattttttgggggacaagctctctctatattgcccaggttggtctcaaattcctggccttaggtgatcctcccacctcaacttctcaagtagctggaattacaagctcgagcctctgtgcttggctcaaacagattcttttgaagaacagaagtttttaatttctgtgacatccagtttaccaattttttctcttgtggattgtgctttgctcttgtatctaagaaatctttatctaacccaagttcccaaagattttcttctgtatttttctagaaattttgtagttttaggttttgtatttaagtctgtgattctttctgactgaagttttgtatatggaataaggtacgaggtatagatcaaagttcagtattttccttcttttttttttctttgcatgtggatagccaattgtcctagcaccatttgttgctgaagactgttttttctcagctgaattgcctttgcacttttgtctgtttagttgtccatgtaggtatatatccatttctggacacaattcaatgctgttgatctctttttccatcttcatgccaatagcacactatcttgattactgatgctttatgataaatcttgaaataagctagtgttagtcctccattgttgtctttttcaaggttgttttggctattctaggtcctttgcatttccatgtgaattttagacttggcttgtcaatttctacagagaagtcggccaaggttttgattgatattgcatgccttgcagcctggaggctctctcaggatactaaggtgggcatttatatggcttaccttgtatgcttctagtcactcttgttctttcctccttgcatgatgatgtccagtatcttataaaccttttttaaaacattttttaatttttatttttttggttgtttgagacagcagacaaatctagcccctgttaatggccagtggaagtattatggcaggtttttgataaacaggagagtaacaccagacttgtacttgagaaagagaattggcaacatca

SEQ ID NO: 131578 - DNA, 1007 bp, Homo sapiens
cagtaaatatttgttgaatgagtgaatggaagttcctccactaacactcatattctaatctttgtttagcatcactctttttttgtttttaatatagtatgtgttgtcttctgtattagtctgttctcacactgctaataaagacataccggagactggtaatttataaaggaaagaggtttaattgactcacagttccacatggctggggaggcctcacaatcatggcagaaggcaaaggagtagcagagtcatgtcttgcatggtgtcaggtaagagaacctgtgcagggcaactctcctttataaaatcatcagatctcatgagatttattcactatcacaagaacagcacaggaaagacctgcccccaggattcaattacctcccactgggtctttcacatgatacatgggaattgtgggagctaaaattcaagatgagatttgggtgaggacacagccaaactatatcatcttcccacatatatttgtttgcccttatgttgtcattttatagtggaaattttgtcattaaactgaaccagacattcacttttccttctgttcacctacacttactgaaaagtagagcacagagatacaattttcatcgtgaaacttcctgggagtagtttctcctcaggtgtagatgtttttaatttatttctgctgtttctataagtatttgaatttctgtagtcctttttaaaagggatgccttacacatggaatatttgcatgggattactgtcccaagaacctcacagcaatggttgcctctaaggagagcatttgggaattggagataccacatgattgtactgttagaatttttcaaccgtatgcttgattacttttttagtcatatgctttattaattttaaaaacattttttaagtagttggggaaaccccatgattcagtagatactagcttaagtgaagaagaagatttgtattgggaatattgcaaagtacagttaatacagcaaaatacccccatttgt

SEQ ID NO: 131579 - DNA, 1530 bp, Homo sapiens
taactttaatgcctattcaatacctcaaaaagagagaatagtaatgtagttataatattgctgttagtgggttttgacactgagtaacagatgacatgtctaatgaatagtgtgactgcttagattgcataattataggtttgtttgactttaggaaaatcatacgcaggccaacttcacccatttagagactttttgtattatgtaaatattagagcacttcactctaaaaagaaaccccctccttcagtgataatcattctttgtttttccagggtttgccactcagtaggaaaaagcaaaatgaaatagaaaccatctttaaaggatggatttaattcagtagcccttcctggtttgaataacacttcagtccacaatggtttggcattgtgcttgtgactggggtcattgggtacagacatgcaggtttataggatgacagccctggcactggcatacttacagaaacagctagaattttataatgtaaatcagggattatctgtgccctttggacttgattttgtggggtggcagtgcgggggggatagctagttattgtactaacttcttgcaacagtttcttaattgacgtatcaggtgacaggtctcacagagtcaccaaggccccactgtgatacttctccatgtatttattggcttgtaaatgaatgttcaaatatatcacttaggttcatttgattaacgaaagcaagggctggctgtaataaataaacgctcacagaatggcttagtgaaggaatttgaatattcctagcctcccagacttcgcttggcagggctgggggtcgggggagtcaaatgtgtggctaataaaagtgacttttgactttgagctctattcagaagtaattctgcaacatgaagccttccagtattctcccttcaccttgaacatttctctcctgctgctcttcatttgctgcctggtagtcagtctggagctgctttcatctctgttgctgccggtgctcttggcctagtacaagcttgacctcttagcagctggagttgacttagttattctcctagcattctctgagtgacttggttgctcttacagcacttcagattagctttgctgatgtgaaaggtcacttttcaccaatattaaaacttattaatcttcaaaaaggggaaaaataattttctttttgttatcagatttcttaaggaatttggaaagagctttccagaaccatgtctgatagcctctgagtggcattgtctagtgtcctccttggaagtgttgttttatgctaacagattgccaacggagctgagctgaggctctgggtctttgactttctcctacctgaaggtttgttccctggatattcatggaggagtcggaggtgcttgtcctccttgtgtttaaatacctttttgcacaggtgggcaagtgtacagacttggcagttagaaagccagagtgggaggcctggcgctgctgctaactacctttgtggccttgagcaagttacttcagttttctcatatgtaaaa

SEQ ID NO: 131580 - DNA, 1080 bp, Homo sapiens
tggggagagtggggaaggatagccttaggagatatacctaatgttaaatgacgagttaatgggtgcagcacaccaacatggcacatgtatacatatgtaacagacctgcatgttgtgcacatgtaccctaaaacttaaagtataaaaaaaacaaaacaaaaaaaaacaaactacctaactcttatgttgccctgagatttgatgtaagtttgatgtgctggcacataacagtgttccctaattgttagctacagctattatatatacatatataatcattgtcattactttccatgttttatcatctgcactgaacttccctaatgccagacttgcagaagtgttgtacagcaatgcttttctctctggagtcatcattctgtgaatttgaacatcgttgtgtgatttctacccaccactccagtgctggtgccatctcttttcctatagaaaagtcacactgaaaatataaaataggcaagtgaagttatatcatatgtcctcttttatgttctaattcagttgaatctctttgataggacaatttatattttagtgaaagtttaattttcagatttatgaaatataatggccttagaagaatattgaaggaagagttgctataattctttgttggatcctaagaacactaaggcatcattcttgtcctcaaatggattaaaatctctttggtgaaaggaaacaaatgcagataagaaaggaaagattggtggtggtcccaagatatcaagagtgtatgtgttaaggcaaattaggtgaagaaggaaatccttctaggctggtataatttaaaagcaggtagggcctgagctcagcccttgatggatatgtaggatttaatttggtatatattctcaaaaagggctttcagtgaaagagtgggagaattttgatggtgggaagatatactgtggaatcaagtagcagggagcctctgcctgatcagtacctccacaaccaccccaacccccagcaactttttagtcagtaactctgtgtttctgtgtttatccctttttccccctccaaagtcaagaggtttttactgcagtcgggaaa

SEQ ID NO: 131581 - DNA, 1014 bp, Homo sapiens
aggttgcagtgagctgagatcacgccagtgcactccagcctgggcgacagagcgagactccgtctcaaaaaaaaaaaaaaaaaaaaaaaaagaattgaacttttcccccttcaggacattgagtcactcatttaaaaaaaagtttaaaacttctcactctttctcacattcagtagttaacaacatttctttcatcttgaggtttcatctcattatcctcgaacagggaagatagattttatctcacttttcagccctaacctcacactagaatagactggaacaacttggatttagtgattccgatgcttatcaggaaggtctctgttcttttataggaagaaaaaacatagttatttttcttttatgatacaaaggtatgctttctatgcaagctggataccagaccaagaataataaatcacaatttcataaggtttctaagacttgatattatatggggatatgaccattttgagggaaatgttttacatcactttatgtacttgaagctaaggatactgctatcttattgcttgttttagtgagcgataagaatgaacagcagcttgggaggggccgggataatatacttgtttagaaatagcaatggtctagggatctgaagcttttccagccctggttcttctactttctaagttatgatccctggtcaagaaacctaacctcttgaaaactcatgttttttgtctgtgaaattcctgccctgtgtatttcacagaatgattatgtgaatcagattagataatgtatatcaaaatgctttggcattcatcaaatttgatggggctgtaagataatatattattgcaaactcagatttccaaacagaaccccttagagagatggaacaaaatcttctaaaaagcaagtattttgttttgctcactttatttcagggtatttttttggctttgacctgtcctattctggaattcaagagtcatataggattaagtataggctacttaaattattgcacaaggtgttcat

SEQ ID NO: 131582 - DNA, 1122 bp, Homo sapiens
caactctttaaaaactgcatttagatcctcagagagttctatatgaacttttttgatattttcagtcataagaccaacatgtcataaaagtgtttttagagctataagacagtacacagatacacacttttttttaatcactattactgccacggaaaaactgttttctcagtttcatattgagaacagaatgatgttctgaacactagacttctgatgacctgatgtttcctcccttgctttctacgcttttattaagtacattgaagagacactattggctggctttttgtttttcagttttcataaataaatgaataaatttatgaacatttgaataaatactcaaataaatctttgaataaatatttactgaacagccatgtgccaggcacttctagttgcaagaaataggaagtcaatcagcaaagtccatgtgaccttcacctcaggatatgcgaagtccagaacagaagacaaatattttacaaatgttatttaattactgctgtggtgtgtgctacaaattaaaaataaagcattcagggagagttaataacccaggggcaataatgtcttcagggcagggaagaatttggagactccttctggaggaaatgatatttaagattcaagtcaaatgagtctcaacatgggaaatatatattctgtgtaacttttgcatgaaatggaagcatcttatttctgattgtcttgatgtcagcttcagagtgccttaatcaatccaaagacttattgtgaaaattaggccagagaaggcctacctttatatatagaaagttaatgtttatagaatagttgagtaacctaagattggtcagtgattcatttagtaatagatttttgagtgcctactatgtgccaggaactatgcttagtaatgcaagtcatggcagtagttgatttaagaattattttattatcaatatcctacttcttaaacaggggttatctctcttaaaatgagactttttattgactattaaataaacccagtggtagtactgtgtgtttctgattatatgtttatgattgttttaaactaaacctatagttccaaactgtgggcttcaaattgctcagggtaggtttggagagtga

SEQ ID NO: 131583 - DNA, 1629 bp, Homo sapiens
cctgagagcagttctaggccacaggatgtaacctattatatatgaccacttactgactgaatataagaatataccccactctattaggcattgtgaatcattgacaaaagaagaaggagggggaaattcgttcggtggctataaaatttgaggacaggagattcctgagcatgagataaattactcttgtcagcagaatagcaaaaaggcaggaggtgacaggagagtgaaattagtgaaaagctcttcgagccagaggggaaagtactaggagactcacctcttctctactcgctgcatatggcattctacagtgatagacaactcttaacatgtttcttatcaaaagttttcaaatgagttatatgtgagcttttcatctgtaggaacattgctcaggtgtggaaattaaccagagaaagaaagttgactttaggtattcactcttcagacacttggaatgtgtctatttctgtgattactggtaattaacttctatttcggtggtttagaactccctgtacagttattctcaaattaaggttgtgttcggtaacattttgcctaataaacagagacagagacaattagttctgaatatagtatcccactaattgaattacctctataagaaataatctagatataaaatttcttaggtttcgaagtaacatagctgctaataggtgaagatatgttatattgagactgattttcaccgttacctcatagaaatccatcatagtattttggagttattaaatgttgggttttaatcagacttataaaactgttactgggccttaatgtgcctctagtgcagcattttcaagagtttgccccataatactaattaatcaggatgtgaataagtataataggaaaataggattttgtggtcaaataagtttggggaatgcttgattaaaagaatttccttaaagactccaaagcctttaatgtgcttttatgcaatgtgattctccaaaggaagaggatattcagaaatgttgtaaacttagttaactagaacatctctctggaggagggactgatattcttcagaacccactttgggaagtgctgctgtggtttcaaccccctaattttacgaaggaggctgtgagataggtccagcactttgtggcagagtttcttgtggcatccagaaaactgggaagtatgtcgaactcccttccaaaatgagccttaaagatgtttccatgttgaaggtcaggaaagggccaggccctttctccattgcattactccaacagtgaggaagggacagtttttaaaaacatgcggtgaatgcttagtctgtgtttgaagcaaagaagacccctctgtgcagtgatgatatgagaaaaaggagagaaggaaatgtttgagaggaaaagaagagaggggcttacagaagaggcaggagacacacaggagcagcagaatgggcaggaaacgcatatggacctttgaagggccaggctgaccacagcactccaggtaggtactgaggcgcccagtgtgattattaaacaccttggcctcagtggcaccaggccatcctagcagctaattctttgaattacccaaatgatatgaatgttccttaacacagcaaactcctga

SEQ ID NO: 131584 - DNA, 1081 bp, Homo sapiens
aaattggtgaactcctctaaaccacctaaacttggaataaatggcgataaactttccttatatttattttcccaactcacagcttaaactggaaggaaaaagtgtataagattcacatttaccttttgactttagtcatctttttcataaaggtttattcctgtctaccatcctgccccctcagaattttgcataaatctcatataacagttcaacaagtgactggtgtagactgggcctgctttgtcactgagtcactttattatgaaatacttaaagttgaatatctgtatatagcaatgaagaaagaatgttaaacagtttatactttctaaggccaggcttggtggctcacacttgtaatcccaacactttgggaggccgaggtgggaggatcgcttgagcccaggaggttgagaccagcctgggcaacacggaaaaaccctgactctacaaaaaaattaaaaaatgaaagtaaataaacaattcaaaaatttatactttctgatctgatggttttcatgactaactcatcagacagcaatgaaaagtgaaattaataaaaattcacaaagccagatataattagttaaaaataaagtctgaataagccgtaatcatctttacttccctcttcccattttgtaagcagttggtatttgattgataagcatgtccagctgggaaataaagatctggcttctaatccatgttctaccaggctgtgaccttggacaagtcacgtaacttctgtatttcagcttcctcatttctaaaatggggtaataatagtacttggcctacatacctcattgggcaattgtagataaaacgagattgtagataggaatgttttgactacccccctgccccacaaaattgaaaggtggttatatagttaccacatacagtcctcatctgacaacccatatctgaatggccacaagactgaagagtgaaagaaacttcctgattctaccaacaagaatgggaagggagtccctgttagctcttagaggaggaaagatacattcccagtgcttagatctctgaatcaaattctggaacacagtttcccaca

SEQ ID NO: 131585 - DNA, 1019 bp, Homo sapiens
actctgagcctcaagaaggttaagggacttgcgcagatcacttggttagtctcaagaggtgagacttgaacctcagtgttttgacatgtaattcaaggctgttttcatgacagttctgtttcaagatggatgctattcattgaattcactttgagttgtagttttcagttgagagtaagaatgtttttagggagtcttggttataaagtatatttatgattttgtacatctcttattgtaaattttccaaaggtaaagttttgggaaatttagtcaaaacaaaaagtgactccccacactgatgtggcgtgtgttagagagggattctattagaattaaggaactatttgaagcaaagaatactgttatatgtaacggttatattaaaaataagaaaaacttttgaagagccagtattatttacttctttaaaactttgtgttatatttttgaagtggtagtggtgtgaatatgaaggaattttaggaatttaaagtaaaataaaaatgaaataaacttttttctagttttaatgatatggtttatgtttatatttattaaaatattcagttcttaccataataatagcaagcctagctaacatgtctccagtgcttgttatgagccaggcagtattcagttatctccggttgaataattgttttcttcttgccaggttagcctacagatttgttcatgatcaattcttagaagtagtgagggataagtctccatgatagaagacagtgataaggtctgtatgtggcattacatgggacatgtaaaaatgtttcactgaatagtgaaaaggatactgcaattggagtcagaagacctagcctcctccttgttcctccctggcctaacagtgtgacactgggttagtgacttgtcttcataaaccttcgatttccttatctgtaaaaagagaacagtgatacctcatagggctgtggcaaggattaaatgagataacttaggtaaagtacttaatttatgccttcaaaagatgaggcctc

SEQ ID NO: 131586 - DNA, 1384 bp, Homo sapiens
ccagctgttcctcctgacttccccatcttagaaaatggcagtattactattccatttttaattagaccaaaatccagagttgtcctttgttccttaattttttcacagcccatatccagtccatcaataaaccttactctttatttctttttttttttttttttttttttttttttttttttttttaagacagagtctcgctctcttggcctcttgggcaggctggagtgcaaatggcgctgtctcggctcactgcaaactccacctcccgggttcaggagattctcctgcctcagcctcctgagtagctgggatttacaggcatgtgccaccatgcccgactaacttttgtgtttttagaagtgatggggtttcaccatgttggccaggctggtctcgaactcctgacctcaggtgatccacccggcttggcctcccaaagtgctgggattacaggcgtgagccaccgcacccagccaaccttattatttctacctacaacatgtatttagagtctaaccacctctcactgtttctcctactgtcaccctaatccatgccatcatcactttttacctggatgcctgcagcagcctactgactgctctcctgcttctgctcctcctcccctaaagtggttctcatcctcacagccagaatgacccttttaaaaagaaaatcagaggtttttactactctgtgcaaaaccttcacacatctctctcagaataaaagctaaagccctccgtcatctgtcccacttcgcaccctgctttgattaatactactgacctcatcccctgttacttcccaaaccctttttactgtgactccaactatatggctcaccccctcattttctttaggtctctggttcagatgtcgtcttttcattgaagcctgccttgaccgtccatcacagaagagctcactcatttccactctgctcaattgttctccatggcacttataccatttagctagttacgtattttcttattattcttctactcaagtagaatacaaactccacaagggcaggaactggttctcttgactgctgtgttcccagctcctggagcagtgtgtggcctctaataggctctaagtaaatagttgaagtctagggttagtagtatgtcatggacttagcgatataacagacctgctaatgcagtcagtcctagctccaatactgagctcttcaaccccttgtaattagaccgctcctcagcttcagttcctaatcaatagcataggatgtattcattcttacctataatgttatttgtttgggggagggttaaataaaataaacagtatgaagtgcttacctcagtaccttgccaataataaatagttgagagcagctgctgctactaat

SEQ ID NO: 131587 - DNA, 1233 bp, Homo sapiens
gagagaatttctggttcttactgcagtgcaatatcactcctaaagtgagaaattcccagatttaggataaatgttcaaacagttctagacaggtaagcttggctactcaacctctgtgtacacttttttccaagacttaaatttacaaatatagtggcagcaacaacaaaatgtttcctcctaaggtgttgcagctatttttctaaaagcgaaaaatatgctctccccctccccaaaagggggaatgatacatcttaccaggtaccgtttccagcttgaagtccaagatatctgagctgagcttattccttttgttaaggttgccttatgtcgctctacaactagtgagccagcaacttatttttataaaacattaggagaaaaagagaaggggaaattggttaaaaacataaatatgtttatgtcagaccaaaaaataaatatgaatagatactttagtcttagcttttgctattggttctgaatccaaagttggtatttttaattcccttcctccactactcattccatgttctttttgccctcagccagctctcagctaattgtagatttttatctgtagatttttatctgactgacgtttatctgacaacactttagactgtcattcacaggggtgaggaaggaggctttgagttgttggtggtcctgcctatatggagttatttctatcttccattatctttcaccgctagatgtggtcaaaccaacaggtgttccaggttccagacacacacctcccttctctcatcctgttgcaacaatcttctttacccttgataatcaagattcattaacacaaccaattctgtcacctccctttttgtccctgttctgtgtcatgaggagttcagaattgctaggttgcagtttaagcttccaaatcagtggaggtattgttgagtcccttggtgaaatcattcttcacttgggtgctgagactgttaaaccagcagaaccagagtcgcagtgatgggggaattgcaagttggtcattaggtgtgatgagggggaggagaagatgtgtaactaattctgcttctgtcccttggttactgggccctgtattatggctgtgggagaaacaatgttttgtattattcactggttctgagcatcttgggagacaccaccctatctaattttatttggaactgaatcttcagaagatgatttcagcattctgaaagatgatcttctagatgatagggt

SEQ ID NO: 131588 - DNA, 1055 bp, Homo sapiens
tcacatgattcaaaaagtgtgtgaatgactcagctcattaatatccttagctcctgtgatctcccctcccagtgaaacgatggttataaggcaataatgataattggaagaggaggagactttgactttgccccgtggcaataaaatgacacactttaagtaattacatgtgcatacaatattgtttgaaagaaatgagttatattatcatcatataaatacatttaatatttgtgttaaaatatggtgaaaataatatgtagtttcagcgtggatgaggactgagttctgctttttgtttctaccattatcttttttcctgaaacaacaagcctctatatggacagagccatttggagccctaacttagttcctaacagtcaactcattgattaccttctccttgctgacatagagaaatgttgcagtcacaggggtgttgggttctaattacatgtagctaagtattcacaagtgattttgagctaaaatgagcaattcgttgaagagtctgtggaatttctggggatttgcgtgtttcttcctgttactgtttctttctttttgcagcaatttattaaacaaagacctggatatttggagtcagcctttgcgcatatgtctgctcttgctagagtctctagtgactcaaaaatctaatgcacacttttcacttcttatttagtttcacttctctgcagcatttgacagatctcgaaattccttcctaaactttgtggatattttcttttggttgtttcttaactcttacactttttctttttaaactcttctagccgcccttaaaatgtgatatcctccagagtttggtcttggtccttttttttgtttctatttatccagtctccttggtgatcccattcatttccatggtttccattaaaatccatacactggttgctccaagtgggtgtctttatgtcagtcttgatgagctatagacctgtgtattcagcaacactggagatatgtatagatagataataatagtaacaacaatactaacagctactcattattgaatattttctgca

SEQ ID NO: 131589 - DNA, 1882 bp, Homo sapiens
ataagattaacttatttgaaatacatgttgagtactacctactgtgtgctgggcactggtaataccgtgataaatcagacatctttcaaggagtttattaggggaaagaggcataaaaataagcaattgaatattcctggagtggtggtagaagtccgtctaaagtgtatggggcacaatagagagtttggtgagttttgcttggcagcaggagcatcaggaaagggccagtgatgaaagggagcgattatgaaggcctgatggagagcagctgcagcaaagtgataaggcagcagcttgactatagtggctaaagctggaggatgagaaggtggaaagagtggctccttttttcccccaaggaggtggaatatgaacagaaaataactgggggcagggagttgggattataagaggttgtttgttttaaaaaatgggtgtgaagagcctgtgtaaaggttcttgagaaaagagcccgttgagaggaaagtttgttgtgaaggagatgaagatgtaataaagaacagggttgagaatggatagcgagatagatagatgaatagatatgtgataacatacacagagcagaatgttaattgtggcacctaggaagtagatgaatgagtgttcataatatacttccttcaacctttctgcatatttgaaaatttataatattgggaaataattttataatattggggatggaggagaacatgggttgagaatttagccttgaacagaaccagggggcacttattccttggcatggcaggacattatggaaggtcaaggctaaagccccagccacttttgtaaagcagaagtgactctgacctgctagggtggagggccaaaaaaaaaaaaatgttgagcatgaaggatggaataaccacttgtgagtgtgagagaggactgagcagacttgggtggtgatgctcaggtctggtgaagttgccacatttgtgattttccctggcagttatcagaagacaacaagttagtaggatcattgaagggccactagcttacggaagccaaaatagaatgagtagttggcatgaatgagtcccttcagtatttgccagcagtctgtcctagaacatgtcccaacctctctggtgctttgttcaagagattgttttcaacctcactatcttttgctttgaattatctgagataaaaacaatgttgcaaaactttgttaacactattattattaacatttaactcaggtaattttgttgtctcccttaggtgaaagaagaacgtccagaaaaaataccagatttaaaattattggtagagaagaaatttttggctttacagagcaagaattctgatgcagactttcaaaataatgaaaaatttgtacagtttaaacaacagctgaaagaactaaagaagcaatgtaagtcaacatgctttgctttggttcggctttttgaaattagggaactgacttgatgaacagccccagttaactgattttataaagtttgcttatctgcttggcttgatcctcattctaagttgcgttttattgttgttgcaattctgtattttgtctaatttttggttcaaatcagcctgctcatttctgaaagccaacagtttccacaaagtgctcagaaaatttcccagcagctagttatgtgtattgtcccattgctggggagggaaattgggaaaacaaaataaaagtgaaaactattttatttaaataacaatggtatcgttcaagttttaaactgctgtgccatgctttaaaataaccatactttgattctggttttgcctctttggagtaatattagctatgttttctctcagaagaccactttatcttctcaactatagaccaaaatctccttgatccatt

SEQ ID NO: 131590 - DNA, 2090 bp, Homo sapiens
ggtagtataaattccatgtggtttttaaattgttgccttcttaataaactattacattcaagttttttagtggacataattttgacttaagaattggagcaggcaatgtaattttttataccaaaaaaattttttagacagtatttaccagaaataatatatcatttctgcacagtaaagtatatatgccctttcttttcccattcttccatatggtccacataccaattttatataaattgattttttcacattagcatctatttagtcctgtagtctttgcttcttttaggattgagacgcttgtatttcttaaagaagtgaatagtgaagcaaataaccttttctaactttagtctcccaacaccttcatttacacacacatggagcaggagtgttgtatgatatgagacataaatttacctcgtgtccttatatgtgcttaatgtagggattcgtattttgaaataggctttcttttaaatataagcattttctttaaattgatgctgagatctcaaaaaatgactgaggaagctgcctcacttttgtctattttacaaataacttaagtttcacaatttggaatgttttgcaatcatgatgagacttttgtttttactgtagacttaaccagtaagcattttccccatattttaagtttatttttgttcttttttttaacatcacagctcccaacattcttctaatgtatttttcactcttccctcaaatgattaataatttcccaaagagataataatttgccaatggctttctgatcttaaagatgctagtgaattaattgtatagccatgagaattagacattattccccttaaatatacatgggccatatagtctttaccttttatccatgatatttattactcagtggtgtgtgtgtgtgtgtgtgtgtgtgtgtatagtatctggcacatggacctgtgattaccagcctgaggccaacaaacccctcagttgggatgtagagattaaacaaagcttttaaaagctcacattatatgacctcaagtttgtttacctggtcatctcatggtaattagaaactctgattggcagctttcgatttcttgattaaaaacctaaataaactgattgttataggcattttttcaaaggcattctcagtgaaaagaccgagaactattctatttggtgcttagtgaaaatattttgaactaatatatgtaccagttattaacatctctttattaaatgcaatagttttttgtcaaataaatagcaatttttcaatcttgaaaaaaaaaagatgctaatgaatttcagttttggtgttggtctaagtagccaaatgtattttatttgactatttggagccagtactcataaactgtggcagacttagcatccaatcacaattcctgagttttaagtaattttataatacaggttgaaggacaaatattcaaaaatataaattgttccttcttttgttattgtttacaaagttattattccacaaggtaaaggatgaagacttttagaatcatactcatggagaaacactttctaattaagaacatataattcaaaaaaatgataaatgttgaaatcatggctattacttcttaaatctctctaaaatggagttggaaaaagaaagaaaatgtttcctcaggccaccagtacacattatttggatagacagtcaaaccttatgtatatttatattgaaagaaatacttccttataaagtttccctgtatattgtaacactggaattaaaataactttcccctaaaataattaaaataaaaatttcccctagaattttattttaaaaagtttttagatttcaaatgacagaacaagcaaaatattaatacttttgaaaaatactctataagatctgtataccttacttgcaaaatgtaattttagtgcagtattattaatataatacttgtattatactaatacaagttgatacaagtataaacttgtaccatgtctagtggattttctttctttagatttaacactgttgtgagggttctaattaggatcaggctcccacagtatttgtgtagccaggtcaaaggtac

SEQ ID NO: 131591 - DNA, 1097 bp, Homo sapiens
gatctaaattatattcagaagtaacggcagtttttatttttttaattttatattttttccctgaataccatccatttgtctcaagtacattcagaacactttgaggattcactgtgtatgaattactacagttgaggctctgaaataaataaaaagcaaaaagcaggaatctgtacatgcagaagacagtgtatacaaacatgatataatatgacaaccattaataacaaatatcaactcaaaagcaaagaaaacatcagaaacaaatgttatacaatgtgggacctaagtgaggagagtcaaaacaggaatgccatgccagtcaactgatatggggctctctggagcagtaggtacagaaagattttgaggctgggttcagccccagtaggaaagaatgtgctaaaagataacagtgggaaaggagagggcagtacagatgtctagtatttaccatccccagaatacaaacctaacagatatactacactcatttagagatactgttactctaaagataatatatttcagttacacacaatgattttcccaatagttatgtcttatagatattactaggcattagatataacatctttgaacaaagaattttatcctttagatacccagtgtcctgtatgttagaaataattaggtctgcctcagcttacatctcagggtcattaccaagattaaatgagatactgactctgctagctctaaaagctttagatttaagttattgaggaagagctagtacagcataatggaaagaatgtggcttagcagacggaagacttggatttgagtcacttaatagcagcctactctcccttcagataccgcctatcttagatacttctaattcttggagtcatagaatcaagattgatcgaagataacttctacacttctagacaagatgactaggatagtgatggtggtgataactgagttagggaacaatttcacagagaagaatttcttaaacagtaatcatattctcactagcccaagttgtgaaatgaaacaatatgattcggtttaaggcagacataaccagactttcttgggtgaaataattttaatttagctag

SEQ ID NO: 131592 - DNA, 1062 bp, Homo sapiens
ctctgcctcccaggttcaagtgattctcctgcctcagcctcccgagtagctgggattacaggcacccgccacgccacctagctaattttttgtatttttagtagagacggggtttcaccatgttggccaggctggtcttgaactcctgacctcaggtgatccacccgcctcggcctcccaaagcactgggattacaggtgtgagccaccatgcccagccattatgtgcattattatttctttctttcagctctattagatggctgtatccattttatagatgagaaaataagcaaagagatgtaatataagttgcctaaaatcctgatgctgaaattcatacccaggtttaggtgataccacagcccatgttctttcccacataccacaccaattcttgaaaacacttttgtgtgttttttctttctctcaattcaagcataccattcatttcttggaaaaaaaaaattgacttttaataggactcttgaagagtgaatcatctgtttggatcttccagatcatagaactgccttgatgtactttgatgacgctggaggaatctgcttcatctagctgagagagaatctttttcggtcacttgcatttagagattagggagtagtaatgataccagacattacatagcagttcttcttttccagatctccatggttttggcaattcatttagaatacagtgcctaagaattatgtttctggtggaatagttggtgtgttatggcagagaggaggaggatatttatggcatcccaagtttagaacaaattccatgaaatttatttcaaacataacaacagtaatctcttgcacatacatcatctcgcgtaatctttacaacatccacacgcaggaaaggaatgcatgaaaagtacaagttctgtttttagcagactgaacaccatataataagaatcttggaggtgacatatttacccagtgtctcacagtcaagaggccacaaggatagcaaatacgttcacaaggaaaggggaagttttaaaatgacagatagctataattaaagttagtgaagaaaggtt

SEQ ID NO: 131593 - DNA, 1136 bp, Homo sapiens
tatagtaatataataataatgctaactagcccacagagttgtttatgggttaaatcaaatattatatgtgaaaagtgttttataaactgtcatatactccccaaatattagttacctgatatttttgaacttattagaggcatttactttaataattttcatttatacatatacttaaattgtataaggataaacattttaaagttattatcaattggcatgaattcttaagcataagcaatgttttaataattttgttaatgtgttaaagatcttaatgaaggataaaatattgctggactttcaagtagttaaggaatgttctgtaattggcaagggtgggaacaaaaaaatgttgacaaggtaacacatcatttttcagtacagtattggttttgacaaccttttcttgataggaagacagaaactgaagtgtcaggaattgctgtattcaccatgaaccttcctatgctctgatgaaaacatgaatatttgttataagcaaatgaaatggagctgcagctatcactatgtactctgtgggcctttaatacagtagggattcctttatagatatacatagatttaaattgaaaaaaatggtctttgctgtttgagctcagttgtttagttagcctttaaaaaaaaaaaaaatcaccagataacttatcgtaaatgttgtgtgtgtgtgtgtgtctgtatgtatatatataatttttttagtaccctcatctcctgtcaacctgtttgccagattatagactgtatcatacccatggaccttgcataactaatatctagaaagaggaagggaaggaggcagaaatggcttcctagggagaagcttttactgagaaataagccacatggctccacagccagcccataggtctttgagatatatacagcccatgcttcatcctacccctaccttgtaaatgttaatagactttattcttaaataattattgttaacagactcttttttaagaacagttttaagttcatagcaaaattgagcataagatacagagatttcccatataccccacatgtgcatagattcccccattatcaatattttagtgagtaggcccctactatattcagagcactgctagtcactaggaatgtaa

SEQ ID NO: 131594 - DNA, 1271 bp, Homo sapiens
tgctgtagagcacaggggttttactttacatttaccaaaagcagaaaattcctactgcagagatgggtaagaattatgccattcaataagatacgctgtctagtcccattcctaaaagtctagtcccattcctaaaaatccctaccagtcccctctccattactttctgcccccactactattgctgctctacttctgatcttgctgtcagcctcctatatgctcccagctctaactagatccggccagtttctaccagaatgatcattctgcagcatatacctggtcatgcttgctcacaggaaactggcaagagtcaagtagggcatgggctttccatggctcccttcagcccttctggctccaggctcctatttcactttctcaccgctctcctctctagcccttggaatccaaacacttaacattcctagaaagtactgtgttctctttacctgtagactttcactcttgctgatctcttcatggactattctacccctctttctcttcccttggttaaggcaagtccctccttctgcctcaatgcagaaatcactgacttcagggagtcttccctaaggtagagcaagtgcatgtctacaatgtgagacctttaaagaagctttcatctggagaagagtatctaattacaaagattaggaaaaagtatgtgcttggcaggaagagggatttgaggcaaattttatggtggctttgaaatatcctaattatttcatttaaatagtgtactaaatggaaccccaaactgaaatattcaactcataatctaatatttgacatgcattatactgtcccttatccatcagtaaaatgttctgtatctgctgcttttggtgatggtgcatcccaggagacacactgactgaaacacattaaccttctctcttgactggctcatttgattcaaataacaagttcccccataaccctacttcaaaaactagaaagtatcttactccattttcagaataccaagttgtgagaagcagcgagctattctttgtttttgttactctttgtttaccattaacctagtaatcacctcggctggaggctggagattgaagcaggggagtgggggaggaggacctgaaggagcagagggttgagaaaaaatggttagaattataggttgtaaataccagtatcgtacttaataaaatatgctatctctgatggtcaagcttaagcttttataatacaatgatttaagataattataatcaattgaattttaaagatataaa

SEQ ID NO: 131595 - DNA, 1749 bp, Homo sapiens
tacgagtttttaactgctgaaacatcattgactgtatgtgtgtgtgtgtttcattcatcctcttttctcagtacattacccctgcaaaacaaggaggtatttgaagtaatctcactcttctgattcatctgtttgatgaaagacatgtttgtttattcagatattaaaacaacttgaaaagagagtgtaacataaataaaataaaactacagctggtttacctatacagtatttgttaagtatctttaactgtctgtttttgcctggcactggactagatgtataggaatagagaaaaagaaacatgggacatagtctttactttcaagaagtttatatgcttatagcatgggtaaaatttatacccaacaaataatttattaatgtaccaaggactatgctttaatcaaaggtagtacatagatggatatgacctagtccttttagtggaaatagatatttaaaatagttataattcaaagcatgagagaaatataaactgagtgctgttgaattagaaaaagaataggaggagacaaatgattgagtgccagcgtaagtgtttcatacaattaacacctgagaagggagacatctttgaaaccagagggtgatggcttcatacagaaaatgagtcttgaacaagactttgaagaagaggtagaatttgaataagtggagaggtaggaatcctactcaatttagaattgagttgttttcccaagaaggtaattatctaattagagtcttttcaagtggcaagtattaaagagcatgcaataacatgactatagaaagactgtagaaaacattatgctgggaagattgctgtcaatgtttttttcctctccaatggtgccaaggcttaattttgttttctttttctcttaaaacttttttagagatggggtcttgctgtgttgcccaggctggtcttgaactcctgggcacagatgatcccctcgtctcagtctcctgagtggctgggactacagccatgcaccactgtgaccaatttgattttctatcgtcagctatttgtgtactttaattggaagactgagtaaagaatggttattttataagggaaatgcacattttgtttttattgaatagtactctgtagccatgtattgattgaaaaaaaatagaaacaaataatgtgtatctctgctgacgaagaagtacaacatagacaaaagtaaggaaacccccattgagtgatgtcaactgggtactttctacaagtatatctggctttatttagggactaaaccggtagaaataattgggggaatttcctttcctaaatttgacaggtaaatttgcttttcatactttctgttttagttgcttatatttaaactattttgagaaggagaaggatcaattaaaatgtattttatttagtgctaattgaatagtaccatatttaaacttataccaatttccaaagtacttgatgtaactatatataattagtaatagaatataggaatcatgatttttattttggtaaattaaaggtagtttttctctgttaaaatgggatttaaaacacctttatgaatgaatccctttatctagtttatcattgcctttcctatgaaagtagtgatacttgactaatactgtctaacttaattgctaccatgtggtgaattctagagaattctttaggggaaatttttctactacatttattttcaatgacaagaaattgggagaatttataatagctcttatcat

SEQ ID NO: 131596 - DNA, 1649 bp, Homo sapiens
gccacttgtatatcccagatcaacttctaattctgcttcatattgtttgctatcctttagaatatttctgtcccacctcccttcattacagtagctctttgcaatcttagataatcttatattttcattgactttatattccttaacttccaggagagttctagtttctgatattctgttccattggcatgtacttgtcagaccaggtatcctcatttacttacatgtcatagtgctctgtaaacgtttatggattgattagcctaagtgggcaaagtccatctgtctctataattttgaataagagagagccattgcttcctaaatattttttattagtttctgcctttgtgttaattagtgtaattaacattgtcagtatctgttgctacacgtgtgaatctcagtgttcaaactcaggctctttgctaccgacttttaccttgttagcaaggcgaacacatattcatttaaaggtatcaataagattttatgacctgttttctggtagcccaggatagagtctttctgggttcactctgcagagctgggtgagttaggtgggaagaatctcaaaaaagatgccattctggggtaataggggaagctcagggacttggttgagtttaaagtatgacctcctagagctgaggcagtgagagcccggtatgtgcaggaggctttgttcatggccagactattgtgggagcctcttgaacaacaaggtgaaaagagcaaaatgggcaaggaagttgtgagccaggctgaggtttgagtggagggttcaggtacgtgttcagtaccaaaccgttggaagtcattgccagagtattaattaaattgacactttaaatagtttctaaattagggatggttgatcagatgaagagacatggtgggccagaaagcactgacttggataatctaaataatttattaagataacattttttaaatgtaggataggatcagttcactgtatacagttgcacagtttgttatgtactacataaaagcacctcactaaggaggcagagggtgactagatttcagcccgggttctaatcaccgaggcatgtacctggtatgcctggaggaaagtgtacctttttctgattcatctgctaattcaaatatttggggtaggcaagtagaggccttgttctctttgtcttatatgttgtagacttaatgtgaagaatatcctctaatctgttaaaaaaatcaatatgtaataatattttctgatccaaaaattatattgagcagtaaatgatgattggctaccatttaattctcttttataaaatgagaatagggaaaaagaaaaaaagaaattaagtatttggctttgaaagagtcgacctgtatgaaaaagaaatgttgaacatttgtacccttttttctttttaagcttttattctctgttgtgagattttcccctttgaggacactgaaagcaaaatgaatcgtgccattggaaaatgccctgtagatcttcatggggttatctgtagccagcagcgtacaggaaactagtcacattattaattgcattctctcttggccaaaggtttagctgttttaaaatgtgatttcactgcccatattgctcatatgcctaagcttctttgttactttagtaaata

SEQ ID NO: 131597 - DNA, 1976 bp, Homo sapiens
ctcctctcctctcctctcctctcctctcctctcctctcctctcctctcccctccactcccctccccctttcccctccccctcccctctttcctttcttctcctctttcctttcctttcctcttctcttattttctctttctctttttatttctctctttctctgtttctctctctttctctctttctctctctctttctttctctttccctccctcccttccttccttccttatttccttccttccttccttccttcaactgtacagagacctggaggtcgccaggctacccattctgaaatgtgagttttgtttggctcacacagtgttgggatttgttgggtttcaaatgtgtttaggtaagagttgtgcctttctattagtcactattctgaccattcccttttgttttatatctgatccacttcaactgtctttcctgctggcattccagtttgtaattcttactttatatctggatactctgtgaacacagaattaaggcaggaaattagaaggtagaataaaatctgcttttaagaagcagtttacattaaacaaataacttttatttatagtgttaataaatgttttcaaatattataattgtatcccaatatcattcccctaagtactcttcccatttaattgctattaggctgggctgtgccttccagcaagataaataccaggttggtaggcaaaattagggaactgtatcaaggtttagaataccaagggtcaatagcaggccagtcgttggaaggcagaatatacacaaacagtaaggtcaagacaagtcataagtcagagcaagctggacagactagggaatagcagtagcatccaaggcccatgggagtaggaacatcaggtccaagcctctaagaccaggaaatccatgagcattaaaggaatgagatcagaattggcaggcaaggaggctgagtcatgggggctcacggtctcaacaaggaaatgggtcactggcggggtcagtacaggaccctacgtgaaagaaaggagtttgccacagaccaaccccttttgcctctgcttagaattttttaaaattaatagactttattttttagaccgtttttaggttaacagaatggaacagatagtgcagagagttcccagataccaccttctcccccaatcccctacacaccagtttcccctattttcctatttttaatattgtacatttgaatgatatatttgttgcaattgatgaaccaatattgatacactattattgagttaagcccattttttacattaggtttatgctgtgtatatttttatggggtgggtgttcgtgtattaacatttatattacataaaacttactattttgaccattttaggtgtgctgctcagtgagattaggtacgttcacactgatgtgcaaccatcaccattagccacctccagaactttttcagtaaccctgatggaaactgtacccattaaacagtaattccccatgtccctaccctcacctttggtaaccactttattttattttattttattttattttatttattattattattatactttaagttttagggaacatgtgcacaatgtgcaggttagttacatatgtatacatgtgccatgctggtgcgctgcacccactaactcgtcatctagcattagttatatctcccagtgctatccctcccccctccccctaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatatgccacattttcttaatccagtctatcattgttggacatttgggttggttccaag

SEQ ID NO: 131598 - DNA, 1597 bp, Homo sapiens
tcaatggacatttgcgttttcaccttttggatataatgctgctgtgagcatcagtgtacatgtatctgtttgagtttctgctttcagttcttttttgtgtatatatcagaagtggaatagctgaatcaaatgatctgtgggtccgggcgcgatggctcatgcctgtaatcccagcactttggaaggccgaggcaggcagattacctgaggtcaggagttcaagaccagcctgaccaacatggagaaacccgctttctactaaaaatacaaacttagctgggtgtggtggcacatgcctgtaatcccagctacgtactgaggcaggagaattgcttgaacctgggaggcggaggttgcggtgatccgagattgcaccattgcactccagcctgggcaacaagagcgaggctgtgtgtcaaaaaaaaaaaaaaaatggtctatgggttttgggcaaatgcacaatgtcatgtgtccactatacagaatagtttcactgtctgaaaaatctcctgcttcaaccattcttcactctctcacctttgcctctgcttaggttttaatgttctttttgtagacatttaaatactgtttatactccaacctggaattttcgggtaaagacgagttagtgaaatcagtgatcaagggaaagtaagatgttctggtaaattatttatagtcccttaggctttgagattttgaaagttacttacacagttagcgtacaggtaacaaacagagctttagaatgcattggcttcaaataggatgatttgtgtggatgcagttatatattgcatccatttattccacaaagatttattaagcacctatactatatgccaagccctgtgctagatgctttcaataggaaataaagattccataagataagttagactattttaggagtttccacctttttaccaccaagctacccctttgatagttgttccctaggaggcatgtgttttgaaagatcctgtctattacatattatgcttgtgctaggctttctcagaatattgaaaatagcttttgaatctccactgtaattttcagggagtcctagaggtctagagatcttcataagaaaactgatcacttttttaaaaaattttatttatttatttatttatttattttttatttatttattttgagatggagtcttgctgtgtcacccaggctgaagtgcagtggcatgatctcagctcactgcaagctctgcctcccaggttcatgccattctcctgtctcagcctcccgagtagctgggactacgggcacctaccgccacacatggctaattttgtttttttgtatttttaatagagacagggtttcactgtgttagccaggatggtctgtatctcctgacctcgtgatccacctgccttggcctcccaaagtgctgggattacaggcgtgagccaccgcgcctggccctgatcactttttaaattcagagcatgagtcttcgattaggctggtttgtgtgactgtcactgtgctcagtcctgttattacagctgtgctgaggtacttagtgtggctgttttccagacttgacttgctcaaattaccatttctctat

SEQ ID NO: 131599 - DNA, 1071 bp, Homo sapiens
tattgctacattttttctaggaactctgaacacatttcattcttgtgaattcgcttgtgcaacgatattaaatagagtaatatgtttattttgtttcaaagtcaaatgaatttgagaatggtgaaactgaattatttttcttgggctttctggaaaagctagattctcagaattctcccgtggttataagacttactctattttataaagaattaataaaatgtcactgaagttttgttttagacactttgggcttcgctgattgaaaacaccacaccaactgaaaaatcactgtgaaaaagaacctggtagtactgtcaatatcaagtaggattcattaattttctgacattactggacaagatggttcgtgccattcagaaagctctttttctttcttcttctttcctaatacagtgaggcatacaacgtagcctgccttatggttaagttgggtgtatgacttgtaaacttccctcttgctattaaagattatataatgggaagttcattggttttgaaaggcagaccaaacccacccatgggatttctattggctttttagatgtattgcatttctctgagtaaacccatgtggctgagaaatagtgagtagcttgttggctgactgtgggaaaacctatgaaggatcagttgatctcatttgggcaggagtcagaaatggctgagaatctaaaactatatatatgaggatggttttctcttgatgttgcaatctttattttaacatgtttttgtgtttagcttctggagttgcctaacagtataatttcaaatgaggtttagtttcagctgtttaattttaaactgtagggaacatgattaaaaaaaaattaaggcattatcatttgccttagaattttaatggtttgtatagaaagagttttcctgtgacaacctaaaacaaaaatgagcctaacctaattcttgatattatttgttttaccataaaattcttacattagaacatgtaactctgtcagagaatttcaacatagttgcataaattgtgtttcatattacaacttgttctctgcttgacttcattga

SEQ ID NO: 131600 - DNA, 2107 bp, Homo sapiens
tgggacattcgcgtgggtcgtttgtaattgaagacagtgcatcctttgtaactgaagctagtgcaaatgaggacaggagtggagggacagaaagcggagaggtgtacagctgctcttcttgcactgtacccctcatatctgcagccgggatcagtcaagatctcattcgtgatgcttgggtgccttgggggcttgggaagccagctcaggccttgtgatccactcggattagtgttgtctggggttctcactttctgactcctggaggacgaaacgccacttgtctgagagggagtgggagtgattcttgagaatgaaaacatgatttgggtagtgaagaggtggagaggagaggcagaggggatgtggaaaagaggtagaagcagggaagtaagcatgaataaagagtaaattgggcagggagaacaaggaggaagacactttcttccccttactcctccctgtttgacagtctggctatttctgctttctcccttagtttcctcttttctctccccgtttcatggcactgctctccaaaacttgttctggcaaccctctgcctcatctttttgtgtccttccccaacccctatctccacccaccagcccagttcacttcctttagttgccccagccccctttgcctagggactcaccagtgagtgccacattcacagccatgtctggtgcagtctgaaacacctgaggccactcagggtctgtattagaattaacctttactaacaggtttaaccagacttttcaggttccttttaagtcagaatgaacccctgccttgaccttgcccatcctcaaattggggggcagcctccagatccacaagacatgagaagcaggagcaggcctgccacgtccctgacatggcagtagagattttatgaatggtagctcggtgtctccatcagtggtagctgatggtagcttagtgtctccatcagtccttcagatagcagtgagaagatgtgggcaacagcagtgtccctgacttgtcagtagcgtgactgcagctcagagagcaagtcatgccaaccagggccttcccctccagagccactgctttgctgccttaccgaataacgaatcaaatgtttctttcctttactttctgtttagaattaaggacaacttttattagcatctttgtctaagctatagcattaactcccagtttttaattacatcatcttaattgcaaatgtattgcaattcatattaaaaatcaggaagccttgtactttgctaataaactctggtgtttgcaaatctgattaagctctaattagaattcctttatattcaatctgtttcgaattacttttctgactataaaaatgtgtatattgtaaaagattcaggtaatatagagggcaaaataaaaatcacctgtaatcccgttacccagagataaccacataataacattttgtggtttcttttagtcttttttttctgtaaactatatattcgcaaaactgagatcagtttagtgtcatttttttagtcagtatagtgtgagctcattaaatatttgaaaaacatgattttaaattgatttctaatatttcatgttatgcatgtgccattgatttattcctctttgaatcattaccctctattactgttacatgcactggttgtctttcagtggatagcagttgatattgtcaatttttaaagtcagtttgatagttaaaaaatagtatcttatactatgtattgagtcttaactatcaaaattgcctaatttttagatcatttcttgttacttttatttatgaattataaagattaaataaaattatggtatatttttcaggtaaaaattatttcaaaagttgaaataagtggtgtttgttttggtaaaattttacttctttctaaagtgttttgatgcatttattcattcagtcagcagatatttattcaattccttccagtacaaggtgttaattggttagaataaaagaagaaaagtatgctttctgccttctagaagcttacaattcagtgatggtaacatatgtaaatatgtgataatgtaacacaaagaaataaatattaaaataaagctgcaagctgggtgc

SEQ ID NO: 131601 - DNA, 1237 bp, Homo sapiens
gagaaacagctgtagttcctctgtatctcatgaaatccaattaactttcttccttttgtctcttttctgttcagtttcaacactgttcagtatcttcagtgaatttttactcaacaccagatgaatagtagtactattgtaagctaatcgtatgccaatgaggaaaaacaccttttcttttttattacttaatggataaaaggtacaaagaaattaccagtctaggtcaagttcacaaactgggcaaaatagatttgcaaaacaaatacctaaaaatggaaaacattcctaatggaggaaatggcaaagaaaaatcatcttcaagattttgcccctgtctttcttagacagcagggggcagcagcatgagatactagtacaggtggacaggtcagggtttgcttactcttcactgaactctacgtagtaggtacaactgccttggatcaaaaacaatttttagagaccctgatagaggattaatgcattaaacaaaatcacaatatagattggtggttgattaaaaattctagtatctgattttctatctaatatatattattctggtttcttactggcaagcctttattttacagaatttttgagagaagaaatacttaggactgttaactgtagaataaaccttacagtcctagaaagaagcattaattatatgatatattagtaaaagatgcttatagttgttttacaggtagcagtagggtgacctaatacacagaaagtgctgtgccacataatgaggattcagtagatgtgattaaatggttgctgacatcccttcaagacaatgacttgtcttcatagctcatcagtgagttcacagtctattgttcctttttatttggccagtgtaaaatagcagttattgcaagaacaaagggattaaagcatctgaagacctttgtttgagttctgccactttagtagtgatacatctcagagatcaacctctttaatgcctgtctttgttccctggaacagagtttgtgtttccttttgtgttacaacagaactctggtcattcctaccatagcacttttgcacactatagattgcaacccacagtattttacttaaaagattctgaaaaagtggattagaaaacaccagtgtgtatcatgcataggaagaatactgtttcatgaaattttttttcacttaaacatacagttgtatatactgggttatgataaaaatatatatatatttcttgctg

SEQ ID NO: 131602 - DNA, 1110 bp, Homo sapiens
tagaatatcacccactgtatctcacagtatcatcttgaacatcagttgagatgatgaacatgaaagtgctgatgccgggcgcagtggctcatgcctataatcccagcactttgggaggctgaggccggtggatcacctgagttgggagttcgaggctagcctgaccaacatggagaaatcccgtctgtactaaaaatacaaaaaaatcagccggatgtggtggtgcatgcctgtaatcgcagctactcgggaggctgaggcaggagaatcgcttgaacccaggaggcggaggttgtggtgagccgagatcgtgccattgcattccagcctgggcaacaagagtgaaactccgtctcaaaaaaaaaaagaaagaaagaaagtactttctgtaagcactgtgcacatgataagaattattgtctggcatagtttttgttattgttgagcaaataagcttcaggtgcttttagaatcttaactcagtattttaaaggtgacacatttattaccatactattaatagtactgtaatgtttctttttaggtgtagagttaggagacaatcttgaaaaattaggtaagaaggaaattatgatggaaaatttcaaacatatataaagtaggcccagtagaatgttctgcgtactcatccccaccttcaacattgggcaactcatagccaattttgtttcatttctacactctcacctcccctttcttatgttatcgtaaagccaacatgtatttattttcttcttcttgtttttttaacctttttggatatgtagaaatacttttaatattcttttaaaaatctaattataagtactaaaaaagataggttggtagttgagactaaaggactgttatgtgaatgagttattctctgacaggaactagcaggtaaacaggatattttatttctcaagattttcatatgatggtgaccaactgcattgcaaaagaatggtcacattccagggttgtaactagttctggaggcttagttacgcaattgccggctctgtcatcttctacagggatgtgaccttacggaaaagtaaggaatctgaagcgtggcagatcactttgaagcttgcccagtttttg

SEQ ID NO: 131603 - DNA, 2608 bp, Homo sapiens
actccagcctgagcaacagagtgagactccatctcaattaaaaaaaaaaaaaaggaaacctaaaagcttttcccaagagtttatatattcctgcatttttttcttcttgatttccattatcatatctatttgcccttgagcatatatttcttaatatgttttcttcctaactacaaaagttatatatgcttgtggcaaaaatattatataggatatttgaaagtgaaaagataactcctctgaccccaatcccagtttgtagcatatgtgtcatttttctgtgcataagcaagaatatgcatagccatgcatacacccacacctgtgtacacgagaggttatatatagatgtatatatagatacatggagttatattttatacacatatacaattctatgtcatttgtttttacttcaaagtatattggaaatctttccatgtcagtgaatacaaagaattgtgtttaaatatacctttttatttcctcaaattgtttcatgtcaaattgttttattcatacacatcttatcttcctttggaaaagaaaatggaaagtcctcaagagcaggaatggttacatactcattctcttttccattccattattctctactcttggtgcatttattgcatatttcactatttttgctgtgggaaataaaagatgcttgccttctaatccctaaggagttatgacctagtaggtaagagtccacattttacatataatgttaacgcaggaagaaattgagaggcaacacagatttctattcctggaaatatggcagttaggttatttgaacaatcttcttgctgaaaaataattgaaactgttgagtatgtataagaaaacatcctcagagcagcaaagggctgaaaagagaaggaattaaaggctaaagtctgaaggcaagtgaaaattcagaaagaagtggagaactgaaactttttgcgcttaacgtagaattcagcacaatgatttggaggtggtgaggtcagggagtttctagggtgctcagaagtttctagttatagacctggtggtagctgtacgggataattattttctaaatttaaagtatgtattttgtgcacttttctatgtacatgttataatttacaacaaaggattaaatgtaaaaggacgagttgcaaaactatatatatatatatcatatgatcccatacatgtgtatttcatgtaaatgagtatgtgtgtgtgtgttatgtaaataggggtcttaatatatacattttacataataagtatataaatttatgtgtatatataaatgtgtttatgttgggaatggaaatgtttgcatatgtgtgtttcatatacttagaaaaagacctggaggtactcactaaactactgactgaggccatctctgagagacaggaagggcatggggaaggaacgagaaaggaacttagactttttgctttataccactcaaattaaatttttaaacaattgtcatcatttaatgtgttttaaaatcagatttctaaaaagatttgactaacatctctgcccactgatagaaaagtactccctctaccatgctctataccacttggtacactatctttcttttctttctttcttttttttttttctgatcttgctcctttgctagactcttaaaaggaacaagacctgtcacgtttatttttcttgtacctactaaatactggtacatagtagagggtctataaatactagtgaaaactgaatgagtaaatgtaccttaagtagaacaaagggctgtaggcactcagtagttatacatttcctctgaggctcttgttacattttttaatattcttctgtacctggcacagcagtgaacataaagttggcacagtaaatacaggttgatttgaatttaaacaacactttgtggaactgtaggcaaatgtggagtccaccatgtggtgcccctcttgatcccaggcagcagggacatgaaattaccccctgaaaagtaaactgagaagtgaacacctaatagattaaggtcaagagaggcaacataatcttaagagacataaagactctttggggagtaaggtttttactataacctaatcgagggcattgacatcttaaacacactcacacagtctccatcagaatagcagtttttctgtctctaaaacagagaaaaagtaaagctattaatgtcactgttacggttcctaacaaagcactgtcagatcaacaacacctgccagattgaggcaagcattcagtccacctggcagatgtctaacccctgtggcactggaatcctacataattaactccacttgctgtgcttccacacacaccaagcttccctctggaaactgccttttcaaggagataattcactatcaggctgatagagtaattcagttatgccctattctgttgttcactgtgaattaataaagtcacattctttttttctcagtacatcagtgtcttgtgagttttgttagcataaatctgcattcctgagtccagtcagtgagaccgggtatcagagtctgcaaggcttatcagggtaaatactaccttgtggccatctgttggcacagactgctggattccccag

SEQ ID NO: 131604 - DNA, 1211 bp, Homo sapiens
cctaataatgtgcacattccagttagagagtactaagctatgttaccccatgacagttgacctcttctgggtgaatattatctgattgattttgcaaattccacacctgtatggatgaagagaatatatattgtagatgctagatcatgaggactcccaacacctcatttctagtcctggcttcacagcctcttctggtcctcatctcactatcagcattgatcctggcatcatattcaagtcccctcctaacccgggtctctcttgagacagtgagaactaaagaagatggaagacacaatgatttcaacaagattaaggataaggatgcaagtagagcaggcagggaacgaggttatagaaactttttattccatttccatctgtctctctttcctcacaacagtcccaatagcatttcaaagggtttcaagttccatgtaagttatagaaaaaaataaagcacaagttctctgtgacatgttcagcttatctatgaatataacggaactgaaaccatatttcaataaattattaacagcaatcccttgccaagaaggatatcagcacagataacagggcaaatccattataactcttaagcaaatcctggaattttaaaaaaattgaatagtgtatcaaataagtgcactgttagctgggacttcattaaacagcattttttttcctttctttcctgttcctccccctttcccaccagcttccagccagaataattgataactaaatctcaccatgaatttgttgggaatttacccacaatagttctcaatttattttaagatttaaaataatatatttttaaatagtagattaagactttacagaaatttcagataggataatacagaaccttgaaaagacttattttttacaaacttccttaaaaattcttaattgttctaacagtcacagttttgtttatgtatacaattggagttctgcagtaagacactgtggggttattagtacatatatcaaattcatgaggctcctattcctgtatattgttacagagctgttcttgtatattgatgtttaatgatatggggccgaattgttattcaaataattacagcccattcctgattatttagatgctgattaactagtcaatgacttattccctttgacaaaatttcccaccctctggctttcctttgatgttaatgaggaagaggatccagttt

SEQ ID NO: 131605 - DNA, 1894 bp, Homo sapiens
atttgagaagaaactcacagtatttgatataccttagtggatttgaaacaacatcttatgttacaaaaaaatagcattttaaaaattgggtggggcactgtggatcactcctgtaatcccaacacttggggaggccagggtgggcagatcacttgaggccaggatttcgagactagcctggccaacatgataaagccccatctctattaaaactacaaaaattagctgggcatggtggtgcacgcctgtagtaccagccactcgggtggttgagacatgagaattgctttaacccgggaggcagaggttgcagtgaaccaagatcatgccactgcactctagcctgggcgacagagcaagactctgtctcaaaaaaaaaaaaaaaaaaaaattcaaaccaggcactattaaatgttatgtgctgatacaaaaaattacaaatttaaaaagaaaaatcataccacttccttcaataaataattaattagaggctgaacataacatttgtaaaaatatacccagaatttgcaaaactacctggatttttcagaacttacatacattttaccaaagtgcatgagatagtatcaagattcctgctaatagaaaagtatataacctgtgctgtaaataaagataaaagagtagagtgagtcagagaaagatggtcacctgagaagtaagtaagtgtgtcgcccactctgatccctgccccttcttgctcattgctgaggccactgtcagcctttgttttctctttcctactgttgagggtcagggtctaaacagagattcactggactgaactgaaaagacaactagattatagaacagaattctcctgaagttgggcagcattagggcaagctgaagtgtgcagtttttctttttctttttttttttttgagacggagtcttgctctgtctcccaggctggagtgcagtggcagatcttggctcacttcaacctcctcctcccgggttcaagccattcttctgcctcagcctcccgagtagctgggactacaggcacaagcctccacccctggctaatttttgtgtttttagtagagatggggtttcaccatattggccaggctggtcttgaactcctgacctcgtgatcagcccgccttggcctcccaaagtgttgggattccaggcttgagccaccacgcctggcttacagctttcagaattacattactgtcttcagacactgacatactttataatgaagccaatctttcacatactggcagcacagggaccttgtataaatggctgagtaaacagaggtaacttttctccttctattctgcctttctgaattctttttctgcatcacctgttcttcaatcttcctgcagccctttaactcttcttatttttgtccctttgggcaattttaccataaggcttgatagcattaagtaaatccctgcatgtgtgtctgtgtcttgtgtgtaatggttattttttttttgttagtttgtaatgcacttagcatattcctgtctaatcaagtaaacaccaacagtaatatttcttaaatttgtagaattattggtttttgacagcctgaaaatcatcctcaaaaaaaaggtatataaacacaaaatgttaggaacaactgcatggtattcatgcacccctggtatctatttatggatcccagctgggttcagatccctttcccattttgtagtttcaaaattagcagcttccatggtcactggtggtacaggttgagtatcccttatccaaaatacctgggaccagaagtgttttggatttcagacttttttgaattttggaatattggcactattcttacgggttgaatatccctaatctgaaaatctgaagtccaaaatgctccaatgagcatttc

SEQ ID NO: 131606 - DNA, 2441 bp, Homo sapiens
ttactttgtatccaattacctaatagtcccgcatgctaaaaataatggagcatccgtcaccttaggcattagaggggaaaagcctcaaattttacagcttgctgaggcatcttttcttcaaagagcaacaggaagatcatctttgtcactgaaagactcacaacatatcccacttctgtataaatcccccaaaaagcaaaatttataaagacattctggagccacataagtaattagtcagaataaagaactcaagaaagggaagatattgtaagagttttttttttaagtagcatagaattaattgtgactagcagttgttaacagagtggtgtgccataaagctaatgataaatgattcctcaaaaaagaataatgtaacagactaatagcagggatctacaattatagaatgtttctcaacaattaggcaggaggaagacaaaagagtccaaggagagtaaaaaatggctgttttataattagcattgattaaaaaaatacaggataaagaaagttcaaagttgagcagtagcagagtaaaaataggatgaataatttcctaagttactcattctgttcattaaagagaggaggggaaaaaacttaatcaatatggctaaggggagagggaacttcttaacctatatggctaagggagggggaaagaaaccattctggaagcataaaaaaacaaaatgtagctttaaattaaaaccaaacatttattaccatgcagtgactaccctatgttgttaaaagacaaggattcgaattggcttttaaaaaaaattcagccactatatgatccaaaggtacatctttaaaaatatcataatggagaggttgaaaacacataccagacaacaaactaaaaaatttggggtgctactgttgaattagaggcaaaagtattatactgtgcaactttattattttttgctgttaaaaattcagtaaacactgtcaaagcaatcctcataaaactttcgtcctatcagaagacatttagaagtacaaggattggaagaaacacaactgctgctgcaatttggacttttttttcagagtaaatgaacattcgcacacaaaaaaagatatagaggagcgactgctcaaagcttaaactaataactacacactgtactttgtatgctacagaaagtaatttacaagatcaattaaatatttataagatttatactggccacaaagtgaattttaagggattttaaacattgaaattggccaagctctgtggctcacacctgtaatcccaacacttcaggaggccaaggcagcagatcacctgaggtcaggagttcaagaccagcccgaccaacatggtaaaaccctatctctactaaaaatacaaaaaattagcccggcgtggtggtggacacctgtaagcccagctactggggaggatgaggcaggagaatcacttgaacctgggaggcagaggttgcagtgagcagatattgcaccactgcactccagcctgggcgacagagtgagactctgtctcaataaataaataaataaaggtaagcattgaaattggacttgccacattctctcaccataatgctgacaaatacacatttacatcaaatattaactgaaataataatttgaaatttaaaaaagaaacttatctataacacaagtcaaaggctacgtcaaaactatagttaaaaatgattcacaagttaatggcaagaacatacataacttaccaaaatgtgtaggtgggaagagggtttatcaaaattagaggaaaattgttgccttattaagctcgatagcataaacataagtgagttacacagcaatgcaaggaaaaatctaaaaaaaatactaaggatagaaaaatgaaagaataatgacaatagcagcaattaatgaattagaaaagcagaaaaacaataaaatgatcaatctaagagctggattactgaaaattgaaacaaaattaagatcaaaagaaaatatgaaggccagctctgtggctcacgcatgtaatcccagcactttgggaggcccaggcagtggatcaccagaggtcaggaatcagcctggccaacatggtgaaacctcgtctctactaaaaatacaacaactaactaggtgtggtgaggcacctgtaatcccagctactcgggaggctgaggcaggagaatggcttgaacccaggaggcagaggttgcagtgagccgagattgcgccactgcactccagcctgggcaacagagcaagactccatctcaaagaaaatatgaaattaggaataaaaagaggtatataaccatagacgtgttgggaatttttaaaaaacatatttgaaaagtaatatttttaactctgtgacaattcagttttaactctgtgacaattcaatctgcaaaatgaatcttttcttttttctttttctttttttt

SEQ ID NO: 131607 - DNA, 1116 bp, Homo sapiens
aaacctgacattgacttttccaagtttccagcatatattcctgggcagaagatctcaataatagcaaaaatagcaaccacttattggatgcccgttatgtcttagacaatggaatagttattttcataattagctgacttcatctttaccaccttctgcaagctatcttcattaactccactttttaaataaagaagcaggcttttaaagcaaagttaaatcatttgctcaaggtcttacaggagctaaatgtcagagctgggatttgaacctagacctgtaatctaacatcttttttccctacagtatactgcattatactgccaccataagacctggacctcagaaggggaagcaggcttagggttagactttttaacatgctggatctaagagatttacacaatatcactttggtgataaaccattgaaatatggtctggagtctgaggaaagaatcagctgaaaatatacttacagatgtcatctggagatggttgaatccttgtaatcctagctgagattgcccaggagagtatagtcagcaaaaagaggatagcaccaattctgggaacacgaacttttaagagactagtaaagagaagctaatgtatgagactggaaagggatgacagaaagaagagaagcaaatgtgtaaaataacacacccctaccggccgggcacagtggctcacgcctataatcccagcactttgagaggccaaggggggcagatcacaaggtaaggagattgagaccaacctggctaacacggtgaaaccctgtctctactaaaaatacaaaaattagctggatgtggtggtgggtgcctgtagtcccagctactcgggaggcgagacaggagaatggcgtgaacccaggaggcggagctcgcagtgagctgagatcccgccactgcactccagcctgggcgacagagcgagactctgtctcaaaaaaaagagaaaaaccctgtttcatcagtattaagatttatattttcttgcatttgactatctcaaaaattggcatgtgtcttattatcaatgaggtcttgtaattggcagtacacaaattagtagtacataaatgggacatcttataactgaaggaata

SEQ ID NO: 131608 - DNA, 3320 bp, Homo sapiens
tctctatttcttaagattgttgtaaggattaaatgatatagtacatgtaaagtacttagcactgtgcctggcaaatggtaagctctcagtcaatgataggcattctcatgatttccgattggaaagaaattggtgcccttcccatcctaccccagggtactgccatttctctttaagtaaagctagattatatctgaaataggcaaatatggaagtttatatacacttaagggagctacctgttcccttctcttgaaggatattaaactgtggtatttgctagagaatttgaattagcaggtgtatgtagattctgagccttttttgtgctcagctcaaagccttgaccatgctgaatacataacaaagtactgattgataatgtttaacccctaggggcaggctttcttttcgccctgagcaaaaaagatgcaatctttgtggatgggtgtttggggaattcctgcaatataccttagatgcagagtttcgggtggagttttgtttttatgtttgtttgttttgttttgttttgactttccattttccactttaactgtgatccattccaggggattttgtagtttctcagatgttatactggatgaaaagtagtaactgcataaacattagtttgagaatacagataatgttataaatcttcatcttggtttgtattgtaaaggcagcatctcatgtgacttatctttatatggaattgctaaattagtattgtgcctttcctccagaaagcttaaaatgaagtcgtataggcagcctgatttaaaagataattactattccatttcctaaatgttctaccatgcaagaagaatttggaggaaaaagaaaaagtttattcctttggggaaaattaattttactttgtcttggtaaaatgctaccacatatgcagttaaatgacaattccccctccaaaaaaaattttttggcagtcatagtcatcatgacttctcctataagattatcctagtgttcaggatgcttctcaaaaggcctagaagataacaaatatttgtctaagtgtgtttctaagggctgtaactaagcatctctcttaattcagcaaactacctttttttattcagtcaaaatttaccttttaaattaggcttgtaatttgattttcattggtatcaaagaattctcttttgactccaatattacatttaataattcaaactctaatatctctattgaaacactctgtgtttcagtcgtgtttgaagatgtctaaaaacaaaagtcttttgcatttttcatattctatttaatggctggatgcatgtcagtgcataggatttgagtcattagtgtgccacaaaacattttaccaagaaatggtgcgtcatcaaatagttgaattacaatggtagctgtaaacgggacccaatttacaaaagtaaatagtgtccccttttacaagaaagaaaattaaccatgctcattcagattctgaagtttaattagctttaacttgctaaaagaaagaaattgaacaagtaaatagcatgtacttcaccatatatagcaaatcctgaatcactgccattttttatataactgacccacatgggttctttgctttttcttttatctgtttacctcagattttttttttttaataaaggactataatttgattggcttgtaaattcttcccatttctaacatgctataagactttaagcctaatttcctttgagccttaatcctcttgctaattgatgtgactgagttgtctggaatcaacctccttggtgcaaatgactgagactgtgacgttctatggaagcagtttggtccgggaatgaatcctttcattcagcaaacaaatgccatgccagctgagtcctgaaagagctcatgggcacgtaaaggaatatagttgttttacaacatgtcccccaaaattatttgacactcttctcattagcaagtgggactctgccccttccacttggatctgagctctgtaactgcctgccaatagaatatggcagaaatgacgcattgtatcagtttctgggcccagaccttaagaacctagcagcgtccacttcctgtctccttgtatgctcactcttggaacccagctaccatgctgtgatgaagcctaaagacccaagcagagaggaaccaacttgtcagctgtatgaatgagccatcttggaggtggattctccagttccaggagagctgccccagttaatgctacatgaaacagagacaagtcatcagtcatccatccccactgtgccctttccaagtttgtgagcaaaataaatgactgttgagttaagccatagagtttaggaatgatttgttgctggaacaaggaggtagacacataaacaattttgaagcaatgtagattacaatgacagtgatatttactacgtatcacaggaacactgagtcgagacacctaatccttccttcatcatcaaggaagactccctcaatgaatgagatggcaactgaactgaatctcaggttaaccaggttggagaataaagggtggcgtgttctaggcagaggggacaacagtgtgatcacaagcagagaggaaggaaacaacatggtgtgcagaaggaattatgagcacttaggtgttgctggagcttaaagctggaataggaagtactaattatgtagccagagataattggcaaaggttgaatcatgaaggcccgtgtttgccaggtgaagacatattgtgtacacacagcttgttattttcattattgttgtattgcattttggattgaagctgtctgatcaggtttgtgttttagacaaatccttctatcagcagtggggaaggtggatttcagggtatgaattctgaagcatgaagaccagtcagatggccgttgcagcagttcaggcaaggacaatgaggcctaaattaagactgcgagggtgaggatggggaagagaaactagagtcaagaaataggtggttttaaaaagaagtatttagagggtaaaaagaatactaactggccggatgtggtggctcacgcctgtaatcccagcactttgggaggctgaggcaggtggatcacaaggtcaagagatcaagaccatcctggccaacatggtgaaatccctgtctctactaaaaatacaaaaattagctgggcatggtggcgtgcacctgtagtcccagctactcaggaggctgaggcaagagaatcacttgaacctgggaggcggaggttgcagtgagctgagattgcaccactgcactccagcttggggacagagtgagactccgtctcaaaaaaaaaaaa

SEQ ID NO: 131609 - DNA, 2308 bp, Homo sapiens
ctggcatccatgtagcgatgtcagtgaggcagttggaaatacatgtcaaaaattaaaggagatttaagctgtaagaaaagatttggcagccattgtcacaaaattgctagctgaaattatgcatagacaagctcacccaggggaagaatgttcagttaaaaaagaagaggactgttgggtgcggtggctcacgcctgtaatcccagcactttgggaggccgaggcgggtggatcatgaggtcaggagatcgggaccatcctggctaacatggtgaaaccctgtctctattaaaaatacaaaaaatcagctgggcgtggtggcacatgcctgtagtcccagctactaggggaggctgaggcaggcgaattgcttgaacctgggaagtggttgcagtgagtcgagattgtgccactgcactccagcctgggcgacaaagcaagactctgtgtcaaaaaaaaaaaaaaaaaaaaaaaaaaaaaaaaaaaaagagggctgaaggtgaaactctgggagcaccctgacatgtagaagttagttaaaggagtccgggcctgtaatcgcagcgctttgggaaacctaagcgggcagatcacttgaggtcaggagttcgaggccaggctggccaacatggtgaagccccatctctactaaaaatacaaaaattagtcaggcgtggtggcacgtgcctgtaatcccagctatttgggaggctgaggcaggagaatcacttgaacccagaaggcagaggttgcagtgagctgagattgtgtcactgcactccaacctaggcgacagagcaaggctccatctcaaaaaagaaaaaaaaaaaaagacatttaaaggaaaatgtgcccacaaaagagatgggaaaagaatgatccaagaagttccaggagaaccaagaaggaggagtcatctcagaaaccaaagtcagagagttgaaaaagggggtaatctcctgtgtcaaatgtaaacagtcagtccagtaagataaggattgaggaagggtcattggtaacttttgccaagctggacaaaaccaaatttctctttttttttttttttttttttttttttctgagacggagtctcgctctgtcgcccaggctggagtgcagtggcgcgatctcagctcactgcaagctccgcctcccgggttcacgccattctcctgcctcagcctcccgagtagctgggactacaggcgctcaccaccatgcctgtcgaatttttttgtatttttagtagaaacggggtttcattgtgttagccaggatggtctcgatctcctgacttcattatccgccctcttcggcctcccaaagtcctgggattacaggcgtgagccaccgtgcccggccagacaaaaccaaatgtcaatggataagtgcatggaaagtaagaaaatagacaccaatggtacagccaaggcaatgaagagtagctagagaagaacacaggagcatgagagggtggtggtggtggttttggagagatggaaaatacgtaaatacttttatgacccaaatagctcatgccattaaagggaggagattgaagagagaagaaaaagaagatgtgattcatgtagtagcatctattcagagatagaagggcagagagtcaagggcagtcttttgggatacagtaagtgtgggtatagatgtaaatagttttataagagtagggcaggagattgaagattaaagctgatggacttaatttttttctgtgaaacaggagataagtttgttcactgagggaatgagtatagcagggattgatagctgtgttaaagacagtggtgagtcttagagtagtcttttaagaaaatggaaacaagggctagctcacaagaggcaagaaggattgataggtgacccagaggtccagttgactttggagattatggtcttatactagtaatctgcacagtttagggcttttattcaagggaatgccccacccctatcccattcacccccgctccccccaccccactttcctggctcccctgagtgagggagaatgggcaagcctccataggaaagcagcctcagcctggacaaaagcaaagttttgtttaagacaacagatggagcattctgtgtgcaactggaggatggcttgttttgttttttataatggcatgagggttctagaaagtaaaataataggaaagattagaagggactcaagaatgagaaaagccacagataagaaaacacagaggagtaagaggatgagggtaatggagagaggtgggggggttatgggagtggcaatgtgatttgcttcttatttagt

SEQ ID NO: 131610 - DNA, 1076 bp, Homo sapiens
tcactggaacccaggaggtggaggttgcagtgaattgagattgcaccgctgcactccagcctgggtgacagggtgagactctgtctcaaaataaaataaaataaaataaaataaaatataaaataaattgtataggccgggtgcgatggctcacacctgtaatcccagcactttgggaggctgaggcaggtggatcgcaaggtcaggagattgagaccatcctggctaacatggtgaaaccccgtctctactaaaaatacaaaaaattagccgggcgtggtggcaggtgcctatagtcccagctacttgggagactgaggcaggaaatggcatggacctgggaggcagagcttgcagtgagcagagatcgcgccactgcattccagcctgggagacagagtgagactccctctcaaaaaataaataaataaatagtatacaattttgtgaaagtatatgagtcaaactttcctttagtttgccattcattcattcatccatttattagtattcatccatttattgttcattcattcatgcaccaaaaattgttctagacactagggtagcaagaataaataagacagtcagagcttactatgtgccaggcactttgaaatttggagctcaatgcttttagctccacaatctggtgtcatggtgtaagcattacactggaagtctagtttttttttctaaaaactcactggtaggctgtgtggctttaggtgagacccattctgtgttagtttcctcctctctgcagtggtattgctcactctgtttacttcgtagctttgatgtcagaatcaaatgaaatggtggttttgaaagagctttggaagtcccaggtgttatataaagcaagtagtattcttgtaaatgtggcagtggttttgaccatttcagtgcctccgcgaaaaaaggttgaagatgagtatctttatattgttctcttgaactagatctatatgtttatgctggtcagtcttaccatttcctccacttcctgtgcaggcgacagggacctcataatgaggtagctgggggaatgataactatagtgaatgaaactc

SEQ ID NO: 131611 - DNA, 1057 bp, Homo sapiens
agagatggggtgtttcaccatgttggccaggctggtctcaaactcctgacctcaggtgatcagggtgggctgttcttgaagctacttcagaaccgtgtaagagctgaaagacccagagaaaattatcacagggtaggagagaaaagtaggacaattcgccagactcattttctgggagttttcttataccatcttgcagcctcattaactcttccaactctttataaaataataatactgaaaaatggccttatatcttctagtaccttgacacatgcaaatatctcatttaatcttcacaacaaccctgggaatgtggcttttgttttgtttttattgttagtactatacaaatgagaaatctcaaaccaggagcaggctgaaactagggtgagagtcctcacctcaggcacaaaacttaaggggatgccaaaaactcagtaatcaagtaatattttatgtagtatcttaaaaattaaagtttatatacagttcaacagggccaggattaaggagaggcaagtgaagtgaattatgccagctgcaaggttggatcctggctttatttaatttttttttggtagttcatgaattttttgcattaactttgttattattattatcattacttttttttttttttctttttgaaacggagtttcactcttgttgcccaggctggagtacaacggcaagatcttggctcactgcaacctccacctcccaggttcaagcgattttcctacctcagcctcccaagtagctgggattacaggcatgcaccactgtgcccggctgattttatattttttgaagagacaggagttctccgtgttggtcaggctggtctcgaactcctgacctcaggtgatccacccatgtcggcctccaaaagtgctgggattacaagcatgagccactgcacctagtcttttgcattaactttggtttttaaattattgcgttaaaatgctgctatctttattcagttttttgttttttgtaccctcttaaattttgcctctcaggcaggtggccgccttactttaccctagtc

SEQ ID NO: 131612 - DNA, 1056 bp, Homo sapiens
ttgccttacttagaacaaaatcctgtgacccgaataaagaacacatgaatatagctaaccctgtgtgagcttgcggggcaggtcaaattttttctttttttttttttttttgagatggagttttgctcttgttgcccaggctggagtgcaatgcgcgatctccgctcaccgcaacctccgcctcccaggttcaagagattctcctgcctcggcctcccgagtagttgggattacaggcatgtgccaccacgcccggctaattttgtgtttttagtagagatggggtttctccatgttggtcaggctgaggtctattttttaaaccccatcaaactgtagaatgaaatagtggttagaaaagcaactatgaattcagtggcatgtcttataaagtcagaattcctacagactttactctttagtgaagtttcttgaataatgaaaatagttcataacaagaacaaacacaattaacactgtctgtattcaccttctggtgggggaagtgcatcagactatatgaaggcataaatcacctttttctgttaggattttgttttatacaatgtattatcaatttgtcctgctatatagttggagagaatagaatgctgtctccaactgatcattttccttatagttgaccttactcctgaataaggttcaggctttcatgagaatttcagatccagtatacctgttggggatgaatagcaaaagaaagtactaggagtttgggattagaaatagaagataaaagagcaataatagacttgtgtttccttgcaattcaggcttagtaaaggaagtcggaggcaaggaaacttagaccttcaaattgtactccagtgtctgttaaagaggaagaaggagagatgttcagaatcactatgtccttgggaatatcacaggacaaaaactttatttataaataaaggtaatctgaacatttggtttgagcatcaggcacagaagcagaaaagcataacttttcttttttctttctttttttttttttttttttgagacagagtcttgctctgtctcccaggcagt

SEQ ID NO: 131613 - DNA, 1050 bp, Homo sapiens
tctcaaaaaatagtaatcggtactttatctaataggtcatgttgaattatagaagacttctgagtgagagatggcctcatcaaactcatttttcaaaaagtttaatctggtggaattaggaaggaaagagaaagcagagagagtacttatccatgcgtaaaaacaagtattttttggctgggtgtggtggctcacaactataatcccagcactttgggaagctgaggtgggaggatccctggaggccaggagtttgagaccagcctgggcagcacagtgaaaccctcatctctatttaaaaaaaaaaaaaaaaattaactgggcatgatggtgccacctgtagtttcagctactccagaggctgaggtggaaggattttttgagcctgggaggtcgaggctgcggtgaaccatgatcacaccactgcactccagcctgggcaacaaagcaagatgctgtctcaaggaagaaaaaaaaaaagtattttttgagaaggtcaacatttggttagtgaaattagaaaggaaaggaaagttgtgacgtatgtggcaaaggaaattgacattgtcactggcacttctgttggtcgtttgaaggagaaagaagttaaaaaaaagagaaaaggatcccaaggttttatcatgggctgcctagagaatgatcactccattaacaacaacaacaacaagcaaaaagaactatttggagaataaaggaaaagatggtatatttcattttaaacatttctttgaagcagtggtgtgatgagtaattaaaatattccttaggttgttggggatgcagacctggaatcagagagaaaaatcagggctaaaaatgaaatatttagaaattgcatatccaaatttaatgttaatgtttcagcagaaacaaaagagagagctgagatgcacatacacccattgcctagaaagagaaagagatgccctgggaggaatggcctgagatggaggaggtgtaagatcccatagcagtgcatgagccaagagaggaagtaattttaggaagagtggtatggccagcagtgcc

SEQ ID NO: 131614 - DNA, 1282 bp, Homo sapiens
cagttactgcttcataaatggttgctgttacttttattctcattcagagacaaagtataatactgaaaaggccagtgacttccttgttgaaagtcaggaccaggtaaattcaactgttgaggtgttacagcctattaaagacgccagtgagacattttggtattgagtcaaccagatactgataccatcccttgttcactgacaaatatgggaaggtaatttcagtaggtcagccatcagtgtgtgccttccaaaacattatagtcatgttacagtaaactttttatatttgttgcatcacaaagatttattgaagtgataaaagttattatggaaaacagtgtgcggtaactatggtaacagttatttgatctcacagtaattagctaagcatttagttgcacaatactttcacaatgccttcctggttagttcattaaacaaaattagcttttgtttgaactgccttcctacagcgtcctaaatttgattttagttcaaaggaattggaaaatgtattttaaaactacctttccaacttacagtttatggacatatttgaggttgcaactggcttttatttaattctttatttatactacactatgataacgattcactggattatcatctgaatttctcttggaaatgacctaagaaatgaacagtaaagttggagaccagtgccttaattatggccctgttcctcactcatattgcagattggggtcaacaggtgtccttcttaagactttgtttttatacctgtgagtttggggtgctgtataaatgttagagtcccaggatcacacaagtggagtcatttcttgatcatctgcatacctcctgctgggacctggagctagcaggtgcccaggctttttctaaagcctccctcctccaggtgcctcctctgccctgctcagcatagcttgtgctgtgtttagcacctctttttgcaaggtggaatgtgctgcagatgattcacctaaatgatgatgtcatcctcagaggacttcagagctcttgagacaagggcctctcagactgtttctactctgcacccactctccactcactcccagcagacagggaagcttaacccgtactgcttggcagattggagatcccaagcacaaaagaaagcttcaagcattcaagattttgaaactgaaaaatacagaaaatgaaacaaaaaaaaactttttaacttatttactaaacatgaaggggttccaaagtaaattagtgaaacaggattttttaaaatccaatcaatgtt

SEQ ID NO: 131615 - DNA, 2290 bp, Homo sapiens
ggttgcagtgagccaagatcgcgccattgcactccagcctgggcttcagagggagactcagtctcaaaaaaaaaaaaaaaaagaacctatttgttcttgagtagtcttgcaatttttcaggacaatctgaagatgataataataataataataataataataataataataaatagaataatatcctaggtggcttcagcacctgacttctttttcccccatcttccctatccctgcttttatctggtatgatagtcatgtgtcagctgatatcaaggcccctaaaactcttcacaccccccttccatatccttttcctgtccataggagaatgtctttctctcactccatttggaaaacatttgatgtcctttgatgcaactctcatttcagcttctgtgaaactttctgaatttccctcacacttcatcccgtcttctagccctctcatgtcatttgtacctaattcttagccacacatcattattcattataatttgtggttaaaaactatcttgccgagtgggctatgaactccactagagaagtgccactctttattcttccctgtaccctcccatggtatccagcaggtaagaacgtgccctgtggatagccaaccaaaccactgagttctcttcctcttactgccctctaacttcctgaattctactcatttgtatttcctcgttggctgcccagcccagccacactggataatcaccctcccaactctcccaattttgattccttttctctagacctaatgttttatgtaggggcctctagccacttcagggaaagaggaaacgaagtactatttattgagtcacctaatgtgttttcgatgccgtatgaggtgttttgctgatttccacaatcctatgaataaatactaatatccagatttttttttgtcatgagaggctaaggttcagaatgattaagtgacataatgagctagtaattgtaagagctggaattcaaacccagaacgctccgcctgcaaaacccaagtgtcttcactttttccagtccaataactctgttatgtctttagcccgacctaaattccagccttagccaatgtcttagagtagtcactggcaccctatattcctttgatctcatggccttctgtgccatcagtcagccagaggtctgccccccgcactgggtcttctgtcctgctgtagtgctcaagatgtctgccaaagaaattcagagattcttccagaagtggctttttacaaagacaggatactcaattacatttagacaaagaatgcccagtccaccactcacatagcaccccagcccctgtactgcccagggccagcattgacaatcatgagtacattctcaatatagccttccaggaagcccttagccaatcaaacagaatggaaaccatagattaaatctgtttcccactctgatttgcttccaacttgctgttgctgtgtagttttcctgcccttctttgttggtcttaccatgcattcttcccaccctaaaacccctcttccttactccagactaactggaggactgattgtattttactttgcttactgataccttttgctttgctttttctcacactaatttttctacttggcctaccttcctcctatcactgattgtagaataattaataatggaatagcctcatttgagtataaacttcataaaggcagacgcatatggttattatatctgattgtatatacagtccctcatagagtgtctgacttatggtagaacctccatgaacctttgaataaagaaggaaggagaaagggaaggaatggtggatttggcacaggtattatactatatacagatgtatttttgtttgtttcatcctaataacccaatgaagttagtgttattcctgttacagacaagcaaatggaatctcatagaggtcactctgctagtaagtggaagagcttcctgtttttcactgacctgccaaatgccatctcttctggaaagccttttattattcccccaccttgaccactgcattgcacaactgtgggggacaccattcacatagatgacagtgtgaatggctccccctggagttgtgtggttggtggccttggtaataacttgttcactggtgttctgatggcgcatgagatctttcttacagcagtgttcatactctgccttgtatcctgtactcaagtcctatttcctctactaggttatgaattccttgaaggaaggaaaagtgctttcttcatctttgtgtcctctgccagtaacacacaaaggg

SEQ ID NO: 131616 - DNA, 2277 bp, Homo sapiens
tcaaggccatgatattcattaggcactagaggcacaatgactaaataatatggtacttttcaggacctaaacaattttagagatctcaaaagaaaatggctttaaaacacaaaaaggcacaggattgaatataagtgtttgcacaaaggtaaaaccaaataatttgtcatcttcttcttcttctttttttttttttcgagatgaagtctcgctttgtcgcccaggctggagtgcagtggcgcgatctcagctcactgcaagctccgcctcccaggttcacgccattctcctgcctcagcctcccgagtagctgggactacaggcacccgccaccacacctggctaatttttggtattttgtattttttagtagcgacggggtttcactgtgttagccaggatggtctcgatctcctgaccttgtgatccacctgcctcggcctcccagagtgctgggattacaggcgtgagccactgcgcccagcctgtcatcttctttaaatgttaaatttagcagtcattactgagaaatcatagaaaactgtaaattaaatgaataaccagctaccaaataatttttttaaaaagatgcaaaaattctttcaaaaatgttttgggcagaaagttatttttaattgggtataaatacaacttttaatatgttagatatggtatcagtgggagagcctccagaaaacgaacatacttgggatccttaaaataaactgtctgggtccaaaatgctgtgcacatagcccgtgaaatatttgctggattttaattgattatagttaaatgatgatggtcttttttgttgtggaaggaaggaagcatgggtattttacattattattttgttttgttttcttttatttataaaaagaaaaaggagttaagggaattttcccagcttaggtggaatgagtgccacattcctgcggagatattgagcaatctttggggcccttgaatggcaccagtaaggcccttcagagcactctgtcctggccctgctcttaggtttgcttgccacgctgtctggttccttcagaatgtaggaagttgggggtggcacagaagccccaagggcagtatgctagtgcagaggaagcgaaggcaagccattgccaggtgctgccagcagagcagagcgtgtgctttcgtgaggcatgagggaactgacctttccacttgcccttcacactcagggtgactcaaagtgctgacctattgttttaggtactgattatacagcgaacatgttgatgatatggtagaggtgtttcctcagcaatgagtgttgaatgtttaaagtcaagtagatttttggtatgcttttgctttggtcaagagggtcttcttttttctttctttttgtcttttggatattgttttggttttcattctgtagtataaattgcagtcccagaagctgaaattcacttccacctgttcaaaaattgctgtagactttagtgcttttactaactatgcataatattgatatgcccttgctgctgaaattttatatctaagattatcttcctattatctagccaggattcaactcaaaccgagaaccaggatgggattggaattaaggcacattcagctggaggttagagccatagtcaaatgtgaaaatataaagcatattaaatattttgtgtttgtataatcattatattagatcagctataaccaccacgaggggaagttttttaaataagtggatttatgttatctgccatctccaaaagtttagagttgccagttaaatacatatatatttttcaaaggaaatcatcaaaaaggacattccactcttattacaaagctatgtcggataaatattttgatagatgtggttccgtgcacctgggagctgagacgtggctgagcctggagcagttagcacagatggagcactgagatatagcaagggttgggttttttcttatatatattgcaaatggttgattgagatagcatgaacattacattttccatgccactcagaaaagtagcttccttatgagaaatgatcttcttatttaagaatgataatgataatgaccatactaagacttttctcacaagtaaatgtataatggggtatgttacaatatgagcgttttgttaaataagagtactaattagaagcaattcagtagactggggtaagtaaggtcaagtctgcttaactttgtgtcggatataatgtaagtgtttggggctaggatatttactggtcctaagtggcaaaatgcgaaagat

SEQ ID NO: 131617 - DNA, 1041 bp, Homo sapiens
gtctagctcgtagcttgcaaactctaactcctgcaggggccagggagggaaggaaatggataaaactggtcccattgaaattggtgagctagagagcaaataccctgtgtagtgttgcatcttccagtttttctagagaaatcggatgtttggattttttaatgtcatcccttaattttttttttttctttgagagggagtctcactctgtaacccaggctggagtgcagtggcatgatcttggctcattgcaacctcccccacccaggtttaagcgattctcctgcctcaacctcccaagtagctgggattacaggcgcatgccactacacccagcaaatttttgtatttttagtagagccggggtttcaccatgttggccaggctcgtctcgaactcctgacctcaagtgatctgcccaccttggcctcccaaaatgctgagattataggtgtgagccactgcacccggcaagatcccttaatttttaaatattagctattgattgaaatttgaaatgcaacgtttagctaaacaaaacctatttgcaggctacatatggttgatgcatcgcatatttacctctgctccacttactccttcgatttaagagttagaacttgtccttttggcttggggcttttgtcttttaattttcaaacggctgtaacctggagaaaggctgtacttcagactgtgtcaatgaagagttggtaatttccactgagttcaattcaggacagttactccccgttgtctgtgtataatatactgtgcttgggcaccagtaataatgctacacagcttatcccttcaaagtatctgttgactgtgcaagagcagtgttccctgacaccagtgacctgtgttatacacaatgccatgtgtaacacagtgtacagccctactgggcagttctggactccacttgaaaatatttttaccgaaattatggatggaaactatgagaatcgttctgatgagggcatctatgctaattgtaggaaggtagtctagcataattgttgaaagagcaagtca

SEQ ID NO: 131618 - DNA, 1604 bp, Homo sapiens
tcagttacaattccagtctcacagaaaagttggttgaggcaacataggtaggtcacaagtccagtgtggtccaggcaactgtgatcaaggagacagagccacatgacacaaatatggttgccatggcacatgtctgaatgcaaagagacagttctcagacaggatgggctatcatgagttagacagacaactcctaccaccaccaaaaacccaaggaagcataaagtaaaaaggataatgtagtagcactatctcagtataaattatttatagatttattgtctttttcctccaccaaattatgtgtaccatgaggtcaggcaccataattatgtttaattctctagtacctagcagtgcccgacaataggcattcagtaaatattcagtaaatattggatgaacagaaactaaggtaagctctgccttcatgggaattatagtctggtcatgaaagcaggcagaaaacaagcaaataaaaagatgtaattgtggtaaatattaagaaagttaaaagggggagaggggtaaaggaagggttaccaaactacagcagaaactttcagaggtaggtgatggtgttaaaacccaaagtagctgtactaactttgcttattcatccgaagagactggaggtggtaatcataaaagattccgtttacattttgttccattcatcattttaacacataaaaaactagtttacattagagcatgggttgctaaaaggttgctgtaaagaactatataaaattttaataaatttaattaatgtttgctgatatcttttcatttttatcttccatttttaaattggtaaactcttagcctggagctcgatgtaattatataacagttctatgagctggtcaatgattaatcaagtgcacaataggagatatacattggccaactctgcaagcagatttggattaagattacaaatcacacaatgggaaagacatgttctccaaaggagaatcaggcaggatcagatgatacaccgggatgtgttttcagtgtgatggaaagattgtttccagtgatcttagtgatggtaaagatagaggagaagacacctaagaaatgtgtttttctggagttatattagtatttttgttgccagtatctaatagtgtttccagaactattctggaagcaagccagatctcgtaaacaataattaacagagctttttacctagctttattcattagagtaactaacaggagtttctatataaacaactccaaaaccctagtggcttattaaactgtagatttttttcctatataaagttcagtgcagataaagggggtgtttgttccataaatttattcagggacccaggctctttccatcttgtggttctgtcctcccgcactcaattcattcaagctggtccatggggaaagaatgagattgggccaggactacaccaggaagtgcacatcacttccactctcatttcattagccaggattgagtcacaagtaccacacctacctacaaggagggctggacaaaggtatagttggggactcaggaagaagagagtattagtgactgttctcagtgtctgccacactagcaatatgtagatt

SEQ ID NO: 131619 - DNA, 1033 bp, Homo sapiens
ttccaggagtgacaaggaggttcccatggaatgagtgagggaaaggaaagtaggagatgagatcagagagctaacaaggggtggatgacacagggcttcccaggccattgaaggactttggcttttacttagaggttaatatggggtgagaattgagagaagaatgataactactgctgattattgagcttatagaagatagctggcactgtgctaagtgcttgacctgtgttatacttcttaatcagatagaacaagaagattagaacaatgatataaagcaaatggcctgtcccgagaaaggaccctgagacagaggggttggggagcgtgcaggggcagtattcaaacccagatctgagtgatttcatgatgtcatactgtcatttaatgaatatagacatgtgtttgccatcacattgctgtagcaagactaatcttagcctccacttgaccactctgcaagaccactgctcaggaactggataggaagttggtgcctgtgcctccaaacaactctgggaatccgggacaaagaatctgagcacacatcatgcaccacacacacattttccccagggcacggagcagggtaacgcagtgtccatgctgcagctccacactccccgcatcttctgtttcgcaagcggagagtcctcactcttgccatatttaaagactcagtgtttctgagtgccttttaagggcagggtagaatcaaaggccaaaataccaaaggttcagtttcctgttactgaccacagtagaccagaaaatgaggcagctttcagagtagctgcctccctctgtgaacctgcagttcagctttgactcaggagagcctgtgggaactgtcagactccttagtctgcaagatgttgttctcaactgaatggacacaccctaagtcaagttgtgtattcgagaccaaactgcagtgcagaacatgaagaacagacagaattctttggaattctgattcatttgcaggaccaaataaggacctacccaatgatcatcttaactcatgctg

SEQ ID NO: 131620 - DNA, 1725 bp, Homo sapiens
ccaggtttgggagctttaaaagtagaattgaggctgggtgcggtggctcacacctgtaatcctagcactttgggaggctgaggcaggcagatcatttgaggtcaagagttcaagaccaacctggccaacatggtgaaaccccatctctactaaaaatacaaaaattagccaggcatggtagcatgggcctgtaatcccagctgcttgggagactgaggcatcaagtctcatcactgattctcatcaagcgatgagaatcgcttgaaccctggaggcagaggttacagtgagctgagatcgtgccacctcatttcagcctgggcaacagagccagactctgaaaaaaaaaaaagagagagaaagaaaggaaagagagaaagaaagaaggaaagaaaggaaggaaggaaggaaggaagaaagaaagaaaaaggaaaggaaagagggagggagggaaggaaggaaggaaagaaagaaggaaggaaagaaagaactgatagaacttggggactatttgaagtaaaagggagtgggaagatcttcagaagtgaaggatgtctttatgttttccagcttcagaggttggataaatggagatattaaattaactggtacagagaataataaaaggtactgttttacttcagactgaaactatatacctggcattaagctaaggaatttaatacattatttgatttagtcatcatgataaccctacggagtaagtagtatcattgccattttactactgtgaaaacctaaactcagaggagcccagtgtcatatagctagctagtcagtgtctccctaggatctgaacatggatttgtatgacaccaaagcctcactttacaccacagcagtaaataagccctcactctggaagaggagaaatggagtagggacaagaggctgaagagaagtcttagttctggaagcgttaaactgtcaggcagagatatcttgaaggcagctggaaaatcagacctgtagctcaggggtgcatgtggggaaataagaaaatgtgggtgttgctggcttatggtgttggagagtgaatgaggttactcatcaaggagtatatggttaaagagaaacagaccctcagtaaatgaaggctagaagggggatgccaacctagtttagaaactcgtatacctgcatactcagtttaggagtttagaaacgctcatatacctatatgcagtgtaattttttctgaccaaagtatagccttgtgctttggtgtataaatttttagtcagctgggtattgagagttccctgttagagcttgagccttgccctcacagagcttatagtctagtggagaggcttagtaaaaaatccattaaacaataacaatcagttgtagtacaggctaaatgttattttagggtgctgttacaggatgctgcataagattggccccaaagccaggcttgagagtcaatagccaggcaattaggattacaggtcatagtattgaataagtttatacttggccagacgcagtggctcatgcctgtaattttagcactttgggaggctgagatgggaggattgcttgagcccaagagctcaagaccagcctgggcaatatagtgagacctcccatctctataaaaaattaaaaaattagccaggtgtcatggcatgtgcctgtaatcccagcttctcgggaggctgaggcgagaggatggcttgagcccaggaggttgaggct

SEQ ID NO: 131621 - DNA, 1968 bp, Homo sapiens
atggtatctttctattgggaaactaatcgtttgtgtaactggcaggatgaaacatcagaaaatacttgacacattttgctagagtcctaaagggcacctaggaagactgactccaaaatgtcaaaataaggaaaatacataactcagactagagtcagacagaagggagttccattcccagcccaccacctgtcagatttggggcaagttatttaaccttttttgctcctcagttttttttaatccctgaaatggggattggaattggaacattataggattgtcatggaaattcaaagaaagaatgagtggagaatgtttgaaagagtacctaccatatgatgagtgcccaatcaattgtagctattgcaattatgtaaaagagaaatgtgtaatagctttttgtttggtgtattcaatatggttttcaaaataaagaccaatatcataaagttttgttgctgtttctcataactacatttaaattcccggttactttaagccccctttttttttgtcttctgcatacctgcaagtacctcatccattcttccgtaatgtttttctcccttagccaataccattccaatgaataaatgctcaagaccaaatgtgaacagaggtttaggctgactttaggactgagtcactgtgatctgtttcagcctcctggagctcttttttcctccatgctcatttaccgaggagtataatgtttgcatcatacctgctgttgaattaccatgtaacgattaatgagatatgtttattaacaagatatgtttatgaaatgccttatgtttgtgatcacttgtaataaaacattaataaagaatatggtttattgatgaatatattagatcgcaagggggaaaacccagtgctaatgatgatctcacttttaatatgttagataattactccaactgaaaccgaattgatttttatcagataaattgggggtcaaagttacaccgcagtaattactgctttcaaactgtgtttgtgtaacctggggaaagattttgctctggggaccatattgaggcatttgcccttgccactagcagagaacttggatctgtgcacacacaactagaagcagaagcatgtatttcctttcttttaccaaagaatagaaaccatgaagaaaaccactctcctcaatactggatgaaattagacaccaaagaattccctttcactcagttctctgcttcatttaaaacctagaatctttgtagaaatctgtaaaaaaaaatgcgtaaattgtatagtttccttttcccataaaatctccaaagaaggaaatcttatttttaccttggactttcaaaaacatagataataaaaacatttcatttgctctaacacagtttatgatgtcactagaagttcttgataaaattgtcagcgtgagtatgccactgaattaataagccatgctttattcgtggtatgttgtgcaatatgtcagcatttcccctttctttcctgtaaattgtaacttttccgatgactagcatttaaagtcttttcctgattaaggaattgtcagctgaaatcatcagggatttccccttaactattttggaagaaatctgaagaatgtaatgtgttgcttggaaattaagaaatttggaataattcatgtgaacctaaatggtgaaatagaatcaagaaatgatagttttcttaaaaataagatggccaggcacggtggctcacgcctgtaatcccagcactttgggaggccaaggcgggtagattacctgaggttgagagttcgagaccagcctgaccaacatggtctctactaaaaatacaaaattagccaggcatggtggcgcatgcctgtaatcccagctactcaggaggctgaggcaggagaatcacttgaacctgggaggtggtggttgcagtgagcagagatcaggtcattattgcactccagcctgggcaacaaga

SEQ ID NO: 131622 - DNA, 1468 bp, Homo sapiens
gtagctttctttcttgatgtaaatactgtgtagggacttgcaggctttcattcaatctcttttcattcattcattgtgcaccatgcctgagcagtgtgccagctcttggtgatagagcaattaagtaaaatgctggatgaagccctatggggagatgggcaaagcatgagaagtactagaatagcagagaagtaaacaaagcgagatgttgggtggaatgggagcaactaattccagcaagggagggtggggatcaaggaggacctcagagatgtaactagactcacactgaagggtttaaaggaaggagatataattaggcacaaagaatcacataaggcgaaacagacacagaataaccctgcagagcatgttttcttcatcatgacttttctcattgactagaatcttttttttttcttttttcttttcatgtgtgtttgtgtgttaggaacagagagaggagttacagggatagagtggtagggacaggagaagtagataggtaaggaatgtcaggccccaagtaccaaacagagtagtgtatgagcttcagtgtcagaaagacctggttgggccttaggctgttcctttacctcaaagccccagcttccacatcagcaaagtgggaaagcttccatttgggttgctctgagagtgaaatgaggtgcactgtagcacagtgaggggctgagttttgagtcagacagacctgctttcaaatcacactgacttcttgtattagctgagtcatcttgcgtgtcaaaacctcagttttctcatttatgaaatgggaataataggatctccctcatgggcatgtaaggattcaactagctaattcatgaaaagtgtttattagtacaaggctgggtgcacggtcagcaatgttagctttccctctccttttaatagaaccttgctaaaggttagttcctttcccctaaggaaatgtaagagtttgccattttaagtccttcagtaatttattcactgtaactgtacagagaaagagtatgactttttagcaattatattttccatggaggagtcttccattcaggctcaccacattgattttcctttgttggtacccttttttttccctctcttttttaaagtcagggtttcactccgtcacccaggctgttgtgcagtggtgcagtcacagctcacggcagcttcaacctcctgggctcaagcaatcctcttaccttagcctcctgagtagctgtgaccataggcacacaccaccacatccagctaatgtattttttgttttttagcagagacgagctctcactgtgttgcccgggctggtctcaaattcctgggctcaggtgatcctcccatctcagcctcccaaagtggtgggattataggtatgagccactacacctggtctaaacctcattcttatcaatgcatgatgataacagatgccatcccagggcaaacaagtgaatag

SEQ ID NO: 131623 - DNA, 1018 bp, Homo sapiens
caattaaatggtgcaatgcctataaaatagttagcgtagaagctggtgcatagtaagctttcagtaaataatagtcctcatattacaaaacaaacaggttcttaggttagttctttccttgttaagattttcattgaatatttaagctctagtcaagctaatccagatatattacaagttttcttttaaacagaatgctttgtacactgctatagcaagcttgttccatttttctttcccctatccccttcagggttccattttggttacaagaagcttgctcagggagaggttcctgcactttagcttagatttctgtcaaaacaagattacctctttagttgaccctgtgagaagccgtttagtcttatgaaccaacctttgatttcaaaattctttgagttgtcctgaatgtggtaagctaccctgcaatgtgcttggaaatcatccagtttgggacctcaagagagagggataagatgatctaatcagttttggaacttggaagagacagagttgtctgagtggaacactgagctgtgaacccagtatcatagacattgattgttgccagtgagcttcgttccaaaatgggggacccatacagaaaataaaggtgtcttggtccccactccagacctgccgaatcagaatctccaacagtagacctaagaatctagatttctttttttttttctttttatctttttttagaaacagagtctcgctctgtcgccaaggctgaaatacagtggcacgatcacggctcactgcagctttgacctcctgggcccaagtaatcctccccattcagcctcccaagtagctgggactgcaggcacatgccaccatgcctgggtaattttttattttttattttagagacagggtgtcactaagttgcccaggttggtctcgaactcctggcctcaagtgatcctcctgcctcagcctccagagtcactgagattacaggtgcaagccaccacgccttgctagatttctttctaatgtagtt

SEQ ID NO: 131624 - DNA, 1362 bp, Homo sapiens
agccgggatggtctcgatctcctgacctcgtgatccgcccgcctcggcctcccaaagtgctgggattacaggcgtgagccaccgcgcccggccttcctggtggttctgataccaccaagtttggaaccactgcgaggccatttcccagatgaagaaaataaggcccaaggagaggagtacctccaccaagatcagtggcatgctgaactcatgaatggcagaggcctgctcagagctcaggtcaccctcacagtcagtgcaggtttttttccactactccttcatgctcctgggtctgccgtggactcaggataaacagacaaagttgtctgtgtctgtactttctcatctgtactgtagagataataactcctgaccttaaagggccattgtgaggttaaattagttaaagggtgttcagttcactttgtcctttactcagagtctgttctttagacaactgaaagggtgctaaattaagccattttgcagagaggtctgagtcatctagtggcagctgtctgtgcctcactggaggtgctttgatcattgtcatctaaatgcatgcgttaagtactatctgtagcacagcgctccaggctgtgctaagtgagttacccagataatggtctctgcccttgagaacagcgctgaggcaagggacataaaggttattcacacagcaacagaacaggggatccatgaacgttgaattcagagagcctagaaggagcatggggacacccattctgcgcccctggcttagaggaccgaagtgctgcagctcaggtcacatggcacgttgagagcgggatgtgtgacccaccaaggctgagtccttcccacctccccctgctggaggggaattgtttttctcacgggttggaatgtagcaagtgtccattatagtcaatctggaaaggctttagtttggagttagtttcaaggatgtcttgaaatgaggcggttagagctcagaggatgactttggggatggtgggcagactatgtgtacgaaggattgggccaaaaaagattatgaagtatcttttcttttttttttttttttttttttttttttgagacacagtctcgctctgtcacccaggctggagtgcagtgacctcccaggctcaagcaatcctcccacctcaacctcctgatagctgggactacaggatgtacaccaccacacccggctaatcttttatttttttgtagaggcggagtctcactatgttgcccacgctcatctcaaactcctggcctcaagcagtcctcccacctcagcctcccaaattgctgggattacaggcgtgagccgcagtacctgaccagattgcgaagtatcttgaagcaatc

SEQ ID NO: 131625 - DNA, 1122 bp, Homo sapiens
ctaggcattgctcaaccaaaggggaaagttcaaagtgaataggtaggttggtgtgtcatctaaagagacgatatagtgtcatcaagtgagatagagcctcagaaaacatcacttttggatctgtgtatatatgacattgtactaagacactgtagcatggaagtgaatagataagaattaggaaaatcacaagctaggagaggacagatgttatcacacagcaccttgtaataaagggagaagagtagggaaagttaagcctgacaggaccccactcctggtagaaaggaaccattgatatggctttgaagataggaaggacagagcattgaggcagaatgtaaaagcaaacacctctagtatcatggaatccagggaagaaggaaaggaaaggaagagaagacctgtgagcattttattatgtgctgggcatattaaataatcaattactcaattaaattcaattcaatactcagttaaatactcagtccttacagtagtcctgccagttaagtcttctcccattttacagatggggaaactaaggctctgagaggtggtcattttcccgagatcaaatagctaggggaggcaggattgtcccaggtctgactctgaatcccttgcttctgccacactgcttcagccagaagttggagaaggggaaggaggattggttatatgcagagtcagaagctatgagaggatgatgaggatcagagtggatttggagaagtgatgaggatatgggtggctttgttgggtgatactgctgcagagtagaaatgggagaagttggctacaaggaaattcacatggttgggttcacagtttcatctgccatgtgtggcattttactacctggtatatggaagattaaatattagctgcatttaattctctctttggagaactgcgagttcctttttgaacaaattctttgcaagcacttctagtctacatagttgggcttccaggttgatgcatcttcagattatagttccaagaaaaatactgactccagtgggtggtttttcacatttttaaactgatcagtcctattggcaacataggcattcatccattcactcccatctgggaactatgggaatcttctcctcc

SEQ ID NO: 131626 - DNA, 1084 bp, Homo sapiens
tttgtgaaattatgggtttgcatgaattgcaactaatggtagaggtctttgaaaaaataattataatttgagaaaatggggttagcctatattaggtttctgtagtcttgaggtacggaaagaatgggcaaacatttgccctttaaagtaggtaagagtccatagcacagtaagaagtctgtttcctctcactgggaaaacatattccagccactgatttaacttctcttattgttgctgacttgcaaccctacaccccctctaagtctatgacaggtctgaacataattcttctttgtagtccattgactcttataaaataatgctgtgattataaggtttcctgaatacaattttcagaatgttagtaataaccacattgcacctacctgccatacttgggcaattatctctgttgctcaatttacttaatattggtcatagtgaaacatgttttcatcacttgaaatcctaattttatttgccagattactaatggccacctatttctgtaacataaggtagaatgttatgcaagtttgacttgcaaatactgtatgttgactctagaaaacaacaggtttggccgggcgtggtggctcaagcctgtaatcccagcatgttgggaagccgaggctggcggatcacctgaggtcgggagtttgagaccagcctgaccaacatggagaaaccccgtctctactaaaaatacaaaaattagccgggcgtggtggcacatggctgtaatcccaactactcaggaggctgaggcaggagaattgcttgaacctgggaggtggaggttgcggtgagccaagatcgcaccattgcctgggcaagagcgaaactctatctcaaaaaaaaaaaaaaaaaaaaagaaagaaagaaaacaacaggtttgcctggagatggcagcataaggagtcatttttctgcttctttttaagatagtctgattcctctcaggataaaatgttgataatgattgaaaggataaagcatttaaagctggaatggatttttgatactagagagaccaccctccttctaattctcatcccttttcaggctggagaggaaacaa

SEQ ID NO: 131627 - DNA, 1044 bp, Homo sapiens
gggagactcctggggacccctgagtgagaagttttcctagaggaaggcagtggccttgataaaatgccctcctggactgcttctcagcactctatttctgtgtggcacagcctaggctcatagacatcacattctctgtggttctacttgtgctcactcgtaattgtcacctgccctggaatatgtgagctttcagtgagaaagaacatctgtccctcttgacacctttgggtgtgggtaaggaaaagagtaaatgttccatgctaagcatattgtcaagcactgtgaatgtcatgaaggaggaagtttgaaaagtgtgatttcttcatgtttacaaaatgaacaaatgactcagatctgttgtacacattcacaagagctgtgtcctaagctgatcctgattttgaagtcatgtgtcttcctttgcatgtggggaggattttaaagggatggaaagtggacaaggagggggtgggtgagaggaaggaaggcttagaggcaaggactttgttctacgatgctgactcagtgatgccttcccttgggctctgcagaaataaagattttcctcatcttttagctccttccttccctcctccctccctccctctttccctccctctctcttactttcattttatttcttccttccagtcagcaggtttttgtggggtatgttttctgttaggctaacttcagacaagaccctgaaaactaagtacagatgtcatcacagatgagtgttccttactcttggaagttcaggtagccctgcctcgattggctctgaccactttgtcaggccgtggagctgagctacattttggggatttcacccacattgttgttgacaggattgttaggcttcactagatttgcaccctcgggctttgatctttttaatatcttccggattgaatacccttttgggattgttctcctgactttttttttaaacgagtatattgtgccactagaaagaagaatgtttaaatggatcaaaaataaatcttgatactctctatcaaatgcatgtaaaaagga

SEQ ID NO: 131628 - DNA, 1035 bp, Homo sapiens
aactaaaaagtttgagaagccctgcactacctaattgtaatgactgtttattgattattgctttgtaccatgagctgtgcaaagcataccacattcttcatctcttttaatctttgccacaaggctgtaaagcagaggctttaaaaaagggcaccttgctagcccagcgtctcaccactggacaagaaagagatcaccaggtcggttctctgactctgaagccacacccttggtcactttctctataactttaaaaaagattctttttaactgctctgagcctcagtttccttatcaaaaatagtcagaatgaggtaccccgtagtgttctctgaaaagcagaagagtttctatgcatccagtccttacatgggggccaacagcaaatgctcccccagaaactcttcacctcccttccttccattccttccttttctttgacgttagaccagagaggcttatcaactctccattttcctctaggtggtcttcaagctgacagagaagctgacggaacagaaggagtggatgaagatataattgtgacccaaagtcagaccaacttcacctgccccattacaaaggtaccgcttcctcctacttcccctgaaagaaacacgattcacttcacagaggcagaaaggttcctgtttgctttctggtttgatttcacttagggagttaaggagggagtaaagaaaagtgctgggggttgaagagtatccacgggaggttcttgggctggagagagctgtcagtcaatcatgccctgaaggatccgggactaaagtcatggcctacaggccaagtgacagtactgccactggattccctgcatttccttatctaaagcctagtaattatgtaaagccatgagaatgggaagttaaacatagaaagctcaggactaggacgaaacagctactggaagttgatcattatcattcctgaaagcccaacatctccttgattacaggaggaaatgaagaagccagtgaaaaataaagtgtgtggccacacctatgaagaggacgc

SEQ ID NO: 131629 - DNA, 1092 bp, Homo sapiens
cggttggagtttttctggggaccccttcccacctagctgtttcaattctaattcatgccccatgtgagggtcctgtacctgatgcacctcgcatataaggaaaaacccaaatgaattaatgtttggttcataaagccaagcagaaaaacatatatacacactataattttagctatttaaaacagcatattcttaagcaaaaagctcaaaaaagaccatagttgtattttgtacaaaaatgtagagagttgtacatctttttctttcttttctttttaatattctgtctctatacccaagggcccattacatgatacaatcttgattatcacaaaccaacacacaaaaaaacctctcattccactttaccctaccaatctagatgtcatatgtgttggaagcttgggaatgggctaacgttgtatcagagagaggtctctaaccatctgctcagctagagcgaggctcagttgatatttttggcatgaatattggattctccaagaaagcagcatttcccaaactccaaatattcaaactccgctatcaaagtttcaccatatccacctgtggcctgtattattatttgctgaattttttggagttcagccttctcctaaataatagaatgcatacaatcatgagtttgatgtgctaagtatccttaaatacattgaaatcgatatggaacattaaacgaaaagaaactcgtgttttcttgttttgtttgttttgagataaagttgttttgaaacaactccgttgcccaggctggagtgcagtggcgccatcttagctctctgcaaccttccatctcagtcgcccgagtggctgggactacagatgcgcaccaccatgccagctaatttttgtatattttgtacagatggggtttctttcaccgtgttacccaggctggtcttgaactcgtgagctcaagagatctgcgtgccttggcctctcaaagtgctgggattacaggcatgagccactgcgcctggtcgaaactggtgttcttaaagccctaacagcatcccgggtgaccctttgggaggctgctgctggagcggggcggggggccctggccggtgc

SEQ ID NO: 131630 - DNA, 1054 bp, Homo sapiens
gggagggcgcgcgcgccgcctcctgcccagcccctcccagccctgggggcgtgtgcgcgcgtccaggccggcccgggacgcaccacctgcgcccgagcgcgcgctgcccggagcatccccagccctaagtccacccccattccccccacctcctactccctctccccttcccccagtctcctccctccgctccggagactgctcgctgggcggcggggccggagtcgtcgcagccacctcattgcacaacccggcttcccaactgtttacacagcccggcctgtgagtgtgtgtgtatacagcgtgagtcaccaggaggcggaggaggtggaggaaaaggagaaggaggagtgcactggccgggatcggtgcagcgctcacactcactcacagtcactctctctgagcgcgtctcgctcgctctcatacacgcccggagcccaggagcgctcaggatcccgagcgccgcgaaaaagttcccccggcttttgctggagactcatcgctttgggaagtgcatttgcttcgtggctccgccgagcctgctgaatcctgtcctcgcggctcgggaccccgggatcgctgaccgctgccgccgccgcctctgcctcccggactatcggcagcctcggcaacaatagtggcggccgcccccagcgaggctccgggagcccttgcctgcgggggtccggggactcgagccggcctccgcctcccggacgcacagccagcgtggtccccgcgtgcaacgcgagcgccggggagtggctcctgctttgcccctcgtgggggccgagccaagaccagtctgcaaactccatcccgccggctggaagaagtcgcggagccggcaccaaacccgcagcgtcttcccgcgcggatcccgggacttaaaaagccggggccaccccggcccaggacgggatgcgggtcggtccggtgcgctctgccatgagcggcgcctcgcagccccgcggcccggccctgctcttcccagccacccgaggcgtcccggccaaacgcctgctggacgccgacgacgcggcggctgtgg

SEQ ID NO: 131631 - DNA, 1050 bp, Homo sapiens
cattcctggagcctttgctgttagtgcctgtgggcgctgttattgggaaggctttgtttttcatagcagctggtgtggaaataatggcttggttcctctctcttgcagaacccagcttagactagaaagtctagaagacacacacataatgaagggggaagatgatgctttgtcagacaaacatggctgcccagcctacgtgagccctgagatcctcaacaccactgggacctactccggaaaggctgcggacgtttggagcctgggggtgatgctctacacccttctggttggacgataccccttccatgactcagaccccagtgcccttttctccaaaattcggcgtggacagttctgcattcctgagcacatttcccccaaagccaggtgcctcattcgcagcctcttgagacgggagccctccgagagactcactgcccccgagatcctactgcacccctggtttgagtccgtcttggaacccgggtacatcgactcagaaataggaacttcagaccagattgttccagagtaccaggaggacagtgacattagttccttcttctgctaatccccaaaacctcagaaacctcataattcttaacacctggcatttccatttctaaagatggacaggccctttggcgtggtaccaaccagataatgactgcatcaggatgaaagctgctgaactcggcatggcgcctcctcttctctgttgggatgagtgactttattgatttgagcagcatatgctgtgattggctgccctgcaaatttgtttcccttaaggaaccctcaccaactatctctgctggatttgggagttccgcatcttttgtggagggcagagtatggacatcttacacccggtggtcaagtgtgtaataaacttgagcattcgaatgggagaaaaagcaaatcgcacaatgacatattttgagtaataaccgtatttttcacagggtgacaaattgggccaataaatctgccatctttgaactcatctttggtggctagactgctacggcagcttctctgatggga

SEQ ID NO: 131632 - DNA, 1045 bp, Homo sapiens
ctcagggtggagcattctgtctaagagaagaaagataaggaggctcccacccacctctcccaagagcagacattaaacatctttgtgctttgaagagagtgaattttggatagtcttgtgattctcagactaacttccagaattatactttaacccctcccagatatggtccgcctttggcattgtgtgtacatctgcagttttgcatggtgggttgttaatatttcaaatgtgtggtttatgaatacgtctgtataatcggcttctggagtgaaacagcaaaccccaaatcttcaaagttggaaggaactttaaaaatcatccggtccaatctctttcctctttctgccacctcccaaggcagaaatcccctcttcagcttcttttgtaggtgggaatccagcctctgttagatatgtccagagatggaaactcactcccctacaaaagatggagcttaatggagaaattgcaactttcattaaaaaacaaattcagatgaaatatcagtaactgtcttggacagtgctgaaatcaggtggttaaacgggtaaacaaaatatactgtattttgagaaatggcacaaaaacaggcagtcatctttaagggctatgcctaggcaaactactaacatgcattgtgagaatgccgtgtatacctcacgtactgtgtactttgtacatatattttaccttttatacctatgttcgattttgttttgttttgttttgttctggctttgaggcttgttttgttgtctgtgtctgtctgaataacctgcgtgtctaaaaccacgtgaaatgtgaatgattattggcaatattaccttgacagaatcatgggactttgagaagagggaggacagaggcctctgtcgcactaacgctctcgtggttgctcgactgttgtatctgtgatacattatccgactaaggactctgggctggcagggccttctgccgggaaagctagaaacactaggttcttcctgtacatacgtgtatatatgtgaacagtgagatggccgtttctgacttgtagaga

SEQ ID NO: 131633 - DNA, 1449 bp, Homo sapiens
taaaaatcctgagacattagatgccacaaatacctagcacttcattagaatttactaaaaatatatcaaagttatcaagtaaatagagtcagtacatctgaagtagattctaaacattagagtattaataaaaatgcatagataagtgaagtgaatcctcaacgtaaaactaccagcctagcatatactggttccagataaaagaagtaaagttgcaaccaagttaaagtttgaaaatataattaattatgactgataacactatactgcttttatctaacaacaagcaaagcgaccccaggactctgataaatagaaatacatcatggacagtgaaaacattaacaattctggcgtttgtgttgtcatctcttatagcacctcctgtttccctggcaatcctcagaacccagacaggagcgtggccccatcagtgcatgctgaagggcgaagggctggtaccgagaattatccatttcaagcagaaggaaaatggaccagttgtggtgttgggacacattacaggattgcctgaaggccagcagatgccatgttcatcagtgtgcaaataatatacaaggctgtaccagtgcaggtcctcactttaatcctctatccccaaaacacggtggaccaaaggatcaagagaggcatgttaaacacctgggcaatgtgactgctggcaaagatgatgcaatgatgtgtctattgaagattctatgatctcactctcaggaggccactccatcattggccatgcaatggtggtccatgaaaaaccagatgacttgggcaaagatggaaatgaagaaagtacaaagatgggaaatgctggaagttatttggcttgtggtgtatttgggaattcccagtaaacattccctaggatgaggtctgagtgccagtaacacatgtgttatcctgctagctgtagaaatgtaacttgataaacatttaacactgtaatcttaaaagtgtaaagaaaaaaaaaacacacacacattcacaattctccagaaacttcttatgtagaatacagttttaaacatgtttatgttaatgacattttacccacacaaatttaatctatgcaaacctgagcatctcttccgattggacaatgcttcctagacatcttgtcaatgataacatatcaaacaatcctaactgtttccaattcttgtcttttcccacggtgaaagaacacatctttgcaactttccagaggtcctctgggaaatctcaaaggcaattttgggcactgaggaggctgagaagactgtgcttgactgttagctgaaacaacttttggctgtttggcagaggactaacaggccctctgctttatgtgaatttctcactttaacttgtttgctccattttgggtgcagacccagccccatgtgcctgaccacaaaccaacatttcctgtctcaattctcctattca

SEQ ID NO: 131634 - DNA, 1037 bp, Homo sapiens
tttattgtgggcatcctcttacaaaatctccctatcagtcctatggttgacatttcccaaataagaatacaaaggcccagggaggtcaatatgaatcttgcccactgcaaggggagaggctggattcgaatccaaacctggctgcttccaggtctgtttttcacactgtccagcagcctcagggaacaccagcatatatgtttgtttgctcagccagaaactgacaggtctgagtgaccaacatacttagttggccgaagactttcctggttttagcactgaaaggcccaccacattctaggcaaactaggacagctggccaccctgctcgggtgcctccctgtcttggtcattgctctccctaagccaagggctgtcatgagggtgaagctggggatattgctaggatagagcaggaaagggggagaagagcaaagagaaattgatgttttagtccagtccccactcttacaacgagcccccattgccaggcgaggttatacatacagcagcagctgcatagacagggccatccaataaaagggacagtacatattatagcctgcttttggcattcatttttattttaaaatcagactcttcacaataggtgaggcctgggcctgtctcacctttgagagctgctggcctgtaactgctttccttagccctcccagcctgcctgcctttgactgtaagtcctgcataaagagtttcacattttggctgaattattacttgaccttcagatgaaggaaggaagcccggaggctgtggaatgacatccttttccttggcttctgcattttatttgcttagatcaacagagcagattctgaagctgtctgggcaagagctagtttaccctgtgggtaggggtgaaaagcaggtactctgagaaggggtctgaggctgcagcccaccccaaaccagctctccatgtattaatcctgcagctaaattgtctgtgaggaagcttttaatcttttcctggaagaaggtacatgggtggggagacattgaagccagtccctgct

SEQ ID NO: 131635 - DNA, 1046 bp, Homo sapiens
cttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagt

SEQ ID NO: 131636 - DNA, 1093 bp, Homo sapiens
tctattaaaatacaaaaaattagcagggcatggtggcgcacgcctgtagtcccagctacatgggaggctgaggcaggggaatcgcttaaacccaggaggtggaggttgcagtgagccgagattgagctgctgcattcaagcccggtaacacagcaagactccatttaaaaacaaacaaacaaacaaacaaacaaacaaacaaaacaaaacaaaagcagatataccaaaatgtttattttggatggtaggaatattaaaatattattttttctttgtatttttactgaaaaaatgttttaattctaaaaaagaaattaataaaaaggaaaatgtgaatctaagattagtgcatgagagctggagacccagagagggcaaacagcatcaaggtcaaagttgagtgagtcctgggtgaaagtgtcttttcagccaggggagattttccatgcagaagggactgggcatcaactgtcaggacatggacagagacgtctgccattagaagctggtcctctcatagcccaccagcatcccccaggaggacactggcttcctcaaggtcacagcctttggtttctggaaaaaatgattaagcagtgaaaggattaaggtctcacagctcctatcgcatgatgtatagatgcagaggtttctcatcatcttctttttatattttaaaagatggatgacaactagatgccaactgcagctcaggcacctgcccagtccctctcagagccgggcacaaaacagacacctgtctagcccctcacagagagccaggcacaaaacagacacctgtccagcccctcacagagagccaggcacaaagcggagacttgtccagctcctggcaaggagccaggcacaaaagagatgcccatgagtgtaaatgaatctgtgaaacaggcagaacaggagcatcaactgagtaattgttttttctttttcaaataagaacatttgcgttgagaagccgccacgggaagagatgtgatgaaacactacacagaaagagggaggagcctccgggtaggttggagtgagtaggatgtagggtagccggcaggggagaagaggggcaaccttctgt

SEQ ID NO: 131637 - DNA, 1790 bp, Homo sapiens
catcatggtcattcttcttggctgggctgttgatttaattaggtttgccttctcttgctaacgtgctcttatttatgccagtgtttgtggttctgggtgtagactttcaggaagcacagccatgaagctgcatgcgtctgtgtgtggatgcctcatgccttttcctggtggtttgcaggcatggaagattcttctgttcatctaagctcctgactttaggcccttctagaacattagagaggagaagaaatcacgtgcaaggatttagggacaagaggatgaggttttggtgtttcctttctggtattaggttttccagagagaggctgttagcctgtctctcgcccactccaccactgtgaatcctggctactggggctagttccttgctaggaaaaaaaaactctagagaaatgtgtttgtgtgtggtgggtgggcgggggccctgaggatgcagggactgtgtctgctgtgttgtctgttataagatgtttcagacctattttgcatactggcagcgacaagttgagacttgttcaacttgacacagtcctgtggtcatagcgaatctttctaaagctctgatcagtcaagaagggggttgtatcaatcctcagaaccctgagtggaactttctacaggatttattaggagaaaaaccttcccggaagctgcagaaggacaaatacagaatccgtgtctgggagaaacctcgtggcctggtctccattatttgagatgagttacatcttggaggtgaggacgtgcctcgtggtctaaagcttcggcacaagggcccaactggaattccacttacgggtatgactgtggggtatatgctgtacccattgaattcccagagggatttgttaagtggttgtgttgctgttttgcctggttaagagtggcttattcttgttgcctcatctatcttgagtgcagaatttttgcataaacggcttctcttgaaaaatagaagtccgtttttgttttgttttgttttttttctgattaactttccttttcctctgtcttaaacaccttcccccgcccctcgccacctccatgctgtgtttctgtggctggagcttttctgcactggaaaggaggagttctcccctctgttctgacatatctgatccccactagtttatatgattgctggtctgaaaacctggtgaattctcactgcccacatcaaatcaattccctgttctttagttgttttttttttccgcctcctgagcggtaggcaggcactctggctggattctggagcctgtgtttgccatgcctgggccttctgcctgcccaagatggacacgtttctctggcagctttgtcaagagatctcctggactataagacaccctgttctttcctcctgtttgtgtgagtggccctgcatttgggcagagtattggcagaatatctgggggaagtggaagactttggatagttgccggtccaggtcgtctggagaggcagtggcaggcctgctgatggctgcccctttgctatttgttttatatcaggtggcccttctggatgtgtggcctttttattttgcatttcctttcatagttggctgcagacataagattcttctttttctcttgttttgcttttttttttttttttttgagacagagtttcactcttgttgcccaggctggagtaaaatggctggatttcagctcactgcaacttccgcctcccaggttcaagcgattctcctgcctcagcctcccaagtagctaggattacaggcatgcatcaccacacccagc

SEQ ID NO: 131638 - DNA, 1033 bp, Homo sapiens
ttggtcaggctggtcttgaactcccagcctcaggtgatccgcccgccttggcctcccaaaatgctgggaggcctcccaagttgctgggattacaggcatggaccaccatgcctggctaattttgtatttttagtagagacggagtttctccagattggtcaagctggtctcgaacatctgacctcaggtgatctgccctcctcggcctcccaaagtactgggattacaggtgccacagtacccggccttgttttgctttttattgtttcctgatgcaggtttgtgatctctttgagggatcaggaccacaccccccaccccaatttatattcccagtgtccatggtgggaccctgactgaggatgggaacagagcaacaatctggaatcatttggaccattgagtcctgtggacagtcacttcaatatcatccctagagagtctcagaaattcaaggccttttggaatgctgccaaaatgggtcctttggcaggagccccctttgtctcttctgttttctgacctcaaataatctaaggaactaataacggtaataaataacaattaataataagaacaataatagtgcatgtataacatggacattgtttatcacgcaaagcatgttcttcaccttctactccctacaactccatgaggcatttataatgaaatgtctagcaatggtagacttcttgttgtggggcagggttggttctaacacttcaaattatatgatctcatttaactttcctataaaataggatgattattgttgtggttttgcagatgaggaacccacagcccagagaggttaaaaatatcctcccaggtcacacagcttgggagaggcagagctgtagagatttggaccacagtcttcgacttcttagtgtgactctcagaagttagaggataatgaggttaagaacaagcaaagggccgggcgcggtggctcacacctgtaatcccagcactttgggaggctgaggcaggtggatcacctgaggtcaggagttcgagaccagcctgg

SEQ ID NO: 131639 - DNA, 1753 bp, Homo sapiens
aacagtaaagtgcttagcagaggctcccacacatagtagttactatgtagtggtagttgctatgtttattattattatattattctcctccctcataaaatggcagcctccctttcttccattccccttcctgagttattttttctcgatagggcttatcttcctagtataccatatgtctctcttctcccactaaattgtaacccattcatttttccaggatatatttgttgggtgtctactctgtgcctggcattgctgtagatgttggggatgcagaaaggaagaaaaaggacagatttccatgctagagcttaggttacagctgggttagacagataaggaacagcagacataataaagaaggacatgaattgtgtattcaagattatgaagtgctgtgggaacaggcctagcagggtcagtgtctggagggctggggcgtggtgctgtgtggttaagttgtccggtcagagtcagggcaggctccatggaggagctgacgttaacctccacctgaagtaggggaaggacaggcgtttcaggctctgggaagagctaggacagaggtggaggcagaagtgagcctgtgggggtgaggagcagccaggagaagcgtgagatgagaatggcgtgagcaagggaggtaggagaacccgagcagcatgcagtgtgcagcctcacagagagcctgcagggcattccaaagattctgtcttttactctgtaaaatggggagcccttgcggtgttttttgtttttgttttttgtttgttatgaggcagagtcttgctctgttgcccaggctggagtgcagtggggagatcttggttcactgcaacctctgcctcctgggtttaagcaatccttacacctcagcctcctgagtagctgggattacaggtgcgtgccaccacgcctggctaatgtttttatttttgtagagatggggtttcaccatgttggccaggcaggtctcaaactcctgaactcaagtgatccacccacctcagcctcccaaagtgttgggattacaggtgtgaaccactgtgactggcttccttgcagtgttctaaaaaggaaagtaatttgatctgacttggcttttgaaacggtcagtctggctgctgtgttgagaagaaactaaatcagggtcaggagctagagcaccaggacaaacatgcacagagcgttaagtgccaggtccaggctggcagtggtggatggggccacaggaatggacttctaggctgttcactgttgtatccccagcatcttaaactgtgctctccatatggtagctgtgagccctatgtgggtattgagcacttgaaaggaaattgatatgtactgtgtgttaaacacacattggatttcagagacttagtgagaagagtaagatatctcattatttatttatttatttatttatttatttatttatttatttactgagacagagtctcacctgttgcccagcctggagtgcagtggcatgatctcggctcattgcaacttccgcctcccgggttcaagcgattctcctgcctcagcctcccaagtagctgggattacaggtgcccaccaccacacctggctaattttgtatttttagtagatatggggtttcactatgttggccaggctggtcttgaacttctgacctcaggtgatccatcccactcagctttccaaagtgctggaattacaggtgtgagccactgcaccaggcctatttgtttatttatatgag

SEQ ID NO: 131640 - DNA, 1036 bp, Homo sapiens
ccttcctcagcctcctatagttctagggttacaggcgtgagccactgcaccctgccaagttatctcatgaaccaattctttgatgttaattacatattgaactgataatgttttggatatattgggttaaattattaaaattaatttcatctgttttttctaactttatggctactagaaaatctaaaattacatgtgggttgaatcatattttcgctggatggaacaatgccttggacgaggtcagcatttagtgaatcaaatgtgtgggtgaggcacaggtgttctgccgtgaatgagaaaccgttgccatcttcgggaagtttccagtgtgggagggaggcacactgcagatgtaactgctaggagagaaagaaggcaggttgaaatgggaccacagccaaccaggcctgctgtagcccagaagctggaagagactcgcccaggagggaaggaagacactggggtgttgggtctcagtctgggtcttggtgacagcagtgggctggcagtgcagaggttcaaggccttggactgcaagtccactaaggtggctggtggtgtgggtggaggtggaaaaggcaggtggggcgagggtgaggggcaggacatcctggagagcctgaataaccaggtataagtgatttctttttctttctttctttctttttttttttttttttttttaagacggagtctccttctgtcgcccaggctggagtgcagtggcgagatctcggctcactgcaagctccgcctcccgggttcacgccattctcctgcctcagcctcccgagtagctgggactacaggcacccgcccaccacgcccggctaagtttttgtatttttagtagagacgaggtttcaccatgttagccaggatggtttcgatctcctgacctcgtgatccgcccgccttggcctcccaaagtgctgggattacaggcgtgagccgccgcgcccagccccaggcggaaattatttcaactgggtcctgagaactgggcacttttcaaggattgtcagcaaggagc

SEQ ID NO: 131641 - DNA, 1043 bp, Homo sapiens
tggtctttaactcccggcttcaagtgaccctcccactttggcctcccaaagtgttgagattacaggtgtgagccactgtgcccaggctgtggttttttattttttaattttttatttttttgtattataatcatagtgtatatgttgcatcctgattttttttttttttttttttgagacagcatctcattctgttatccaggctggagtgcagtggcacaatctcagctcactgcaacctctacctcccaggttcaagcgattcttctgccttggcctccgagtagctgggatgccaccgtgcccggctaaattttttttctttctttctttttctttttttttttgtatttttagttcagacagggtttcaccatgttggccaggctggtcttgaactcctgacctcaagtgatcccacctcggcttcccaaagtgctgggattacagcgtgagccaccacatctggacacatcctgatttttttcttagttgctattaggacacaggcatttttgaatattatatgcactttgtccatgtcttttttttttttttttttttgagacggagtttcactcttgttgcccaggctggagggcaatggcgcgatctcggctcactgcaacctctgcctcccgggttcaagtgattctcctgcctcagcctcctgggtagctggcattacaggcgctcaccaccacgcccggctaattttgtgtttttagtagagacggggtttctccacgttggtcaggctggtctcgaactcctgacctcaggtgatccacccgccttggcctcccaaagtgctgggattacaggagtgagccactgtgcccagccgtccatgtcatttttattgggtagatatttctgttcagtgactgtttcgttgcttactttatcattcctttgatttggatgcttagcttcataacagcctgtttatatagattatgttttctatttttcagttaattaaaaaaaaaacaaattctcagtcctaggattattgtgcataatgtctgaattttttagaa

SEQ ID NO: 131642 - DNA, 1208 bp, Homo sapiens
ttcccaaaagtcaacaacaaaaagacaaacagccttatagcaaagtgggtgaaagataggaccatgcagtgctcatagaaagcaaagtagatggctgggcaccgtggctcatgcctataatcccagcactttggaaggctgaggcgggcggatcacaaggtcaggcgttcgagaccatcctggccaacatggtaaaacctcatttctactaaaaatacaaaaattagctgggtgtggtggcgtgtgcctgtagtcccagctacttgggaggctgaggcaggagaatcgcttgaacctgggaggcataggttgcagtgaacccagatcttgccactgcatgccagcctggacacagagaacgactccgtctaaaaaattaaaaaaaaaagcaaagtggatgataaatgtgaaaagattctgaattttgctaacaaagtcaggttttggagatctaatttctagtcagtaaaattcatcctttctaggatacaatgctaagagttttgataaatgcatagaactgtgttacactgttgtgtaattaccacaatcatggcttagaacatttccatcgttcacccagattccctcctgtcccttcacagccagtctccttctccacccccagctttaaccaacccctgagttgtttgctgaccttacagtgttgcctttttcagagtgtcctataaatggattcatacagtgtgtagtctctcggatttgtcttctttcacctggcataatgcattcgggacccttccatgttgttctatgcatcaggggtttggtagtttttattgctgactgggactctgttgtatggatataccactgtttgtttatctgttctccatttgaagagcatctgggtgtttccacaagatacatgtttcatgctttacaacgtgccagaaataggatgtctgactcaagtgttgacaaggcacagggtgttcagcagctccgctagtgagtgtgtgaggtcactttagagaccaccttgccagcaggtagtgaaattggaaacatgtgcagccccgttcctaggtaagattgagaattcacagttcgtgctgtatgttacttaaggatatttagagatgaaagtgaaggtttaaaaaatgggctggaaagatctatatcaaactcactgtcatcatctggggagagaaggggagtgggctgattgtgaaggtcaaagccta

SEQ ID NO: 131643 - DNA, 2262 bp, Homo sapiens
cacctcctgggttcaagcaattctggttcctcagcctcccgagtatttgggacttcaggcacaacccccgtctggctaatttttgtattttttttagtagagacagggtttcaccatgttggccaggctggtctcaaactcctgacctctggtgatctacctgcctcagcctcccaaagtgctgggattacaggcgtgagccacggcgtccagcctgttctttaaatttctttcaaaacagtttagggaagggatatcctaggtaaagataatagcatgtgtgaaggccctgaggctgcaaaacttttggtgtgttcagagtgtcaaaagattcgtgtggctggaaaggagtgaacgtccagggtccagatgaacaggtgtttggtcatggagggccttaagtgcttttttaagtctttgggggtggctaagctgggtggttcctgatttgattgacctttttgttgggtagatggtggatcaacggaagcaggtggcccatttggggactgaattacagcaatccaagagagagctggactcggctctagcagtggagaggaagagaagaggatgagtttggtatttattttggagacagaaaggacttcttgggaccaggcgtggtggctcatgcctgtaatcccagcactttggcaggctgaggcgggcagatcacttgaggtcaggagttcaggaccagcctggccaacatggtgaaaccccatctctactaaaaatacaaaaattagccaggagtggtggcaggtgcctgtaatccgagctacttgggaagctgaggcaggaaaatagcttgaacccgggaggcggaggttgcagtgagctgagattgagccattgtattccagcctgggcaacaaagtgagattccatctcaaaaaaaaaaaaaaaaaaaaaaaaaagaaagaaaaaaaagaaaaagaaaaggacttcttggagggcaaagtttgagggaagagttagctagctagagaccttccaaactgtgctcaggcatttggattttaccctgtgggtgatagggaactattgaaagttttcatttttttctttttggagacagagtcttgctctgttgcttcaggcaggagtgcagtgagccatagtggctcattgcagcctggaccccctgtgctcaagcaatcctcccacctcagcctccagagtagctgggactacaggtgcatggcaccacccccagctaatgttttgtttttaattttttataaagatagggtctcactttgttgtccaggcttaaaactcctggctttaagcgatcctcccatcttgacctcccaaagtgttggaattacaggaatgagccatcatgctcggctctatggaaggttttgaggtggggcagggatgagattagagtgatgtgcctttgccagagagatttgtccagaggaagggtgaccagcctggagtctctttggaatgttctaggtaatgtagcagagattgtgtcagttaccctctggtgggatgcttggcttttcccattttttcaaaaggaaatgggaaaaggaaaaggtcctctgtatggaaagtccccaggaatttataggagagtggctaacgaagacagagttcccttccggcatttattgtgactgagtttgttccatagttttagtcccacttaggtcatgattcatcccactgggccagcagcagcattgggatcacgtcagccaatcttcgcacttagagattttgaagagagatatctcctatccatgtggtacattgcttttcacaaaacaaaagagttcattttgtcggtgaaaagccctggccagacccagccggtggagaccagtagcttcctctggcaggctgggcttcctatggtcattgcagtccctccccatttataaggctgccttccctgagaacacctgggacagatgccccccagaagcatgccctctggaaagggagaggagcaggagggggcttcaggcatgctgggcctggggggccaccccctggcctttgctaagttcctggctggtctgagccctcttctttcctctccccaggccttgcaaaggccatatctcttccttttcatgactctggaaattccatacatactttctgcattaggaagacattctctgcatgctgatctcgttaaaaaggaaaagccaaggagcatcctgcacctccctcctgtaagcgagctttgcaaatggtaaactagatcctgaaaggcaaccacttaaaagc

SEQ ID NO: 131644 - DNA, 1657 bp, Homo sapiens
gatcatgggatcagaggcagcaggtgaatgtggggtgtgaatatttttgaaggcttggaatgaaatgattcttccagactttagaggatttgtgtctgcagattcttctctaaggtttgtgtctcacatagtgagagaatcagccagccagggaaatgggacaggattttgtctctttccccatttcctcttctaatgaactcctacctatgctttatgactgcattaaggggtcacctcctccaggaagcattccctcatctccttacgctggttctgagtgtgtcgttcctgcttgatcccctcccagcaccatgtgtgtgagttctcacagctcacaccccatagtattactatgttgtttctacagtgggttcctgtcaggggttccaaacttagctgtttaggaggatgagtagattgtacaaccacaccaggcgggcctgatcaaatacagtaagaagtgtccggattggcaaaccagcgggtccctcttctagatgttatcagagagatactgttagagagaggttgctagatgttaatagaggctgctgttagattccagctccctcctcccctggtcccttttctctcctcatgccaaaagatagacccagtgttgccagagcttccacttttaaaagagaagccttttaaaatataaactctcctgatttttaaatgttttcagttaagtttttaaaggaacattcataggccaaaccaaatacctgtgggccgtatgtggcccccggggccagcagtttgcagctccttggttataggtgcctctaacccattgcacaagctccctcaggcatttcatgtctttcctttccattccccctgggcctagcagggagctggcatgtcacagtgggtgctccctaattattggttattgacttgaatgctagactgagcaagcacctccctgctcacagggtgttaacatttttccctcagaactgtttgtatgtaatgctattctgaattgcttcagttccttacatactttagtgatagtctgtatgtgcctggaaaagtcatcattccttagattctagacaactctgttcttctgttcttttcctttttcctttctctctccgtcccctcaacatatgtttttgttttttgttttttgccagttcttttgtatctggccggttaacacagggcttcataacatggggtcggctgttattaagcaacagtggtttccggtagctcactgactttgccctctctgctggtaagccattgctgatttccatcagggtaacaagcatgattttcagatttaccttcatttgcagtgaacaattatagcaaaattgcttaaagaaatgaaccttcaggtgtggcggctcgtgcctgtaatcccagcactttgggaggccgaggcgggaggatcacttgagcccaggaggtctctaggctgcagtaagctgtagttgcaccactgcactccagcctgggtgacagggtgagacatcgtctcaaaagaaaagaaaggaaaagaaaagaaaagaaaaggaggggaggagaggggaggggaggggaagagggagagagggagggagggagggacggaggaaggaggaaaggcaggaaggcaggaaggcaggaaggaaggaaggcaggaaggcag

SEQ ID NO: 131645 - DNA, 1147 bp, Homo sapiens
cttgcctgttgtagtcctggcactttgggaggctgagatgggaggaattggaaaccagcctgggcaacataatgagacttcatctctacaaaacaaatttttttttaattagccagtggcatgcacctgtggtcccaggaggccaaagctggaggattgcttgaggatgggaagttgaggctgcagtgacctatgttcccaccactgtactccagccagagtcacagaacaagaccttgtcaaaaaaagaaaagaaagaaaaggagagagggagggaaggaaggaagaaaaaaaagaaggaaagggagagaggaaggaaggaaggaagggaagggaagggaaggaagggagggaagggaggaaggtaggaaaatggaaggaagggagggaaggagggaagaaaagaaagaaggaaggaaaaaaccggtcggctatcttgacgaaaaaagtctcagtccactccattttgtgcagcatttcccgtcttgttatctttctggaaaaactcagtaagtctctggctgggaattatagaagcttaatatgcacttgtaactgtgtcaggctctcacagggaacaaacaagaggaactatagatttttatagtctgcaagagcccagtccatgcatttaggaggcacagagtgagagaaagagcattgacaatgataatatagcattaatataggtacaatctggagtaatgttatctagtactactaatagcgatattaaaatggcattatatagatattaagccctgacttcgtgccggtttgaacttttcctgtattaattcatgtgaatcaattttgagactctgtctcaaaaaaaatatatgtatataatatatacaaatatatataatatatacaaatatatataatatacaaatatatatatataatatatacaaatatataatatacaaatatatataatatatacaaatatatatatataatatatagatgtcatggtgatgggaagactgggggaggagaggagcagtttaatcccaggatcccatggagaggaaacttgtaggtctcttacccagtgtcttctcctgctctctggctctgatttctgaactaagaaaagtgtgcaaacatcatctgctctcctggttgtatttgtaaatgc

SEQ ID NO: 131646 - DNA, 2497 bp, Homo sapiens
aggggcagtaactagcagaagggaaacagcccgggtccagtttacttcccctcaacgtgggccaaggacgccaggcaggatcatagtccggctggattgtggctttcctcaaggtgatcttgacttgcccaggtgggatttcacccccacttccttccaggcttcccattttagacttgaaatgtaggcctgttggggcctcctccagtagatgtgtgcccttgagcttggatacccccctgccaagatacgcctttcaaaaacagataaacttatcgcaactgaatagaaggggctcccaaggggtcccaccctgctccggaagtctcagtgaggaatcaatagctgttaattcctgtgctgccccctgcctgacattccatccacacttgaggcccagattgtaagaagggagagcaggcaggtctctcttccaggagagggacccggttcatcagcaggatttattcattcatgtattacgtcaggctcagcgcctgggctttttataaatgagggctctgctggcgttctgtgttattcagatattcggtgagagaccaccagaagccacaaaaaattgctgacatctgttggaaggcaatcatgcataatggataagggtgcactctgcagttccagcagcattgatttgaattccccctctgccgcttcaaaactctgagatctcagcgagttgcttaccctctagagcctccacgtcctcatctataaaactagaaaataagtggtactcactagatccttaccttgttgtgagagtagaatgacgtgcatgtagagctttcccagagctggcatgtggtaggtgctcaataaacgctggttattctctctctctctctcactctgttgcctaggctggagtgcagtggcgtgatcatagctcacaacagcctctgtctgccaggctcaagggatactcctgcctcagcctcctgagtagctgggacttgcaggcaagtgctaccgctcctagctaatttgttttattcttagtacagatggggtcttgctatgtggtccctgctggagtgctggttgctctctaactggctgcgagccccggggtaggcacactggtactggggctatagcaaaatccgtgctcggtaaatcatcattgaaggagcaagggtgctttacagttgtagaatctcatagtacacgttactttggtttttctcttcccagctctggagtcctgggatccaagtgtgagccccatgtctgcaaaatgaggctagtcacttgaatcctcttggatcttgctttcctcatctgttagtgagcttgtagatagctctgactgtcaccaggctttgctctgagcactctgcatctgtattcaacctgtatacttaatcttcacaacagttgaggtggttgatccatagtaatttctcgttgtacaaacggagaaactgaggcagagagataagtgtcttcccaaggttaacagctaaccagtagcagggcacgctgggatttgaaagactctctatgtgtcctaactggtatgctctcctgtctagaggtgatctcttcctccagggttccaggtagattggttgagatgtgcaatgcggaagagcctcgggataagtcggctaatgacaccctcaggctacccagccctcgggagctcacagcagagcagttggggatgccttgcaaggttacctgtgccagagttcctggggtacatattaaataggtaggacccaatactactttgcattttcctggaatcctagactcttaacattggaaaggatttctttgccaagtaattcgccctcatcattaacctctaagaaatgcagaggtggaattagaaggtgcgtgtctctttcttttgcaccacagattctatcgagtctcatctggcagcttcaaggatcatccgcattctttcatcttcatggaatgtcactagattgagatgattctaagggtgaggtcaagcatttggagtttggaactctgccttttgtagagatgctcccgtgggacttgccctgcacccagttcagcttgcttgggatgcatctgctgagcctggaagagaagtatgggttcaaggccagcggtccagcactcccacagacctgatctgtaatagggaagggttgcctctgtgtgggttgggagtttaatcagcaagagtggattagcagcaggctcattctgtttactccagtaggtcacggggccaagggcaaacatacacccctcccagcccagaaactgatagctgcaaagttgcacacccttctccccaaattgacaaatatggttttcattgttggagtaataaattatgctttttaaggataaaaatgttgcccagctgttgagtggtttaaacttccagatgttcctctgctcagtaatcagagcaggatgcatgatgggatctctttaaaagttgatgaacagaatggttcattaaatttcaacaatgtgcctggaa

SEQ ID NO: 131647 - DNA, 1014 bp, Homo sapiens
tccagcctgggcgacagagggtctctgtctcaaaaaaaaaaaagaaagaaaattaacaattacatgtgtagtttgcattatatttccactgggcagtgctatgctaaactgtgacacaaacggtggactttagagttgtgcagggtacaatctgcacggccatatgtggcaggcctaccaggtgtggatgaggctgtctgggttcgaatcctggctctaccagtaatcagttgtgtggtattgactaaattgtttaaactctcagagcttcagttgttctatctgtaaaatgagtattgcaatagtgcatgcttcatagagctgttgtaaggattaaatgaattagtgcatataaagtgcctagaatagtgtctggcccgttttaagagctcagtgagtcttggttgttgtagttgttactttagtggttgttttttagaacctgaggacacaaggatggaaagactcagtctgtctgtggcaaaccacgaaaggaaagattaaacaattcaatgcaggctgggtgcagtgggtcacacttgtaatcccagcactttgggaggccaagacgagcggatagttgagatcagaagttcttgaccagcctggccagcatggtgaaatcccatatctactaaaaatacaaaaattagccagacgtagtggcgagtgcctgtagtcccagctactcgggagactgaggcacaagaattgcttgaacctgggaggtggaggttgcagtgagctgagatcacgctactgcactccagcctgggcgacagagcaggactctgtctcagaaaagaaagaaagaaaaaataaattcaatgcagtgattattagaggggtaagtccatcgggacaaatcagggggcattcccactgaggcaggacttgagatgaatctcggaagcagaaatgctgagcttgttgggctggccagagataagaaggacattgtgggcgggagaaacagcacctacagggctgagatggatgaaagctcagttcagt

SEQ ID NO: 131648 - DNA, 1046 bp, Homo sapiens
tagctgaggtgagaggattgctcgagcccaggagtttgaggctgcagtgagctgtaattgcaccactgcattccagcctgggtgacagagtgagaccctatctcaaaaaaaaggaactatctggcttcatcctaagagtagttgcattttaaactctcagtcagcttcttttactgtaaaatgggaataataattaacagtctaaattcctaaagtgattatgaaggctgaacaggtgatgcctgttcctcaggcccctcccttggggccccttcagccccatgtgtcccaggctaatctcaaactcctgggctcaagtgatctgcctactttggcctcccgaagtgttgggattacagacacgagccaccactcccagccaggttgctattaaattttacctttttatccaggagcgtgggtcatcatttctttcaaataatgcttctatttatgagatttttctttgtagaaaatgtgggaaatgttaagagtataaggaagaaaataagtcgtgttaacgcaattgctgcatttttctttttttctttgcatatttcttttaaacttgagatcatgtaatgtcaacaagtttattggatttttctcctaatgtagtattagtatttccatgtgttgtaaagagcaagcttttaggtatcatttttaatgcaatataatgttgtaacatcctattgcaatgacagcttgtctttctcccaattttatctgcactattaggtattaagaatatttaatgtggccgggcatgaaggctcctgcctgtaatcccagcactttgggaggccgaggtgggtggaacacttgaggtcaggagttcgagaccagcttgggcaacatggtgaaaccgcatctccactcaaaatacaaaaattagctgggtgtggtgatgcatgcctctaatcccagctactcggaaggctaaggctggaaaatcatttgaacccaggaggtggaggttgcagtgagtcgagatcatgcactgcacttcagcctgggtaacagagccaaacactagctaaaaa

SEQ ID NO: 131649 - DNA, 1050 bp, Homo sapiens
tagcctctggtcccctggcagccaactgctcctctggttcaccccctggggctccctgtataggggagccatcagcctgactgagcagccctgaggctggagtttttggcttcctcctaaccagcccccttcacggtccaggagcctcccagcacagaagggagaatctgtgcagcttgttccttatcctcctttgaaccaaggcctgttccaagaactccagggcctctctgcttgcacgtcagggttgagctgctcccccaggccccatgcacggagttggcagctccctggaaaaatttccttccccctttctttctggcaaatacgatggattccctgcatggccccagaccatgagtcttgagttgagttctgcaggagcatcttgctgggtggcttcagcaggggcaggggtggaaagcctgaagtcctcctctgtcctgaaagcctttgatcttcattctggcccgaagcccctgtgccgtatttccctcagcaccgttgtaacatctggtgagccaggctgttagggccaagtgcctgctctttggagggcatctagttcaatgtgagcatttttttctacccagcgaccaattctggaaacatcaaagtgtttatgagcctactttttgtttctccattcaaaatgaaaatagctttattgatcccatggtgaggggtgggcagggtgtgtatcttcttgctgctgggatgttctactttgttggacagaaggctatgtgctttctggcaggttacacctgggtacatttcagtcaagccgagctggctctctcctcatttcattctcaaagtagatctcttgctaagggcttcttactgagtgtctagttccttgttgtacaggtgagggaaactgaggcccagagtggatgtgacgtttccgaaggagaggctctgtaaagttctgagtaggtgagacttattattagctgcaaataacaacaacaataattagaagaagaagcatcttctgccctaaatcatggggcttttatttttcagctggatggtgaagcttag

SEQ ID NO: 131650 - DNA, 2047 bp, Homo sapiens
attgcctaacgccgcatttctcagaatgtatctctacccttaagcaacgtgtgactgtcctattatcatcaccccattttacagatgaaggagctgtggcaagaaattgactaacttggcccaaggtcacccatataataaaaggcgggctgggtgcagtggctcgtgcctgtaattccagcactttgggagtccaaggggaataggatcacttcaggagaggagtttgagaccagcctgggcaacagagggagaccctacctctaccaaaattataaaaaaattagccgggcatggtggcatagacttgtggtcccagctgcccagaaggctgaagtggaaggatggcttgagcctgggaggtcaagcctgcagtgagccgtgattgtgccactgcactccagcctgggtgagagagtgagatcctatctcaaaaataaaaaataaaaaaaaaatgaaaaaaaaaataaaaaaaaataaataaaataattaaaaaaagagctgggacttgaagccagataataaggcaggcagagggcatacgaaacacccagatgggtcatgagcccgtgcatcagtcagggtctaatggctcagctgaggaagggaggtttaaggaagagactgtggacagaggtgttagggaaggtgtcagagaaggttaaggagccaacatggatcatgggggtggtacagtgttgccagggctggggaggattggctgcagtgtggggtacccagccgctgccatgtggagagggacctgtcactcctgctgtgaactctcccttcttctgccctctgacctcctgctggtgcctcccattggctaaacacagttgatggccagtgcactggggagctgttcttggagcccacaggcatctgcttcttggcacagagcagacaatggattgagtcgggagggaggggaactagagaatacccaagtcccaatggctggagaggagtgagcaggtaaagggggtagaaggtgaagtcagagaggccggggtccacactacacagggcctttggctttcttcggaaggagcaggaagccagtggagggtttgagcagatgtgtgcatcacggccactgccatcaggagaacgtctttctctatgctaggtgtgaacagtcaccccttcctctccctttctcaggatgagtgctgaggaggaaaaggccctttcctccaatgtcttcagaggagacgtctgcccagtccagactacgtgcctcatgccagccagcctgtaaatgacaggaaagagaaaggagcagtgtctcaaaagaggatattctggaacgtttgataatcagagcccattgtaaagtcatgttttgagttacagcatttaaatctttgttccagtggaaaacttttacaggccgtcctgggcaaggcttgaatcctgtttggatctccaaaggccttaaaatagtgtgggatgccgggagactggctccaaaagggaggagacctgtgctggcagccctggccacaccttggtgggaccggctcctggccttggggaccctgccactctcctagctgtgcttccgcagagctggacacacaaaagctttcttgtctggatttgttcccctaagagggtggcaccgaactggtcctgcccatgcaggaagctggtcctgtccaaccagggaatgaaaagttggccagtatcttctcaggccacgctacagccaagtctcttttaatgagctggttctcttaggatgcccaggggagggagaacacacttgagtgggatggcgaatgaagaaggaagcggctgttcagacagcttccagttctgtcaggttctgctgctgtgaccaaggcaccaagtcatctggaaacccactgcaggcagcaacctctttttcacctttgtgtgccccaaagcttgctccgggaatcgatggtttgggaaacaatgcttgctgtctttgagtcctcagtcctgtaaaatggggaaagtatacatcagagggcatttgagagtaaggcaagaagcgcttggcatgtgcctggca

SEQ ID NO: 131651 - DNA, 1082 bp, Homo sapiens
ggagaaaccccatccctactaaaaatacaaaattagccgggcgtggtggcacatgcctgtaatcccagctacttgggaggctgaggcaggagaatcgcttgaacccgggaggcagaggttgcagtgagctgagatcgcgccattgcactccagcctgggcaacaagaccgaaactccgtctcagataaaaaacaaacaaacaaacaaaaaaggccaacaaatttgaccaatactcctcaaaactggaaaagctggtgaccaccacccctagtgctccaataaagggctgtgggaacagttgtgctcagggtggtactggtacagcctggcagaggacatgatgcttgcatagtgtggaaaggccctctgagatattgctgggccttaggggaggaggtccaggcctagagaggactgaagccctccccagggcatggtgtggaccacgctgaagggaggtggggttggagacacagctgggagtcagatcccaggggctctcctgtgtgatgctgaattgctgggaaggggatgccagctagtctctttctctgtgccaaccctgattggttgggtggctgctgagagccttatggtgccctggctcagtaggaagagtgtgtgttcatttagtgagtttgccaaagacaagggaagggggttagagagtaggtggcagataatgccggcctggggatcctggaggttttaggctggcagaccctggctgaggctgttttctgttcttttccttaggccttgggagacctttaccttttcagtgcctctaagacagggtcagagcagtttggtgacaaagtggaagtaaaccatgggtgaaaaacagctctggggaccctcataggcttccacttattgaggattaggcagaacttgcagcttggcccagctttcgaaacaaggtgttcccaggaggtggaaagactggttttcaatcagataaaggtaggatcctatgaaaaactcctagggccttgccgttcctatgaagtggtagctatcattcacactcctagttatgccatcgaggtaaaaagaggtggaataagaatcagggacac

SEQ ID NO: 131652 - DNA, 1191 bp, Homo sapiens
taggttctggacacacgttatgacatgttctgatgatctggcttagacagtggggccctcgaggtaggcccagaggacttggtcctcactgcctctgtggcgccttgcactgggtccagctgacgtggagagagactcaggaaacagtggctgagtgtgactttggctggcatagtggttgctgagagaacagacaaggttctctctcacgacatacagatttcagatcagggaaagtcccagctggcataagtttatcgagcatctcccatggacaagatcagctgtgggtggagccttgaagtacatggtagaaggacagcgagtcttcccaggccagggcttcaagtgaggagacaagatatagcctcccagagaattcctataatgcaatcgtgaaagaaccatacccagcaggaggccggggaaagtgactcctgcaactctaggaaggcttcctggaagaggtggaacgtgagcagcataggattttgagagaagaaatggaatgggctgagggagattctgctggtggaggttcaggttgacctaagggctggcagcagtggaggccccccacgagtgagtttgaggggcctctttagctcagtccagttgaggcagcagagcctttccataggggtgtggtgtgacctgaatgttgggcacgtggtcgtaactgagctttaaaagtgaatgagaggagccatgcgtgatggctcgagcctgtaatcccagcactttgggagatcaaagctgggggatcacctgaggtcaggagttcgagaccaacctgggcaacatggtgaaaccctgtctgtactaaaaatacaaaaatcagttgggtgtggtggtgggtgcctgtaatcccagctactcaggaggctgaggcaggagaatcgctccaacctgggaggcagagactgtaatgagccaagattgtgctgctctactctagcctgtctcaaaacaaaaaacaagaaacaaaaacaaaacaaaacaaaaaaacactgtctcaaaaaaaaaaagtgaataaagagagaagaaaggcggggcacgatgctttttaagtctacgagcatcttatagcattgtttacatcccagcttttcactgacccttcctttacccccgcccccatcccgtggcccttgctctgtcctgccctttctgtacggcgttttctcttcc

SEQ ID NO: 131653 - DNA, 1050 bp, Homo sapiens
gttcatagctcagttcatagttcatagcttagacctcccaagctcaagagattcttccacctcagcctcccacaggtgcacaccactatgcccagctaattttaaaatattttttgtacacatgaggtctcactatgttaccaggctggtctcaaactcctggcctcgggcaatcctggactccccagatgctggaattatgggttgagccatagcctgcagcaaactcttaaaacatgaggggaactatcttgttataaagttgcttttctttgactactggtgtggttggccagcttttcatgtttatggcttatttgtgtttgttaactggtcatttcctttggggtgttagcaatttttttctcattgatttgtaagatctgtcttgattaacttgtgaattttgcagatggtggaaccggggtgccccacagtaagtcccctttgttaggcatcctgtccctggattcgacacctccatttctatgggggacatttctttacaaatctgcatctgattgtgataccaaaccatgctttgcaagtgaatacaaggatctaccccattaatctgggcagttgctagttttatttatttatttatttatttatttatttatttatttatttatttttccgagaccgtgtcttgctctgtcacccaggctggagtgcagtggcatgatctcggctcactgcaacctccgcctcttgggttcaagcaattatcctgcttcagcctcccgagttgctgggattacaggtgtccgccactgcgccagctaattttttgcatttttagtagagatggggtttcactatgttggccaggctggtctcgaactcctgatctcatgatctttctgcctcagcctcccaaaatgctgggatgacaggcatgagccaccgtgcctggccagttgccagtttttaatgttctcaggtgagtggcatttgccaaggaacttctctcttcccttctgtcttcataaacaaaaaatcctactaacttcaggtgtcagtttaaaagtcatctcttctgggagc

SEQ ID NO: 131654 - DNA, 1889 bp, Homo sapiens
ggatggtctcgatctcctgacctcgtgatccgcccgcctcagcctcccaaagtgctgggattccaggcatgagtcactgcgcccagccaggatatttctaacacagagaaattctcagtggaggccgcgggaactagagatagaggtcctcttgcctaccaaagcaccagatggaggtgacagaggccatcttgtcctagagggacctggctaagaggatctaagaccagaactagtctgagtgcttgggattcatatggggctgtagacggcaggcctgcttgaacaccagtgttccaatcccacatctcattcttagagctgtgtggccctgggcgagtctcttgccactatttcttcatcctgaagtgggcaccacattactgcacctcaatttggacgaggattctcaggatggggaggtggttgaaatcatccaggggtcactggaatcaggatggtcctggctttttcagaaggacaaggtggtaggtgccaatctgggggctttgcagatattgaacggcagcctgaggatggggataaacctgggtgtggcagacagaattatgcttcccccaaagaggttcacatcctgatctctggaacatggggatgtcatatgccatacagagaagggaaattaaagtcacaggtggaattaaagctgaccttaaaagagggagatccttttagattatccagagggcccagtctcatcacagagtccttacaagtgggcgagagaggcagaagaagggttcagaaacatgtgaggtgacaagtaacattgctggctttgaggatggaggaaggagccatgagacaaggaataaccgtccctagaagttggaaaaggcaaggaaataggaactcccccagagcctccaggaaggaacacagtcctgctaacactcagtgagacccactttgaactttgtatgttcagaactgtatcataataaatgtgggtggatttaagcctctgagtttgtactagtttgttccggcagccctaggaagtgaatgcaatgggcgcagcatttgatggccagcctggcatccagcctgtggggagtgggagctgagggcagtccaagggaaatgtcctttgagtgtggcaccggcaggcaaacccttgtttgggtgtgatcatcagtgagttgggccactgaagctgcctggtgacctggcagggatggcttaagtaggcagggtttgcagatcagcgagataaaggggcttgcataaattcacatgcccatggcttctccctctgacagcgcagccctgcctccggctgcctggccaggatggcgtgttggtgcattagggaccccttcctctcctgccctgctgtttaaattgttggtctgttggcgttctcaggagccctttaccagtacccttaggccccagacgacctactcctcaagctgatcatatctgctggctgtgtccctgctctgggcccagcaccctcatggttttccataacacgtatcccaactcctgctgatgggaccctcgtgagctgtctgtgtagggagcatggctgcccctgggtctgctttcctgcccctgacccacaggaataggatgtggcagagtgggggccagatgacagagatgctggtgctctctgagctgaggcccactgctgacctgctggtggcttgtcctgctcttggatcataggcactgggacatcctgccttccttcagtgtcccctcccactccctctccttcagcatcagaggaatgaaggaggcctggaggagtagcccctatctaatagagacaggagtgggctgggtgagcatggggtggtcgcagggggaaggggataggagatggagagaggaacctgctatctggtgggttccag

SEQ ID NO: 131655 - DNA, 2150 bp, Homo sapiens
taatattgactggaggcttaggggtctggttcagggtggactcaacaattttgcaagttctatattgttaaaattacaatgaattatttataagcagttgttagtaaatcatgaagttggcattattattctttatttatttatttattttgagatggagtctcgctctgttgcccaggctgaagcgcaatggcatgagttcggctcactgcaacctccacctcccaggttccagtgattctcctgcctcagcctcctgagtagctgggattacaggcatgcaccaccacacccggctaatttttgtatttttagtagagatggagtttcatcatgttgcccaggctggtctcgaactcctgacctcaggtgatgcacccacctcctcctctcaaagtgctgggattacaggtgtgagccaccacgcttggcctattttttattattaaaaaacaaaatgatgctgatgctttcaaatatgtattgcagtcttattacttagtattgagctttgcagtgttggactaatatcacaagtcgaagggacaaagaagatggtagacaataccaactgtttcccattaggctctttccctcctcttgtttttctgagaccttaagggcctggttgtttctactgttccctgctacttcataacctgcaagcttgagaatgtttgtcatttacaaattttaccttatagtagaagaacatagtaaataattgtaccagattgagtagtgtccccccaaaattcatgcctgtatgaacttcagaacatggcattatttggacatagggtttttgtttttgtttttgttttgagatggagtctcgctctgtcactcaggaaggagtgcagtggcgtgatctcggcttactgcaacctctgcctcctgggttcaagctattctcctgcctcagccgtccgagtagctgagattacaggcacccgccaccaggcttggctattttttgtacttttagtagagacagggtgtcaccatgttggccaggctggtctcgaactcctgaccttcagtgatcctcctgtctcggcttcccaaagtgttggggttacaggcacgagccactgtgcctggtggacattgggtctttttagatgtcattacttaagatgatatcatattggattagggtgggggctaaagccaatgacccatgtcctcagaggagaagagagggacataggaaagaaggatttgtagagatacagggagaaggccatgtgaccacagaggcagagattagagtgacacagctacaagccaaggagctccaaggattgcaggaagccaccagatgccagaaagaggcaaggaaggatctttcatggagccttcagagggagcacagtcccgctgacaccttgatcttggacatctagtccccagaactgtgagagagtgcatctgctgatgtaagccacccagtttgtagcaatttgttatggctgccctcagaaactaagacagtagccaacacagaaccaaataccctttggggattgagggaagtggagcgggagaatgagcggcactccctccctttacataggactacttggtaaatatttactgaatgaaggaaagctgaagtatctgtagaactggccatttcattctgcatttagagctctgggagctcttgaaatgtctagacaaacatcctcttcagctagaggaagctccttctcccacttactagctatgagatcttgggcagatggcttaacatttctgggcctcagtgaccttacttgcaaagttgtctgggtcaaggcaatgattaaatgcgatgatgcatgtaaagccccagcatgcagcctgaaaatgtgagcccttattatttatactgtttgccaaagtggtgagtagtgttgctgaatatgccgtgtgtcctattaactctgtgacggccacagtcacgtctcctttctgcctcctcctcctcctcctctctgtccagtgactagggagggcaggaagttcagagggtgaaatgctgaattaattcctgtcctcctggtctatattccagatcaccctgtgggtgggttgaaaaccatgccctgtctacctcctctgcaaggaaaaaataaagacagagagcaaatctaaaacacgca

SEQ ID NO: 131656 - DNA, 3337 bp, Homo sapiens
tccttccctctctctctttctttctttcttctttttttttttgagatagagtctcattctgtggcccaggctggaatgcagtggtgtgatcttggctcactgcaacctccgtctccttggtttaagcgattctcattcctcggcctcccaaatagctggaattacaggcatgcaccaccacacccagctaatttttgtatttttagtagagacagggtttcaccatgttggccaggctggtcttgaattcctggcctcaagggatccaccagcctcggcatcacaaagtgctaggattacaggcgtgagccaccgcgcccagcctcaaacccttttcctgtgattttttttttttttttttaaagctgtgtgaccttgtggaagttgcttcacttctctgggcctcaaatttctcatctctaaagtcggttaacaataatctacaactcatagttttttgtgaggatgaaatgagggtttcatacatgcagaaagcctggaagtaagttttagctgtggccattctgggcaggaatccctcactaggtaacttagagcggcggatcagggcacagacttgggagacagactgtctagcttcagatttaggcttcttactagtctgaagtagaatggttgtttgttcctccactgcttcatctggaaaacaggggcaggcatcccagggtgtttgagagatcatatcagatggagaggccagagtttttagccgatacatcatagacattccccaaaggacagttattgttatcattgggtggatggggaatattgagcctccagccctaggcattgtggatcaatttgttcttcagttatctttggaataatttaaatacactggattgggaagacaaagctatcaccctcctgatgggagagtgctgggtacctagcaggtgctcagtagttagtgaatgaatgagtaagaacagaacaggtcctaggccctgccctgaagaggctcacagtgcaggacaaggcctggagtcaggccagggttttgtggttgtctttaaaaagaaacaaaacaaagaactacttcctaccagctgaccctaaacccctcagctccctgcagggacctctcagccctgcaggggagcccaggctatgtgccaggcctggccttgctgtcagctttctaagccagtcacaaacattctcctctcaactttataatggatgccccccagcctcctctcccctctcagggtgctcctgaggctatgagcagctggcagttccctgtctgagaggtccttcgtaccgcaggagaggcagctctcacctgaaggcctccctggacaccggtctcaactttgtgtgttaccagttatggagaattatttttagtgagttacactctgttagggccaaacacaaggaggaaagagtgactgaatactgctctgagtcagtgactgtgacaagactgtttttttcttcttccctgttgcaggcctgatcttttggccagaaggagattaaaaagatgcccctcaagatggctgtgcctgtcagctgcatggagcttcgttcaagtattttctgagcctgatggatttacagtgatcttcagtggtctggggaataacgctggtggaaccatgcactggaatgacacacgcccggcacatttcaggatactaaaagtggttttaagggaggctgtggctgaatgcctcatggattcttacagcttggatgtccatgggggacgaaggactgcagctggctgagagggttgagatctctgtttacttagatctctgccaacttcctttgggtctccctatggaatgtaagaccccgactcttcctggtgaagcatctgatgcacgttccatccggcgctcagctgggcttgaggtgaggctgtcctggctggtcacggagggttcactgggatgtggctggtgttctcaacgaggtggcatttaatgagcaccctctgtgtggttggcgtgatgctgggtgcctgggggagacagatggaactaaagaggtccttcctggaagccgttactgttccctgccctgacgtgtgttattgtacctgtcaccattttctgatgttcccagtttacgtatctgtcaccatctacctccctataaagtgcctctgctgttggttctgtgtccttaagacattgtgtggcatttggcacagtctctcatgctgcagaaagggtaaattaagacaggattgttaatgaatgaagacatgggagattcaatggaaagatatgcatggggggataatttcttggctctgtgctcagagctaggaacaacataaggccatatggctggtgctgtgagggttgtatgtgggcagatgcatgtggaggcagacaggcctgggtatgactctttaacacatacacactgcatgcctccaggcagactgatggattcctttccctgcagtgaagggttaagtattatcacacgtcacaggactggaattgaagatcgccaagtagacattgaaatgctgaccacatgacagacactcagcatgtggtgggtgatgttggctgggggtagcttttggggatggtggacatttcttggccctgatctttctgagcagagccagggaggcagtgctggactctgacctgggcacagctggttggcgtggacagttgattaaaggtcacagtttccctgcagcccatgggaaggcagagtgacaagtcagtggcagatgaggaaatggagtctcatgccagctggagggagggagcagctgggttggccacaaaggcctgttgcagttctgcagctgacaagtggaaggactggcctctcaggtccaggcctggtggcctgggaggctgctagctctgagcgatgagtggtgccaaggtgcctgaaggagagttgcagctcaaacagcaagtggtccagctctcagaccacttgaggccacctggcatgtggcggccaagaccacagttggggcggggccttgagtctgattttgattggattcctagttcggctcatgcctgacagcactttctcagacaggcttccctgacctcctaaggtaaataatgtccctctgggtgttacatgctgttctcacccatagctcttagatgtgttctaattgtatattcatatgtgcaatttactgggtttcctgtctttctctcacactagaaagtaatctttctgagttgaggaaatgcatttgccttgcacacaggctagacacatacatagtaggcattttatttgttgcatcacagttgccttgatcaaatatggtgactctccgtggttttctcttggtttcttt

SEQ ID NO: 131657 - DNA, 1235 bp, Homo sapiens
acactcttttcttgagtatatatatgacttagcccagcaatcccactaggagagcaatggtttatccattatacagttgagcgcctggaggctctgaggggccatgtaccttccccaaggttatttatccaggagaagacagagccagaagctgagaactgcctcgtgttttataccaaacaaggccccttcagctgaagacttttccttgcggtcttgggaagggtgtgtgtgacggtgagctgcagcaggtgctgggctgtgcttgactgtggtcacgtaggggcaggcagaggagccatttcggggggctgctgagggtctggagagaggctcacagtggtgagcaaagaggttctgggatgggaggggatcagttgggaaagacagaggcagatactccccactcctttgtgccttcccagtcctctctcaccccttcctgccctctccccacaccctatcgtggtggcagctgtgcctcacttatcacatggtccatagctctgttttttccccttttatcagttactgcctagaacaacccaattgtggtggtctgggttatctcccactcttcacagtagggccagagtgggctcagacaccaaaggacacagaatggttatggcaatgaataagattccttctctgtgtcagcaaggatgctgatgtagtaataatctccatttattaagccatgctgtctacagggcacatagcacatgtttttccattcaaacctcaaaacagagctatgagatgcgcaccattatgatgattatctgttttactgttttttgttttgttttgtttttgttgttttttttgagactgagtcttactctatcatccaggctggagtgcagtggcgcaatctcggctcactgcaacctccacctccttggttcaagtgattcttgtgcgtcagcctcccaagtagctgggactacaggcgtgcgccaccatgcctggctaatttttgttggccaggctggtcttgaactcctgacttcaagtgatctgcctgcctcggcctcctaaagagctgcgattacaagcgtgacccaccttgcccggtctgttttactgttgaagtaactggagcacccagagggaaatcaagtgtccctagagaatacaagcagcatttggacagccctgtctgactccaaagccactgcacaacattgcctggagctgagagatgcacattctcccttcttggccactgg

SEQ ID NO: 131658 - DNA, 2319 bp, Homo sapiens
tatcacttactctgggatgacaggtgtatacgaggatgtagctgggcaagccaggcctagtggctcgcacactcatcagttagatggtgggtgctggtgctgctggtgcatcatgcatacaaggctggctctcccagttttccctggacttttgcctgaacagtttgcatttctactcgtggtgcaggagcttgctgttctgatttcatgtcacaagcctgctttcagccacttagaagagccctgttatccctgactgccgctacagcagtcccaacctgtgttgttttcacttgatgggctcctggaattattgacagcacactctctagtcgtacgggctgccctgccacctacactgacatcctggccaggttcctggagatggcctggcatcttggacctgttccccacggggtgcctggagcctctgatggtctacccagggtggcaatgagggaaaggctgtgacttgatcatctccaggggttcttcggtgaacagcccaaggttgcttaacagctggtgtgtatgaatacctggaatgtgccagttcaccttctaatctggcaaggagaatgtgtctcctccttatgcatatgaacaaactgaggttcagtgagatccagaaagctgccacggttactgatggagagagcagagaagctggtgtttgcagtcccatctgtcagccttgacacccctactcctgtccagccagtgttttccaaagcgtgctgatgagcaatgcaagatgatttcatgttatagataagaataaaaaaattgttttgtgtttaactcaaattagaaaaaggcaacaattggtatgtgcgacctgtggttttgcagatgatactgcttaggatgttggtacttaagaaaaggtcaacttttcaaaaatactattagtgacatgtggacctagtcctcctgaagaggactacattggggcaccggtaattgtttctatttgcggtactctggctgtgtggctctggccacgccactggaggcagtgtctgagcctgtgacttgagtagtagctctgtgtcatgtctgctgattctccccaaatcctgaagattcatgatgaagtgactggccggcttggtctgaagctagattgaaaacaataaggatcccagaacgatagcactttacaatcctataatttggctcaaattgcctgcagttactatctcagccctgcctgttatgttcattgagcacccaaagtttttcagtcaattcctgagttaattattctctgggattgaattatgaaatagtaaatatttccactatgcaatcaattggtgacttattcatgtattcatttcattcatttagtctcaataaattgaagataagggctgagcacagtggctcacacatgtaatcccagcactttgggaggccgaggtgggcagatcacctgaggtcaggagttcaagaccagcctaaccaacatagcgaaaccccatcactactaaaaatagaaaaattagctgggtgtggtggcatgcgcctgtaatcccagctactcaggaggctgaggcaggagaatcatttgaatctgggaggcggaggttgcagtgagccgagattgcaccactgcactccagcctgcgtgacaaactgagactccatctcccaaataaataaataaataaataaaagataatattacctaccccatgagtttattatgagaattaaataagagaacatattaaaaggtttcattcagtgccaggcatataatatgtactcagggaatactagttttttttaaataaaattttaaaatgggattagaaggtcaaagcatataggcataaaggtataaaaaatattgaagatgagtgagttactaaaatttaacattacgtttagctctgagcttcctaattagcacaacatgctaagtaggttatatttgtatctaaagtaaagattggcaaactttttatatcaagggttaggtgacaaatgttttcagctttgcaggccacacagctctgtactgcttgtcagttctgcctttgtatctggaaagtagccatagataatatgtaaatgagtgggtgtggctgtgtgccaataaaactttatttacaagaactggcaataggcctttaggctgtagtttgtccttggcctaaataaaggaaacatgtttgtctttcaaaggcagaaactcctcctggatcataaacattgaaaaaaaaattgttacaagatgcaatatttctgtgagacttgttaagcagtatatgcgcagtgctttcattaggattttacagaaaacttaga

SEQ ID NO: 131659 - DNA, 1050 bp, Homo sapiens
gagaccagactgaggcagtgaagtcaccataattgatgggccacactagactggagccaaccatggcccattgctgagactctgggcctcagggtggccttggctggaacctgtattccagtggccctggtggctctcttccctctcaccttcccaggaggcagattatttccctgtggtgggggtgaggcggtggcgtgggggcttcttccctctctctctgtcttgtagccttgttaaaatagtggccacacgctgatagctggatttccagtgcagttgctggggatgggggtctttccctctcatctgtctgtcaccctttatcactccacaaggggtgggggtactggacagaaagagtgtgtcccacctgattactgggaagtgcaatggacacccccaccccccgttgacttatctggctccaaccgaagaacagctgttggtggtcaggtctctgagtcactcagtagcttgggactgggttcagtgggagatgatggcataaacaaataaacactggctggcccccagctctcagctttctgctcactggggggccccagaagcttcctgttgcgtctgcagggaaaataaggatacccataatgaaaatagttttcctgatggagaaatgctctggggaggttgttgaggcatgttagaaaatccctgaggctttctggctctgtgagctaagggaggacacttggcctctctgggctttcgcttgctcctttgggaagcctgttattgtgaaagtgagatgatctgggaggtaaaactggccagttgtccatctcccctctctgaacatgatgcatagtaagccctgaatctcatttaaatttggaagtcagactgactttgtgactgtcctagtttccggctgttgagtcagctcaggcagttcttgggacttctgtgagtctctggctccccgtctctcaatggggtgacagtcctcgtcttgtgcccctcacgcgcttgttgagatgacagatgagtcacctctgggaaactgcctgagagctggatgacaccact

SEQ ID NO: 131660 - DNA, 1486 bp, Homo sapiens
cctggatcattgtctttaaagaaatttaaaaaaaaaaatagataaatgggaagtctatgagccttgtctcccattccccatccttctcttcatacaagtacctctcctgaacttggggtataacaggtcatgctcttacaatttcattacaaatctatttgaagatcactggtagcaccattttgtgtgtttttaaattcttaggtaggtgacataacgtataagatgtctgcactttcctcttttctcccggcgctatgctgggcagatgatgctactatgcttgttcattcattccctgggccacagagtcttgggttgtttccagaattttgcttttgtaaacaatgctgtcatgagcatcctagcacagggctgcaggtgcatgtctgggtgtgtcccaggagtacagggcacagagcatgcacatttgcagcctgactggaggttgccacatcactctccagttggcactatttcctaggttccttccctgagagcctgggaacttctggaaggcaggagtgggtggtgttcaccactatatacctctgccagtcagcatgccccacaccatgtaccagctcatgacacgcctgaatggggtgaattctggaaggggacaaggcaagtgccagggcaggtccagagtctgggtgtggaaggagcaacataatgggggccccttgcagaagcagcagaaagaacaaagaaataggggcctggagtgggggtgtgaatgaagacattgctgttgagaagatacttgtgaagaagccaacagcgttgtctgggcctggctggatatcatgaggctggacatggaggtcccaggcaccattgctgtgggcttttggggagttggatgcacagtggagagctgaggaggaagttgggcttgctgcagagggctgctggaggggctggctggagtctggctctggccctcactcactgagggttatccaagtgacccattgcaggaagaggggtgggggacccagagttactgtaaccactttatgagtctgtctcagccaggatctggggcttctagcaaagcccacagcacaggcacattttaggaaaggcaagattgagatgccctcggtggcccagaaggacacttcagggcagcagggctgtaaaggtcaggagggggaaacttctggaaggaagttgaatgttgtgggaaaaagctgacataaatgaacaaggaatgatttttttcttttcttttttttatttttctttttagagagacagtcttgatatgttgcctaggctggtctcaaacttttgaacttgagtgatcctcccaccttggcctcccaaagtgctggaattataggcatgaaccaccattgtacagccacaagggaagattaaacatagacagtttgagaagagtttttttttttttaaatttctaattttatatttaatagagatggagtctcactatgttgctcaggctagtcttaaa

SEQ ID NO: 131661 - DNA, 2837 bp, Homo sapiens
aggcaagttatttaacttctcttgacctcggtttccccatctgtaaaatggggctatactagttgctctgtgtaggaagggtctgaggtttcagtaagatacattttgcacaaaccccacacacaccaagtatccatgaagcctggttatccttataacctcagagcggtttggagagggttaggaacttgcagatggtcacataatcggtgtatggcagatcttgggcagagctggactggtcttcctaatgagagctcctttccccactctgctttcatggacagaccctaatgaccacctgggttatgtttttgtccctgtcaattcctttgtccttgctgataacctaagggaaccttgagagccagaacgagacaggaagaaaatgcctggctgctgcttgcggggttaattaaaccattcctggggtttcatttgctctctagttagcaccaaaataaatcctccaaatggctttgagccttccagttgacattgcattttgaattctgacagcaccagcattttacatcttcctgaggatgataaatgtttagatagcaccgaagataatggtaaaaggagaaactgggggtagttcaggctgtggctgagcagattgtaactctttggtgtgacgaatgggtgagaagttgcttaaaggacacatctgatgtcccctgctcctaggggttgagagggggatggggggtggactctgttttgccatccggagaatccattgccttcccgatgcttctggggtctcatgcttgagtcttgtttccatgcgttctgtcagatgttaaggtcttgtgcataatggttgaggtgtcaatgtgcaggcgttaatgtcaccattcttatgtaattgttaccctttattgagtgcctactatgtgccaggatttaaatatttctctcagcaacccaaagatgtaaatgtcatatcaccttcattttacagatgtgaaaacaggctcggagaggctgagacacccagccattaaggactcagctgggattcccagccttccctggcactctctcttttttttttttttttttctgttttgagacagagtcttgctctgtcagccaggctggagtgcagtggcacaatatcagctcacttcaacctccctctcccgggctcaagcaattctcctgtctcagcctcccgagtagctggatttgcaggcatgtgccaccgcacccggctaatttttatttttaattttttttggtagagacggggtttcaccatgttggccaggctagtcttgaactcctgacctcaggtaatctgccagcctcggcctcccaaagtgctgggattacaggtgtgagccaccatgcccggccttccctggcactcttgagcatgtttccagaccgcctgcttcctaccccagacatgtcaaaatgcggtgctgtaaatgacagggctctggtcccagatggacagcccgggccctttgaagacactctggccttcaggagtctggatctttatgcctgatggaactgacacgggcctgctatgtttacagtgcctgttctcctgcagggtctccggaagtcatcagccgtgctggccagcactccggaggatgacaggaaattctgctgcagctctgtgggctggctggggtgcatgctggacagggagcgggcggacagggctggtagggaggaaaacaccactgaaatagttcagaccgtattgtcagtgaattcctggattagtatgcagtgctgccaatgatcagatttgggtcaggaagcccagatggcagaaagattgtgttaaatctttatatttttccacgaaatcctcaccgtttcagaccctgttttctaagctatcaccctaataattgtggattttggatttccaaggcacgttttatagtggttgtaaggaggggatggttgggttggggattgggatgggaggggggtagctgaagaaataagaaagtgctgcagaaaggagcacattccacacccagcttcttcctgattgtgtttccctccaagcagcgaacaagaggctgattcaagtggctcagtggcctccctgcctggagttgggttcctatgccttccagtgactaaggaggaaattccatttcagttaatctgtggccgcgcatcacccatggcattctctatcttaattttatggctgcctcatctttttggaattcgccttctttttgtgtgttgggtgataagtcaaggagacatatggcacagctccacaaaatacaaccacattttagtattccgtacacagtcctttctgggcatcccaggctttgtattttcacgttggtcggccgtgaggagggtggatcttcattatctgtgcatgcatgtgcatcccttcatcccttcctcttcagtttcttttctttttttttcttttttctttctttctttttttttttgagatggaatcttgctctgtcacccaggctggagtacagtggcgtgatattgactcgctgcaacctccgcctcctgggttcaagcgattctcctgcctcagcctcctgagtagctgggattacagggttgtgccaccacgcccggctaatttttgtatttttagtaaagacggggtttcaccatattgaccaggctggtctcaaactcctgaccttgtgatccgcccacctcagcctcccaaagtgttgggattacaggcgtgagccaccacatccagcctcctgttcagtttcttaacccttgatgggactcccggctaaacacccccattgtctgggaccttgagattagatgcagtagcactgctggtttcatgg

SEQ ID NO: 131662 - DNA, 1527 bp, Homo sapiens
gattggttgcaaggtgctgggagtggggtgcagggaagggcctctgcacaccacgtccgtcctcatcctgctatgaggtcagctctgtacatgtgctggaagagcaattagcggggtgcctaagcagtgtccatcatggacgtgggtctctgctggccacgcaaggggaagatgggactggtgggaagattggggagatggaagcgggggcagttgtgtgcgaaaggtacagggtcgtggaaacatgcacaagaaagtgacattttagaaggtggtttttgttccataataaatttattagctttggaatctgactctattgccttggcttctccaaactttggtgtcctcatctgcaaactggggatcacaatctcagttttgcagggaatgtgaaatcctgacctgaaatgatcacatgtgtaggaagctgacaaagaatgctaattttcttccttcttttctttatggcctttccttggtaaatctctgtgtgattgataactcatgaagaacctaccagtcaaatcagttaaattaaatgacttcctaatgataataattagattagtaactaataatcatagctgacatttatctagtgcttattaacttctgggcagtgcgaatttggtctcatctgttaaataatttaattcctgtaataatcctaggaggatggtgctataattagccccattttacaaacaagaaaactggaggatcagagaggctaagtataatgtctaatgtcacactgctgaaagtggcttgctggtgttccagccccaacagtctggctccagagtttgtgctattaaccattatatcagtctgctgtgtgtgtgtgtgtttgtgtgtgtgtgtgtgtgtgagagagagagagagagagattgtgcattgtacggtgaagagcaatagaaatcattataaggcattcctgtgctacagtcttggtgggtcaggcttacttatagaagctgtgagaaggatggggctatgggctttaactcagttctgacaatctgtcactcccagaacctgaggcaggctggacctatagacttccacctcctcttcctcctgccctgaaccgtccagggactcagaggaggtcagacaggtgggactcccagaatagtgacctcctctgccacttgcagcctatgtcgggctcctcttatagagccacccccttgcttatgctgtagtgttcctttgttctggccatagttttcctgggcctgtgtcagttgagtgcgtccagatgcagctgggttgagactcaaagccctgaagataccgcaaggggagtgctcctgtgtgcagttgctctgacctgcacagcaggtcggagtggccgccggtccccggctgccagctgtttacctggccggccttgcaaaggctcttcagggccaggccccagccggtgaatcactgaaactgatccccgtggccactgtgaagtacgggactggaggtctccggaggagatggcagctctaataaaaacaggctgccaaa

SEQ ID NO: 131663 - DNA, 1093 bp, Homo sapiens
cctccacctcccgggttcaagcaattcttctgcctcagccttccaagtagctgggattacagacacctgccaccaggccagacgaattttttggatttttagtagaaatggggtttcaccatgttggccaggctggtcttgaactcctgacctcaggtaatccacctgccttcacctcccaaagtgttgggattacaggcgtgagccacgcccacccacccccttcacaccccaccttgtttttttctttttagtagagatggggttttaccgtgttggccaggctggtcttgaactcctgatctcaagtgatccgcttgcctcggcctcccaaagtgctgggattactggtgtgagccaccacgcttggcctcttccctcccttcttgctaactttgaagctcagctccttgtccaagagcctttctgtccaggtgttttcatggtgcctgtgccttctgctggtttggagtgagcggtttccacagcatcctcccatcagccatgcattcctcagggtcaggcgcaacatgctcttcatatctgctccctggcacttggccttcaaaccaggaattcactgcacctagcctgatccattgacctgggcccagtataggccctcccatgttgggaggccatggggtgttaaggttaatgctgggccacacatgactgtgatgagtccctttctctctgctgaagaacgtgtttccatgggggacaggggcagttaagcctgggttctgttgggcgctgctgcttgggtgggtccagtctgccccatgtggggtctgcattctatgccaagtgttggcaggttctgccaggtagagctcttcagtatggaagcacttccctgtgctcagcctctccccgactgtgcacatttccttctcttctgctggggaaatggaaaacagctgaccactgattccttgaaatcacctactcagacactccagggtctgtgtgggattaagtcgtccgcagtctttccctcccttaatctcttctaaccttcctcgaaagtgccgtttcccaccccattttaatcatgccctttgctctcgcctggacatctccaggggct

SEQ ID NO: 131664 - DNA, 1690 bp, Homo sapiens
tcctggagctgcaggctgtatgtgtgggaggtgcacagcagtggcttggccgccccaacgcgcctacagcccgctctggggacagccgtcttttggcagagtctgcctctgcagtggtggcagctggcccaggcagacctcctctctgtccggttagtcagcgtctggtggccaagggcagagtggagcctgtgtttccgacaggccagctgcccctcagagtgaggcagcgccgtgattctgagggtgatgctggcgttcgcccctcaaccctgtcccccacaaggagattacggacaaggcagcatttctaataagcagcctctgcttgccccgtagcagatgaaagactgcgtgtaagagtgggtaattttgggttttcctgatgaaagtagttgacatttgtgctgagacctcatgcgctctgcagcgctgcctttcatctctgctctcaaagccctgctcatctctgccatgactcgggggcggcctgcgccaccggaattcagttgggccagtggtgaaatatagaggaaatggtggaatgacccctgaaggcagtggatgggggagtggagacaagtcctgactttcctggtggaggggatgttcctgggggtgtggaactgtgtatcggcccatgcagcacagccagggaaagagtgtggatcttggagcttggtatggctggctagattggaaaggcagctcctccacggacttgctcggtgaatggagggcatcctttctcttccctgatctgtgtcctcatttgtcagtgggaataatagaataacattactaccaacgacgatggctttcacaactggaaccactaggccctcaggaatgtttactggcttctagtctcattgataaactgaagccattgtgccatagctctagagaactggcactaggggcttgcatgattcatctgagttccccagacaatgctggcacatagtaggccctccataaagtaagaagggacactttgctcctgacatccatacagctcctctagctttgcagagaaagccctagagagaaagaatgtgaaggaacaaagggtcaggttaggttgtgcaacctttctgatatgcatttgtaatgcagtgagcaaatgcacaagccttgagtcgctgcattcttttctaaccacccaagagataagttgaacccccactcgtagcaacctggccacttgtctgtttagtcagccctggaatacctccactgacggggcactcactaccactgaaagatggtgtgcagaattctaatgttcttcctctcgcggggtcgtgggggctttcttccagttctctgggttctgatcgttggggctgtcctgacacccttcttcagatgaccgctgtcaggttggtgaaggcagtgcgcgttgggccttccctccctagagatgtgattgcacgtcgggtaccaggagcctggccagccctcagcttctgctaaccagggagcagtgaagcccggtttacttttgttggcttgtttattttctaatgtcacctgcctctgcactttaagtagtatttgggctgttatggagtgtgcacattctaacacagcaccttgtcagctggctgagaagctgaaaattctcggcattcctccttgatgtcaattacttcaaggagcaggaaggtgacttcttttaacaagt

SEQ ID NO: 131665 - DNA, 2202 bp, Homo sapiens
aattctttatttctttttccaagatacccacccccccccccaccaaggagggctaggacaagtgacaaaagtcaccccagatcacagccaaatgggtagagctaggaatccgaagtaggtgatgaagcttgatttttcaagatgctgcaacccctctcccccatatgctacattaaatatctggacctattttaagtgggttcttttctggggtaatgaggttctcttctgcctcagttttccatggctgcagagctcctgctgttccttctgcctagttcactcttctttgccttgactgcacctctctgagctaccttcctacctccatccttgcattcattaggggtttctttatgtgtccagctcactgtgggacccaggactccttgaagagggagatcttgctcatccatctgtgtcccccactctactgccaacacagtggtaggaagggaaggcggcaggcttaggcgaggtcctgcaggctggacaggatctgtcaccattacttagcccaggcccatctctttacttccagaccaactggtgtcaccataatgccttctggcaatttgaagattctggcaacctcttaccggatgcagctggcaggataatccctgtgcattagccactttcagaggtatctgggcccccaaaagagtcacgggagtcccagacatgaaggagcattagtggccatctccccaccttgctgtatcagcaaaactgctaagccctgacccatattttgggcagtgctcaccctatctcattttatcttactgtatatctcgtttgtatcattttattaggtatcttattttatctcattatatggtaatctcatttgctgggtagaccagtgaggagggctgggacaagtgactggaattgcccaaggtcacagacaagtgaggtttagagttaggactccgaagcaggtggcggagtcaccgttgagttcatcatagcgatgctggctgcctcaaagtactgttttagttaatgctcacaagcaactctgcgaagcagacgggccattcatttgtgcttcacagtgtgggaaactgagtcagagcaggttcatgtcacacagctgataaatgacaaagccagatgtgaagcctgtgagttggattccaacattcatctttgatgaagcgttcaggttggggcctggtgtgggacatgctcagaggaggacgaggaggatgatttgggggaggcctcagaaggcgttcctggtctgagtgtgctgctgtcactgccttggtttgggtccccgcttctgagcaggatcttctattggcagagggttcaatgcagtgggtgccatgaaggaagatgtctccccaacagcatcacagtctcagggactgttcacatcacattaaaagcgctgagactctggcttttggtgaaaacggctattttgtcttgttccacgggagctgggaagaggagactaaacacaggagcctccccctaacccaggggcacatggagaaggaggaaggcagcccatgctggggagcaaaagggagagaaggcgagggccagagccctgggaagtgtcagatcctggtgtgccgcgcttctcccaggttgtataatcagctgtcacttcagcatttccctgcatcagccttcccaagtacagattgaacattaaacaaacagtgacggctttataaatatttaactcccactgtttaggaattgctcggggcaggagacaaaataagagttcctggctgtctgctccatgccccctctggcatggtgttggaggccgggggtcagagatttggggagtggtgggcagcagctattctcttcttcctttccagggggatgtgtttggggacacatgtctgtgtgttcatggagctgttagggcctcttctagaagccaccagtttgcgttttcatacagtggctgggatccatcattgctggtgttattccttcacatcagagcaaacttcttcctttcttttttatatatagcagctttattgagatataattcacatataattcacctgaaactcacccatttaaggtatacaacacaattttttttgtttgtttgtttctttgagacagagtcttgctctgtgacccaggctggagtgcagtggtgccatcttggctcactgcaacctccgcctcccgggttcaggctattctgct

SEQ ID NO: 131666 - DNA, 1043 bp, Homo sapiens
cacgcccgactaattttttgtatttttagtggagatggggtttcgccgtgttagccaggatggtcttgatctcctgacctcgtgatccgcccacctcggcctcccaaagtgctgggattacaggtgtgaaccaccgcaccagaccccaacttttgtatttttagtagagatggggttttgccacgttgcccagactggtcttgaactcctggccttaagcgatccacccacctcggcctcccttagtgctgggattataggcaggagccacggtgctcggccaacacaattgttcttaatatattcatggagttgtgcaaccatcaccacaatcaatttgagagcattttgatcaccccaaaaagaaatcgtttttattagcagtcacctctttattcccacaattctctgcgtgctaagaaattgttgagctacttgtactacaaatatacctatcctggaatggtcttttgtgcctggcttctttcacttggtgtaatgttttcaaggtttatctgtgttgtagcatagatcagcatgtcatttctccttagggctgaatactgttccctagcacaagtatattgcatttttaaaaatctactcatctgttgatgaacatttggggacagcaaagctctagttgaaaaatcaagatgaaaaatcaaaaaaatatagttgaaaaaatcaaaaaaatctagttgaaaaatccagcatcatgtgattaaggccaaactcaacttcacaaaagagagcctctactattttgggaaagatctagaaggttatctgtaagcatatggtggatgttacaatgtgttcagtggacacgccattcagcttttattcagcacttaccatatggtgggcactatggtaggattcattaattaatttattgaaaataattattgagattatatagtcttgtgaaaagatttatcagaggctgttctgtgaattttagaggttttttgtttttgttttttttttgaaatggagttttacttttgttgcccaggctggagtgcagtggtgccatc

SEQ ID NO: 131667 - DNA, 1691 bp, Homo sapiens
gcccgtttctggtctcattgcttttgttcatgtactttcctcctgggttgctcttccttttctctctgacctgtcaaaaagccccattgtaagcaacatttaaatgctacctcttccatgaagcccttttggatgcctcttagggggatgagttctttccatcctagcactgcttgctgcatggtccaggatctgtggggcctgtcttctttaccactttgctcacttcatgaatgtgggggtgtatgaagagtatgatgaaattagaggctatgttctggagtcagactgatcagtactgggattctggccataccccctccttagctgggtgactttaggcaactgactgtaccatcctgaaagtcatctgtaagccgtgctgaccccccaaccacaggacacttgtgcccgctgcaggtgctctgtcagcagtgacttctcactacctggcatcctctgaattcacgagcagtttgaagaatgagcaaatactgagcaaagctcataggattaaatacacacagacctgtgtaagttaacaccaagctaagggttaaatactttacaaaaattctcagtgcggttggtgggtgagaagggctgtcgtcccctctggctgccttgccaagctggtagaggggccatctcccactacctactgacaaagattctttgcttgacccaattacccaatttaatcagacacttaagtcttttcctaggcccatctgtgtacttcctgtaaaatctagttttagcaaaaaactctgctgagtcagtttggtaaggaccaccggccgtcaatatcttccatatctgatagatagggttcctcatcttctaccaccctccagatgatgtctggtcaccctggcctgcctttagcaagaatcttgataggttgatttaaccagaatcccccttactcctgatgttgcctgttagtaattttctatcctctgacccccaccctgcttcttggctgtgaatttccacttgctcaggctgtattgagttgagccctatctttctcctacactgcaaattcccattgccgtggtccctatacctatcaggatggtcctgaattgtcttctttatcatctgctctgctctgccagagcttaagcccaggcagctgagttaaaagtgtgaccaaatggaccatcttgtccctgaaaattgggacctaagctcgattccgagatttaatcatggcagaggagtttactctgctaaccaccatcaccccaccctatcccccagaggggtgcggtgagtaagggggtggcaactggttgtttccaatctcccatctctctctggccctcctctgtctctggcctcccttctccctttgaaagggacacagtgctgctcacagcctgtcctgctgcggtggctgcagagaggggctgagaataagcctgtgtccgaggcagccctccaaatacagcagggctgggttgacctttaaatagatgggctctgggccactcagttcctggaagtttgaagaaagtcagcctttcaagtgatgcgacttccaacctcaggaaagatcgctgtgtttgtaaagggtataatttactgttgcttttgcacttcatgatatgcggctgcacagccagtgggagccagcatgccagaattaggaggggaaaatcctcaagtattttaatataccc

SEQ ID NO: 131668 - DNA, 1187 bp, Homo sapiens
ttttgagacagggtcttgctctgtcacccaggctggagttcagtggtgccgtcactgcagcctcaacctcccaggctcaagggatcctccccttcagcgtccctagtagctgggactacaggtgcgctccaccacacccagctagtttttgaatttttttgtagtgatggggtttcactatgttgcccacgctggtctcaaactcctgggctcaagccatctgcctaccttagcctcataaagtgctggaattgcaggtgtgagccactgcacctggccaagaacttggtgtttcttatttccaagcttatctcctctgttatttgctcccagggagaccccttttccatttatgtttccagggtgctggggggaagtgattgccctcatctcttttgcccagccaccaaacccagtgcagactctgctgaatgcaggccccatctctgtattttacttattccatttcctgtcttgaaggtgggggcactatgtttatctctaggaccctgactggctcatcattgaaagcttattttgtgcaaagcattgttctgagcactgtgtgtgtatgattctacttcatcctctgtaaccctagcagtccggtcaaatagtatcattttatagacaaggcaactgaggcacagagcagctcagcagcttgcccagatcacacagctggaaagtggtagagctggaatctggatgggtgctggcagcctggcctcagagtcggtgctaaccactgagcggcactgccacccaacggatgggagcctgcaggatgaggccatgggaattgatttcactcagcgcgagccaagcagaactcccgtccagacctctgtccaccaccctaataaagccagtgtttacacaggctggaggtgctcatcagatgtttttgccaatccccaaatacggccagggccagaaagtgagaggggtgcctattatgtaaggccctgcggctggtccccagacaatgccacttcctcgcttggcgctgtgtgactgcataacaacgggttactcatttcctctggaaaacttcacagggcctctttgccccatttcctcctcccaccccatcctcaggcttcctctgttgaattttctccagattcctgggaacaccaccatggagggcctggcctttggcggtggacagtctgtggctgggt

SEQ ID NO: 131669 - DNA, 1149 bp, Homo sapiens
cagtgggtggtgtggcccaaagattgagaatcttgtcaggggtggccacgtgagggtggaagtggtttgaatgaggaatggtcttgaggtaagagttggacaaacagtgtcttctctctctctctcttttttttttttttttttttttttacttttttttgagatggagttttgctctttttgcccaggccagagtgcaatggcgcgatcttggctcaccacaacctccgcgtcccaggttcaagtgattctcttgcctcagcctcccgagtagctgggattacagacatgcaccacccacgcccggctaattttgtatttttaggagagatggggtttctccatgttggtcgggctggtctccaactcccgacctcaggtgttctgcctgccttggcctcccaaagtgctgggattataggcgtgagccaccccacctggtcgacagtgtcttctctaagcagaactgtagccctgaagcgcccaggctagaactctctattgaatgaggatcactccattgtgccagctgctctcatattgctttgatggcctttctcagaaaggagaaaggtggtgctgggtgtggctttggcttcctatggccgccccaatgctggtctgacactttctgaatctggtttgtggttggatctgtgcatcctaccgctccactccatgtcctggccttggagaaatcatttccctcccgccgtgattgttcaccttcaaaggtcaacaaaggcagtaggcactgctgagctcttgcagccttcagggctgagctgcttcctctcctgcttccagtgaggggttgcttgagggtgcctttaggaaggaacctcacccctaatgtaacttgagcaggtctttgctctaaactcttcgctgggaacataccctcccgtgggacttggcatggcacccacctctgcagagccacctgtgccacagaataacctcttctccctagacacactgtgtgtccttggttggattctctagatgggagggaccggctgaagcataactgtgtatgttcacatatgtgccttggaagagttttatacaggaaaggatttgtaaatcagaaaaatgaatgctggtatctaatttcctgtccccgttttaagtccagaccaagtcacc

SEQ ID NO: 131670 - DNA, 1055 bp, Homo sapiens
cgtgtggcggaatgcatgctcacacagggaagttggttgagcgtctcctttgagcagtccttcctctggtgaggtgcacaggcgggcatcatgcccatttcatagatgaggaaactgaggctgagagggatgctgcaatttaggacttctgggtgatatcacagaagcctcattctcttttgtggcatgtaccttctctatttgggaagttaaattggactatggggattggaccaaggggtcttcttgcttccgctttctctaggccaaggctttgcagttatggaggaagaaagagctggggtctgtcttggcaaccctgtgactcttctcccctatcctcacctgccttctcacttgaccaacatattttaagggctccatgtacaaaggtggggctgtggccctttcccaaccagcaccttggccctgtaccctgatatgggatggttaaggcacacaggcttcatggatgggggcctacgaccgcagatggagcagaggtggacagggtatggtccggcaggtggaggtgctggagaaaagccgcgttaggcagcacgggagccaggtgcggggtctctcaaagcctcgagtccctggcagtgctgtgctctgtgaggactgcttttgactgcagggcactgacactcataccttttgcttctgcagctgaccatactccctggagccttctcccgaggtgcgcgggtgaccttggcacatacagccatcatgatggtactttaagtggaggctgaatcatctcccctttgagctgcttggcacgtggctcccttggtgttccccttttactgccaggacactgagatttggagaggtaagtggcttacctgaggccatgtgctaacagagaagatgaagagatgattgaaacaggcctaagaccagacctaagggtctgtacattttccacatactttccatatctttagaggcctgaccaaagcagatcttttcctttcttctaggtaagtccaaaggcacctgcctgctgggcccactgttttctaactttcctaactttctgatcc

SEQ ID NO: 131671 - DNA, 1061 bp, Homo sapiens
tcattctggatgttggcagaatttgtttccttgaggttgtagggctgagatcccgttttcttgctggctgtccagatgcattgagcttctggaagcctcctcgctaggcttgtggcctcctctctccattttcaagtccagcaatggtgggtccagttccttttaggatttaaatcttttctccctctttcttttcacctctgtgatctcagctagaaaagattatctaattttaaggattcatgtgattggactggggccaccctgataatccagaataatccctacttcaaggtccttaggtttaatcacatctaggaagttctattgccatgggaggcaacatattcacaggttccaggaaattccgacatgggcatctctttgattggaatgaggggtggcaggtattctgacacagtacctcagaagggttgctgtgatgatgaagtgaatggagacacgtaaagcgcttaaaatattatgtagagccatgtgaatttggcagcattgaattgttgacctataaaaggtcaacttaatagtatctggtctatagtaaatcttcagtaaatgtttgctgtcattactctagtggtagaaatgtcatgctttatttagccagtttgctattgttgggcattactttttaaagagttattattttgttattatagtatatatgtgaacaccgtgatcatcatgcctttgcaaattttattctgatttagggcaatgcatgtctttccaggccacactcagtctcctgctctggtgccagtgtctctgtggcctgaggggcccctctttcttgcagagcccctcatccagcaccagctcagctctgggccatgtgtgtggggtgggacttttctcttttgggaagtgggccatgcctctccttcctgagaccatcccctttggcttcctcggggcccttggctctttgaaccagcctgcagggcaccacacctgtgggcccatttttgtcaggaaacgactcccttcccaagggcaccctgagtcccaggtccccaggcccacagatgttgggccctcag

SEQ ID NO: 131672 - DNA, 1086 bp, Homo sapiens
actgtgattattattccttaggatttgagaaataaaatctgaggagggagcaggacctgcctcagggcctcctctccaagttgagtgacccatcttcccaggtctccttttgttctgtcttgagcctctctcctgaggtcctgaaagaagagaatgtgctgttgtagggggcctggaaatgtcccatggaccatctcgtgactcagtaagatgatgtgtgtcctctggggacagaaggaggtcctgcacagagtgttcctgcccgttgatgccctccccagatcctaacgcgaagtctgacacatagtagcctcccggtaatcttaataagcaaaaggacacatttctcaagtgatcttagcaccatttcatgcaatcaattccagcccagccctttattctggccagccctggtgggtccattagctgcaaaaattagtcgtgctcagttttaatgcaaatgactaagtattactttattgaattgattaataaagaagctctctttgtatgatatcaagaccatgaagaaattgcaaagacataggtagggtctacagcagagtttctcagccttggcgctgttcatattttgggtcagatgatttgttgtgggggctgtcctatgtattgtaggatgttgctcggcatctctggcctctacccactggatgccagtagctctgtcagtcgcaaccccagcttccagttgggacaacctaaagtgtttccagacattgccacatgttcttttgtggtggtgttggtggtggtgcgtacatatgtgtgtgtaaaaatctccctttgttgagaaccactaatctagagaccacctaattagggctgacgtgggctcttccacagagccttctccttaaagacagataggttgatggacagttggatttagggaaaagaaaactgagttgagggtttaaagtgaatttcatccccaatgtggaagatgagcgttccgttcctggctgtaggatgtggagcatgttactccacatgtgggagaaaaaaatcatcccatctacttcaggacttttgtgtgattaaagaggcaagatagtctagtgcttt

SEQ ID NO: 131673 - DNA, 1050 bp, Homo sapiens
gtgatttaaggaagccccaggttcaatttctggttctgccacttgctagccatggtgagaccttgcccagctttcatactttcaggttctttgtctgtaaaatgggaacaataagagtactgacctcaccgggctgttgtgctactggctgtgctgcctgaatgggccctcctttatttgaatccctctgccacagttgtcccattttttttttttttaaatggtgacccaagttccattatggacgatcaggcattcaggggaaggagggatccaaagcagagacaaaagcagccagccagctcatcccctctgcagctgataccgaggaggaggatgccagtgggaagaagcgtggccatatggctggcaggatgcctcactggtaacagtcagcccggcccctttgaagtggttttaagaccaatttggtaacttgatttggaaagtggtatcgatgactccgagggcgcaggctgctcattagctgctgtctgggcccggcaaattggtttaagtggaatgaaattggttccttccctccccgtgctcatggctgaggtccaggcccgattgtaatgggaacctctcctgggcaaaggacatagaaaagctttccggggagtctgaccctcttttttcatatgtgaattctactttcccctgggggtcaaggcaataggctgataaaacataaaaatgaacctgaagtgggtggggtgagtgtgtgtgtgggaagttggatcagaggagaatgaacaatgaacagtggccgagtgtttttcaagggccagttaaccattcccctgttgagacactgtgcttgatgcattttttttcttttctttctttcttttttattctcccatattacaaacactgctgggaggaacatccgcacatgctttcttggtcacttatgtgagagctcatccaggatttataccctgaggcgacttcactgccgtggaggctaaggaacattttctgtttcataagacgcgatcacattgccctccagaacaatcatgccagtttacactcccactg

SEQ ID NO: 131674 - DNA, 2199 bp, Homo sapiens
acccaaggccatagtaagttccagagtgacttcccgtctgttttattatccctgacaaagggatacagtattgtgcggtggctgtggatggcgtgtagtagtgttttccttctcttgaaaagcagctgctgagtggtggagcacagaggtattccctgagccccagcttgtgcccatggtaggtccagggcgtttgggggaaggagaccgactctaggtggtcccgtctggtttctcaggggagaaaattcatagatccatctcctagctgtcatccaattctgtgtagaaggggaaagccaaggttgccctcagattttgatcttggttcactctgatttctctatgccagactagtagagcttcagggaagcttggtgactatgactggatgaattctgtcccccttaaaaccataggttgaagtcctactcacccatacctcagaacgtgactgtgttcggaaatagggtctctagagaggtacagttaactgagctcacgtggcggggctccaatatggtcagactggtgggtgtccttatcagaagaagagattaagatgacaaaggaggagtgaagaccacgtgtagacacagggaggaggtggccatctacaagcccaggagagaggcctcagaagaaacaactctgaccacaccttgatcctggacttctggctttcagaattgtgaggaaataaacctctgttgtctgagcaacccagcctgtgaaaatttgttgtagcagccctggcggatcaatacagtgaccatgagcaagtcactcaccctctctgaacccccttggtctcagctctaaaaagaagcctgagaatttctgcctcacaggctgtggtaagaggcatcagaaatagccgactttcatcggaggctcactgcgagccagggcctgtttaagccttttccatgtctgaacacacttcatcttcatgtgtagcctttggctggggaggggagatactattgttcccattttacaggtgaggagagtggagcacagagctgttaattaacctgtcccatgttagtcagcaaggaaggggctggtccatatgtggaacttcgtagttgtactctggtgcccacacaccagatcactatgccgtcccagctgttgttacaataagactatgtaggtgaagggcccacccagtagtgcctggcctatgggacacattgaagaccagccccctgtgaccagaacctcccatttgctgcattgagtttggaatgtttgaactccaggagctgtgtgtgtgtgtgtgtgtgtgtgtgtgtgtgtgtgtgtgtgtgtatctgtctgtctccctctctctcctctctcccctaccttccttttcttccctcctgtttttgggagggagctcagcctcccttcactgccactgcccatcagcatcctctccctattcagccacccccaccccccatccctggtattaattgactttggctcctgtcctggagctcagcctggcacccagacctgccgtgctatactaacacctctcacatggttaaaccaatgggggtggcatttagcagatgacgctgaaacccgtgaatctgccctttctcactgggccctcactgctctagagtccccgcctcttttacgaagcggctgtcatggttgatgggtgagtgtcaggccccacccagggacagggaggcccagtgccggctgtggagttacccagaccttacggtaaaaacgcatcaccctgaatgggggccaggccaggcatcggcccaagccggccctgcccagcggctggattctgactcgctgtgccttagtcacaggccagagactcttctgcttccagctgaggctgtcccctgccttccctggcggcccgggttcctggaaaagctgtgtgccagaggacgggagtttccctccaacttaagccattagaaagctcatttattgagcacttactaagtgtcagagactgtgctaggcactttacatgaatcttctcatttaatccttttaataaacttccggggcacatgctcttctaatctcccttttactgatgatgcaggcttgacagtgggaatgctaaccgcagaaagcagctcacctcacttgggtgctactgtgtgccaagtcctggggttagcacccaatagccccgtggcggcatgctgttattactctccctgc

SEQ ID NO: 131675 - DNA, 3276 bp, Homo sapiens
gctcctgtatgccatctgcctgtccagcccttagccacaaagctgttgtgccatgtggggagatgcggccagtttcccaggtgaggctggtcctgcttcaagcgtgggagctccaaccactgctccacgctgcctccactcctgaacctgaaggtggaggagtttcccactgtctcaaataagcaccggggcccaggggtcaccaggctcagatggaatttgcttaaaggactcttgggagaaaagctgattgggggatgggaagagacagctggcagtcacttaggagacagatgtgtcaccagaactaaagactgacctgggaggactgactttcacccaaaagggcctgggctgggaattctcctttatgtctccttccctcacactcaagattcaggtgctcacaaggagcaccttcgagtgaggaggtgtaggagggaggatggctaacagctcagtctgctcagcacttttacagtttataagccatttcacagacattatctcactccattgggcaatcatatgggaatgcaagccactgtcttttcttttcttttttccaaatggagtcctgctgtgtggcccaggctggagtgcagtggtatgatcttggctcactgcaacctccgcctcccggattcaagcaattatcctgcctcagcctcccaagtagctgagattacaggcatgtgccaccatgcctgggtaatttttgtattcttagtagagatggggtttcaccatgttggccagactggtctcgaactcttgacctcatgatccacctgcctcagcctcccaaagtgctgggattacaggcgtgagccaccataccctgtgcccctgtcttactgaagagggaaccgaggcttccttagagagggagaggaccctcctgggaaactttcatcccacctgctccttctaccccagtgcactgctggagctcaatattcctgaggcaaagctccctgcacagcagtgtccacagccgtgttgttgtcatacccgtgcactagcagagagctcaggggtagggccctgggtaggaaacccagggcaaggccagtgggtagagttgatgcaggcctcaggctgatcaaaaggaagacagcgtcacagcatggatctgacatctgagggacgtcagatcacagaaaggtcttgagattagagctgaatgaatacccctaggagaaactaaaaggcgtgtaacaaaggagtacaatatcaacagcaagcctcccccggtcattacatgcctagactgtgcctgaacctcacatttgtcattgcactggtccttggcactgtccttcaagggaagaactgtttgccctattttgcagactaagaaacacatccaggaagcagctgagctgggaattaagcccagggttgatcccaaagcctcccttctttccatgctgctctgctccttacaaaaacaaaaacagaattcctttttttttttttttaagatggagtctcactctgttgcccaggctggagtgcagtggcatgatctcggcttactgcaacctccaactcctgggttcaagcgattctcctgcctcagcctcccgagtagctgggattacaggtatatgccaccacgctcgactaatgtttgtgtttttagtagagacgaggttttaccacattggccaggctgctctcgaactcctgacctcgtgatctgcctgccttggcctcccaaagtgctgagattacagacgtgagccaccgcgcctggccaaaaaacagaattctttcaatgttgctctaggaaatttatttttaaaaaatgaatttccttctgcaatgcctggctcacgaccgattgtagatcaagaaacagatcttgggcctttgccacccaagcaggttcagaaagactgccctggcctccatgtgcccagggaggccagaggagcccacagtttcactgtctcagcagagctggaggaacctgttaaactgtctaagaagctaataaaaaaatcccagtgagatcatgtctgttaaagccctttgagctccctgagctctgaggctgtcttaacactcactgtctcattgcttactcagcacaaatttccccagggctgcaaagccccttccctgtttccagacccctggtttcctcactcatttcatttgatgcttcctttacatcttgaagatctgccatttttttctttaaacaccctattctagaaagaactggcatgttttgggtacctattttgtgctaagtcttttttctccattggctttatagtcatactttgaaacaaaatgtaatatgtgccctcattttccgatgaggcaacagaggcacagtctggggagctcagcaaggtctcatgttttagaatcacaagctgtgtctgcacctaggttgtgcctgcattttttttttttgagacggagtctcgctctgtggcccaggctggagtgcaaaggcgcgatctcagctcactgcaacctccacctcccaggttcacgccattctcctgcctcagcctcccaagtagctgggactacaggcgcccgccaccacgcctggctaattttttatgtttttagtagagacggggtttcaccatgttggccaggatggtctcgatctcctgccctcgtgatccgcccgccttggcctccgaaagtgctgggattacaggcgtgagccaccgcgtccggcccgtgcctgcatttttcaggtcattctctccagtaggcagaagcttctctgtccttcctcaatgggagaacaaggacctgtctggaatttggctctgaactgatggttatggcacattacttattcttgctttgaaggtcaggctgggcaatctctgtccttttgaattgtcctggagtatcttggccccgatctgctgggagatcaccctactgcaacctccctgtgcaggaatgcttttactggactctgcataaaatgaatgaacagatagatcttgatgttggagatatcagcctgtagattgcctgagaacctgactcaaaccccactcttgtctccatctgcaaaaatcaggctctttggaatacctttatcaggggatggccataaagattgttagaaaaataaattataatagctaacatttatttagtatttagtattatagtaacgtttatttagtatttagtatcagaaaccattctaaagtttgctctggtagcaacagcactatccacacccctcccaaattaaccatgagataaattgaacgggtaatt

SEQ ID NO: 131676 - DNA, 1088 bp, Homo sapiens
ggggtttcactatgttggccaggatggtctcgatctcttgaccttgtgatccacccgcctcggcctcccaacgtgctgggattacaggcatgagccactgcgccaggccaacaagtactcacttctacctgtgggtgtggttcagcgcccccagtgcctctcccaggtgggagttgcctgccttgagcaggtgaacaaactgaggcccagggagtggcttccccaaagtcatacagtgtagaagaaggattcgggcctctgagttcgtggattcctccatgaagcaatgactgagctgctgctctgcaactggtgctcggcttggtcctgggggtctgtgagctctgtaccatgggccagcgctttctgtgtgctgccacatttatcctttgcaccaccctacaagcctgtcctccaggtcctccatcctttattcaaaacatttaggatgaattatgtttgggagtttatcctgttttgagattttagaaacgcaatacagtacgcatatcatactatgtgttatgggctgaattgtgtctctgcaaattcacatgttgaagtcctagtgccaaggacctcagaatatgactggatttgaaggtagggcctttaaagaggtaattaagttagaattaggctattagggtgggccctaagccaactgggctagagtccctgtaagaagaggaaatttggacagagacaccaggatgcgcacacacagagggaaggccatgtgtggacacagtgaaaagacagccatctgcaagccaaagagaggcctcaggagacacccaactgccaacaccttcaacttgatcttctggcctccagaattatgagaaaataaatttctgttgttaaagccacccagtctatactccttttttatggcagccctagcagaccaatataccgtgtgtctggggcagtgcctctaaccaagcccaaaatttctacagggaaatatattaattttcatagtaagtgggataaataaaatccataaatagcttcatggtagttcaggtcaagatactaagtttccaacacacagtataagagttatgcccaagagtctgtaa

SEQ ID NO: 131677 - DNA, 1593 bp, Homo sapiens
aagaaaagaaaaaaaagtcttctgcaggccatgggggacatggtcttcattttataggtgaacagactgagatacaggaggagtcacttgcctagggccaaacagctcgttcctcttcaggccttcccggtcctgggagcgagtgtttctctttgccttgggaggctttgcagcttgtgctgcgcagctgatagcactgcaacccctgaacatgcacacacacacaaggtgcacacaggcatgcgcatggcggggaggtgtgggtgcactttccagcttccctgccgtgcctcgttctgcagggcaaggccgagaaacagcgggcagcctgtgtgatatggggacagacatgttctcagatcttggccatggtttctaattccctggcaccagaagccctgctgggtgatcaaagctgagtgcccctaacagaaagcagagaggcacatgggaatgacaggtggtgaggtgaagggaacacgggcgtggcatcaaacaggatggacagagtggttggttggctgatctaagtgtggaggaggttgtaaactattcatttaaatgaatatatttattcagcacctactataccaaccttagaaaacttcatactttctgtttttttctcttctttttttgtttttcttttcttttctttctttttttttgagacagagtctggctgtgtcgcccaggcaggagtgcagtggcgcgatatccactcactgcaacctccgcctcctgggttcaagtgattgtcctgcctcagccccccgagtaggtgagactacaggtgcacaccgccatgcccagttaattttttgtattttattggagctggggtttcaccgtgttgcccaggctggtctcgaactcctgagctcaggcatccgcctgctttggcctcccaaagtgctgggattacaggcatgagccaccatgcccggcccatgctttctgttttatttgatcccctttttggggaagacagggcaggttgaaaggtctgctttccaggggaggaaactgaggctcagagaggagaaagtcaggcgccagaggtagatgagagccaggatttgacccagtgatttaggattccaagtccaaggctcaaagtgtgacttgacagctgcaatctgggatctggatgtgtgccttctgtggctcggtgactccagaatttttccaacatctggttgtacggaataacaatagtagcacgaatgatcccatagctgacagccacgggagccatgtgccaggcctggttctaagcacatgtcatatttgaactcacagagtcctcctagctcactgtgaagtggatactatcgaaggggagtcttaagggtttcagtcagttgtcacggtcacagcaccaagatgggaacccagcaggtggcctgggtcctcatggtttgctgctgttctgtgctgccccttagcggggtggggtggggtggggtaggtgggctcaggcctgcagagcttctgtgtggctctaagggagaaagagcagaagggagatttgggatgtcttctgagtgctagccacgtgagtgcattttaccaagcgaactgatgactatc

SEQ ID NO: 131678 - DNA, 1106 bp, Homo sapiens
ctttgtggccttctggatggatgcaccacgatagggaaatcagcaagctgaagatagggaaagtgaacacttatcactgaaggcctctgcagggtttgctttgaggtacttccttcctgtcaaccctgttctggagtctgtctccatttttcagacacaaaaactgaggcatagataactgttttctgttttttgtggggagagagtattattgtttcaatttcctggacacttcaaaacatagggtatttctcattatgcaatagtttaattgagcacatactgcaggccaggcatggtgctgcatgcattctggaagtacaggaatgagttggaagtgctctttttccttagagattttttgttctcttgtgtgtgtgtttgggggtggggggggcgggcgggcacgaataggggaggaatttagatgagaaatcagataatcacagccaaggtgcctgcctggggacacagggtgccataggcacacagaagggcccagggtgtggacttagggtggtcaggggaaggaaggagtttgcccagagaagaggcaggagggagacaggaaaggtaagcagaggccagatcctagaaagaccattttgactttgtgctgagggcgatggtctcatgatgcagattttaagcagaggtgagagagggagagattagcatttcagaaagcatggcctctgccataggaagacaagatcagagggaggtccaagctggtggccagtggtgacggggcctgagctggaggagacagggatgcactggagacccaagagagaagtccctgaacgcggtgcacgaagagcctctggggttacaggaaggaaggggtaaaatgttcttttctgtgtccagcttaggccactgaatagattcggtgctgtgtgttgtactaggaaatgcggaggtgatggggattgtttgggctggagtctggaggggctgtgccccaccccaagctgggtgagcatctaaggtaagtgagggctgtgcccaagactgcatgagcaaatccaggttctcctaccagcaagctgccttgaagactctgaggctggaaatgtataaccttgtccgtaccactgagc

SEQ ID NO: 131679 - DNA, 2379 bp, Homo sapiens
aagtcactgggctgagcagcaggcagggagttggggagccccttgccatttatttgctggtcactcacagggtgttcgatggtttcaattggagctgttgaactgtggcctaagtcaattatcactgggttgctcctgcttgagttagatgtgccccaacccagtggcacagtggaatcagctttaaaaatagctgtgcgttgggagaccgaggtggtcggatcacaaggtcaggagttcaagaccagcctgaccaacatggtgcaaccctgtctctactaaaaatacaaaatattagctgggtgtggtggcaggcacctgtaatcccagctactcaagaggctaaggcaggaggatcacttgaacccaggaggcagaggttgcagtaagccgagatcccgctattgcactctaccctgggcaacagtgcaagactctgtctcaaaaaaaataataataaataaatagaaatagctttgccagggttccgctcccagagaagctgatgacataattgctctgggaaggactggggcatctgtgcttcttgaagctcccaggtgatcctaatgtcagccaagtttgagctgtatattaaaaaaaatttttgattaaaacaaatttttagagagagagtctcattctgtcacacaggttggagtgcagtgatgtaatcatagctcactataacctcgaactactggcttcaagcaatcctcccgagtagctaggactacaggttcatgccacaatgtccagttaagtttttatatatgtatatattttttgtagagatggagttttgctatgttgcccaggctggtcttgaactccaagcaatcctcctgccttgacctcccaaagtgccaggattacaggtgtgggccaccatgcctggctgttcagctgcatttagtcatttacctgtgtgccctcccttgccatgtgtgcacacctggtacctgaagacctgggagacgaatcaatgacaggggtacataggaaataagaataatggagagagccaccagttagtgagccgcgactactgccaggagctacactaagtactcaccatgctgctaggaggaaagttctgaaatgtccccattttatggatgtgaatactgaggtcatgggggtaaaataacatgcccaaaggcacagagctggtactgttggagtcagaactagacttaggtcccctgtgattccaaagtgctacctttgccttggccacccctgcttggactttcagtgaggacaactgtgtgttgggattgtggtccacactggaaatcccaactaggtcccacctgatggaaaactaaagttcctcattacttctagtgccagtgtagaagctgacccaagttgcctttttgaaaaaaaaaaaaagaaggccaaacacggtggctcacacctgtaatcccagcactttgggagtctgaggtgggtggatcaacgaggtcaggagatcgagaccatcctggctaacatggtgaaaccccatctctactaaaaatacaaaaaaattagccgggcgtggtggtggatgcctgtagtcccagctactcgggaggctgaggcaggagaatggcgtgaacccgggaggaggagcttgcagtgagccgagatcgcaccactgcactccagcctggggacagagcgagactccgtctcagaaaaaaaaaaaaagaagacatagtttaggaaattcagtatttatttcttggcctctcagcagggctttatattttcgaagggtgggcacttaaattacacagattgggtttttctgttcctctttgaacactgggctgtgtgaggaggaggaggaagaagactgaatcttacagagctgagatgatcagatactgccggatgtgccatggggcctggagagctgacgttgctaatatatcaccccattggtgcctacagtttccattctctgattagagatcatatttctttgacttgatgctcaaatgcctctgagtttgatcctttctcatatcctgaattctatttccagttccccagagttttatcctaattttatccattattgaagttttcccaaaaaaagtcagcatcatcatcatcatcatcatcattattattaatttttcttttgagatggagtctcactctcacccaggctggagggcagtggcacaatcttgattcactgcaacctctttctctcgggttcaagcaattcacctgcttcagccacctgagtagctgggactacaggtgcgcactgctacacggctctaacttttgtattttttagtagagatggggttttaccgtgttggccaggctagtctcaaattcatgacctcaaatgatccacctgcctcggcctcc

SEQ ID NO: 131680 - DNA, 1437 bp, Homo sapiens
gaaatgcccacattcaactcagggggaataaaaggatgggagttagaatttcaacttgcagttgcagaatctcagagttaaaagaaacctcagaggtcatctcttccaacccttctccagagcagctttaattgcctgtgtgggagattcagggccagcagctgcagcttccctttccctgcctctgacttgccaggtgagtttagatgagttccttgctttcttgagtgtttattattattactaataaacaagaggatgaatatttgaagttcttctgctgtcttaaagccctcaaactccactggctactgaaatcttatatgcaagctttatacctgtaacttgttaaaggagagctgctttgataaaaatagggttatagtcctcctgctgaacctcccatctccacctggcccccagaagtcactcaggaggctctcttgaccccctagggatttgtggagtacagttggaaagggtggcactgtgacctatggttataataacaccggcacctacttattgaacattaaccaggcatcaggggcttggcacaggtcatgttcagttctgacagacactttgggggctctgtatccttatccccatatcatatatcaggtctgagcctcagggaggtgctcgttgctctgccacacagaggtcacacaggaaggaagtggtggagactcagttccagcccaggtagctcagcagcaaggcctgtctgcttcagctctgagctttactgcctctttgtgacttgtgaccttcaacctgacacacagcatcccagccttccctggagtttggttttttgagttgtcatcccacctgccatctctgacagccccagtatttagtgttttaggtgctcccagatccacgatgtgtagtaataggctaaaggcatcagtgttctctagaatacttcgtaccacttagcaaatagcctctgtgacgccactggttttgtgattttcccaagcaaactttactatccctttcttattgtcctcatcacttactcttgtttgcacaaagcccaggctctaatttattccccttgtccttaatcctctcatctctttctccaggtatcaccctcagaaataaggatgtgcagtaggtctggtgggcatctgaatgaggatggcccccagggtgtgtacatttcctggggggaaactgaagctggagtctgggcttctcaagtgtgggttctgcccctgaagctgttttctcacaatggaggctccaggtacttcctaagcccccatctgctgcaggagatacctgaagaaactgtggacagttcaaaggttggattatttaagaaatcttggctgggcatggtggttcacacctgtaatcccagcacttttgggaggctgaggtgggcggatcacttgagatcaggagttcgagaccagc

SEQ ID NO: 131681 - DNA, 1152 bp, Homo sapiens
gaggtttcaccatattgtccaggctggtctagaactcgtgaaaacaggtgatttgccctccttagcctcccaaagtgctgggattacaggtgtgaatcaccgcacccggaccattattattataattttttttggagacaaggttttgctttgttgcctaggctggaatgcagtggcagaaacataactcagtgtattcttgaactcctagacttaagctgccttgctaatgtatttacgtgtgtgtctgtgtttgtaggtctcactatgttgcccaggctgatctcaaactcctggcctcaagtgacccttccgccttggcggttgccatttttagcattattgttatttggacattgtgattaatactttacacaaatgacacaatttaacctgtaccaaataatcatctttcatttattgtctaacaataaactcaaccaaatgtgtaagttcatctatctatttgtccatctggtcatcatctaatcacccaacagaagttttaccaaactccttttttatattaggtgctaggtgaacaaagttgaagaaaatgggtctctaactcaatgagctgggattcatccacgcattcaaacgatcacaagtgtttgcacactgctcactacccttgcttgttgatgccagccttgagtccaggctttccatccttgtcagcaaggtgttcccacaaagtagctcccatttgctatgatatgtttgcccttctggtcctggaaccttcatcttggtgacacaaggcctgagcatctgtcatataaacctttgcgatgcaggctgtgttctctaggaaacagacgctaagatgtagattagcaagtaggatgtttattatgggattcctttgggatcaacagctgtgaaactgaaggagaagaaaccatagttgggcagagggagaagtggagctgtaacaatgtcccaacaaaggccaatgccagaggagcctgggagctagactgatccttcagaattgtcctgaattgaggtgagggttgatcagtcatttcatgtgcccccgaccccaccacccaaaggatgcctaatcttgaacaaggtgattgtattcggccaaggcagttcccagagagggctgatagctgatggtcatctgccagcactttagta

SEQ ID NO: 131682 - DNA, 1741 bp, Homo sapiens
ctctgtcacccaggttggagtgtattggcatgatcatagcccactacagccttgatctcctgggctcaggcgatccttccacctcagcctcccaagtagttagacctacaggtccataccacagcatccggctaatttttaaaatatttttgtagagatggggtctcactgtgctccccaggctggtcttgagctcctggcattaagcgatcttcctgcctcgacctcctgaagcgctgggattataggtgtgaaccactgtgcctggccaaatatctgctttgcttaccattttatccccagtatctagtacataaaagcacacagtattggggggaatggaattacctaagctttacggaagcactgtgagtaattcatttagcaaatatgtatatctattatgttcctatgacatgtcagtcacgattactacccttacggaggttatagtctagggggtttgggctgagcggtggctcaacactgacttcctggaagaggcaacctgcatactgggggcgtgacttcctggacgatgggctctgggccagcgttgggctcagtgtttcctgggttccctagaaggtggcttattgagctggagacttgaatggatatgggatgttttctcagggagggggctctctgttgcagcccacctctgggcgcacctgtccaccataggaaattccctgcttcacttaccttcattgacgtttgaactcccaggagcctggaacttccccaggtgccccattggcttggtgactttacatcattacatcagttgagtaattgaagaatggaggaaccattcttttgagctaagtggaaaaatatattttctcctctgtgagtcaccaaaaactacagcttcttttttttttttttttttttgtttgagacagagtctcgctctgttgcccaggatatagtgcagtggtgcaatcttggttcactgcaattttcaccccctgggttcaagtgattccttgcctcagcctcttgagtaggtgggattacgggcatccaccacaacacccagctaatttttgtatttttagtagagatggggtttcaccatgttggccaggctggtcttgaacttcagacctcaagagatccactgccttgtcctctcaaagtgctgggattatagacgtgagctaccgcgcccaggcttagagcccagcttatacccagttacttagcttctgtgtgtgtgtgtgtttgtaaatgaactattatatttcaggaagttcctagcagggaggatgagatggaatcagtgaattttagatctcaaggagaactagagattgcttggtccaacctctttcctctgcaagagggcccttgtggggaagggactggccaaggctacccaaagagcttggagagaggtgcagggcatgtgaccatgtgcaaagcatttgccagtagagttcggcattttttcctggcgcgttcacctcctgacagggcaccaggaaggtgctgcacagcctggcatgtggtgggtggtgtttatctgcacaagtcacccaagtgatcagaacgcttttacggaaaacaatggctttgatgttctgggtgacaagaccaaagcatgctggcgggaagggaggtttttggggttagagaaatgaaaactatttacatttagggctgacttaataacttaacacctctgaagtgggaggatgtttttgagggaaagttgaatgtaagtgtagta

SEQ ID NO: 131683 - DNA, 1089 bp, Homo sapiens
ggctaatttttgtagttttagcagagacagggtttcaccatcttggccaggctggttttgaactcctgacctcatgatcctcccctctcggcctcccaaagtgttgggattacaggcgtgagccaccgcgcccagccttccaggctggtttcaatcttctggcctcaaacgatcttcctgcctaagcctcccaaagagctgggattacaggtgtgagccactgtgcccggctgagtagctgctttttttttttttttaatcctcgatttacagatgaagaccagagaagctaggctgacttcccatgttgacacagcaactaactggtggggatcagctcagagctgggcagactatgcacttcccaccctgccctgcaccccatgctcggcttgctggatttgatagaatctagcaagcgtgggggccaggctctgctgactccctgtgagaagcagtgtctgtttctgtgtccttttctggggccttctccagagggaaggaacatatcccaaagctggagcttgcactcaggagcttcccaggggaaactgctccactctctgccatctacagctcttgcaggtaccatagtctacctccatgatctatttgcagtgggcgatggtgttttgatgatttccacatcatgaacccaagtgctgttgctgatttcgaagcttgttcactgtctcctgccaagtggccaagggctcctaccctagcccttggtggctgctcctggctgccatctgcccacccagttggccccactgcctgggccacgttctggtggcatccaagaactggtagcagagatggtgattagtcaatgtgtgttataccctgggtctctccatctttccaacagagacctgccttacatgtaggactgcctccccttgttcaggttacctagcccttgtgcaattcaccttctgattggagaaggaagacaatacggccctgcctctcggcctgtagagaggaatggatgatgtgaaactgtggcatgcttgatattctgctggcagagaggagaacagatgttaacacagagcacacctctgccccgaacctcctgggagc

SEQ ID NO: 131684 - DNA, 3243 bp, Homo sapiens
ggcttataatatccagagacaagtgctaaactctgcaaagattctcacttaacaccaggaacaagcctctaagatgagaaactgaggctcagagagctcaagtttgagtacttgttcagggtcctaaaaagcctctttaagtagtagaactgggacaccaacccaggaagcctgagaagagcccaccgtcaaccaagaggctgtgcctctgccctttttgggtaacgaagcaaattcattttgacaataaggctaaaagtgctttcctggtcacaatgcctgaggcgtgtgggaggctgctcactggggagcccagaggcgctgaggacagcatctttctgcgtgcctagctagtcaaggggacttttcagagtaagggggaattcactctgtgctgctgggaactggactctgagtgcaggatgcgttaagcctgcactgaatgggaggaggcgaggactctgaggcttgcagaaccactgcagatctgtccgtgataccaacacatctaaggaaggaatatgacaaccagagtgcctcagagaagacaattatggccaagttgttccttggggagagatgaggaaatcaaagtggggaatacaagccacctgcccgccgttcttgcctgtggggcaaggatgtttcaccagctattccagagttgagagcaaattccccttcagaacttttcagcgttctttattctgagtttgtgctgactaagcttcatgtcattcatgatttggctgccagtgaggatggtgggggggcctgaaaagggaaaagggcaccgtactgtaaatgtatgaatggggttttctgtgggggccacaccggagcatcacagttctttgaaggacaggagagaaggtcagtgcctggatccccaggctaagtaccaggcgctgctttaggatagcctagaagggtggcccctgggcctcattctccacactgtcccaccccttttgaccacctcatctagccatcttgatgatcagttaagataagaatctctagtgaggctacatttttttgtttcctgaataatgcatgatgtccactgaacacatgttactagatgacagtgttgggctcagataaaacttacaacaaaattaatctgatgcagcctccatggctcacatgatccccaccatgtatgaaatgggctgggcacccagggacaggctattctcagaatggggttattgggtgtgtttcttattcctctctacctagtattcttggaagaaggtgaatgaaaatgctctagtaggggagggaaacatgattaatgggtgggggcttatgagtcagaaagacccaaccatcacttctgccctgactgcctgtgtgacttcagaaatgggggatatcaaagcctatctcataggattaaacagtttaatgtgtataaaatgcctaacacagtgcttgccacataagcattgctcattaaatgtcttctcttcttgtgctcctcattcagtgtatagtaaatgtgcagtccttatcttttaaatgaatgaaacatctcattaccaaatctattcaaggtaaacattgatattaatatgtatcctttttgtgtgtttctagaatcctgttacacctgggatttaggcactttcaatctgaaaaaatacatatcctttcagcactctggacggacttgagaactgtccttacgtgacctaaagctggagtattttgagattggagaattaaggtaagcgactttatcttcctgatccttgtgaaaccaaaaatagcttttggagttgacgacctcctgcagcacagcttgggttgtggttcttgacctctcggtgtgtcttcctgtgccgctccaatgtgttcgggaagctggctccccataacctctccccgacctggttctcagagtctagtccacttattcattgtgcctaggaagctctccctctgtccctagtggagggaggagcccaccatctcctagtgaatgcgccacttgtagcagaaggtgcaggatgctccagctgtcttgtgaaaacatgtggagacagccttggggaaaagaggaaaaggtgaggtgagggttatataatcagattgaaacacctttgggacatccagaacatgagctcttcctcctttcccagccaatccgtgcttcctcctttcacctccttgaattctatgctccttccacactaaggctgagggtgcaggaggtaaagggttagaggttaagactgagtgcttcaggtagacttgggttttcttggttttgctacttgcctcattttggacaagtcactcagcctctcaaagccttggtctcctcattagtaaaatagggatggtattagtgcctgcctcatgaagatgttgtttgtgttgagtgagatattggagcaaaacagcttagcaggctgccttgcactgaggaagaaatgctccaaaagggaagagagtttttgcaaattattcctcaattatgccatttagaattccttccatgtatcaggctattttgaagtctttcatttgctgtccccccagcctttcacctatcaccaagtcagcctgggaaacagctgagaatcaccttcccagttgtgcccagccccttacccaaagcagagttgattcccccctcccctggacggcagcgggctagtgaaggcatgtctccactataccatggctactgcactgggttgaaatgtcccttgccccttcccctgcccattccccctattgctggtgaaattgcttagagcaaggactgtcttacacatcacaggatctggcatagtgcctgaccgagggtgaaacaacaaatgaatgagtaattgaaaggagagagaaaaagagatagagaagtaaccaaaagaagaaagtttttaaaggttcagaggaaagaatgaggtcagttgcaattttttttaagtaagatgttggaaagaataaatgacatgatgaaaaggaaactgacatgattcctatcatgaatttgaaagctatgcaagggtggaaaggtgggtgagaagctgtggactggtgagaagacagagaagtcagaactgagagcatagcagagaactgtacttctgttgtgctacatatgtcatcttcatcttttgtattgtgccttaaattttcaaaagcgcatttgcgtttcaaatctgctgtgatagtcagcattcctgtggcatgcagaggtgaagagcatgaggccttgcccttcag

SEQ ID NO: 131685 - DNA, 2526 bp, Homo sapiens
cacttgaaactgggaggcagagttgtagttagccaagattgtgccactgcactccagcctgggcaacagagcaagactctgtctcaaaacacacgtacaaatttttttcttttatttttttaaagacagggtcttagctatgtggcccaggctggcctccaatccctgggcttaagcaatcctcccacctcagtctcctgagtagctagtactataggcacacaccacacacccagccagacttcaattttcccagccacatcatggaccagaagccacttggtctggttgtgaggatgacggaaccttgcccgaggaaatgggcaatgaacaggagcctgtttgtttctccttccagctcctgacctgtctagctcctgaccctctcagtgtcattcttgctcacccctggccctgctccctggatatgcagacaggatgggcttcttccctttagaccttcactttgctcttttggactcctcttctggccttgccttcccctggtgtcatctgctggctccctgcctgatactgccacactggtcatgctggcctcctggcctttggtgacaccgcatcagcaggctcctgcttccctgtcaagggatacaagccagcaccggtctttcgccacaaggtatgtgtgtaaagattgcttcctgtacttggtgtccacaggattttaaagaactcctggcccactcggaactctacgcttgaaacagaaacatcttctcaaaacacctctggtattggcccatttctctattactgtttcttgtggtttcatactgaggtttttggtgcattgcaattgccctggagtttatttttagtaataaagacagagttcaattaatgtcaaaacatgagggtaattgcagaggaaggattagtaagtctaggggaaaatgtgcccaactttttttcttctgataacatctttcactgatcatacaccgtcacacccacagacacggagcttcctccgtgatgtctgcaatgcactaggcccagtcggggagcagtggctgcgccaccacctgaaaacgaaagcatttctgagtctctttcagtccagctcatctagcagccagccacacaggtgaccacccaccgtagctgtcactatgggtgatgattatcattatggttttgaggaaaggctgggctttagaatagtcaattcttatcctctctccggggggatttattctgtctccagaagcagcatttcactttcctgaacatcagctcttctcccctggattgcagggtctaggtcttgttctctgtctgcttccagcttttggcattttgacagcacataggacatgcttggagaacgttttcttgagttaactgaattcaggacactgacttggggctggaaaggcaaagtgaggaagaaagtattcccctttcagaagctccccagtctgccttaagaaacaaaggcagccctgtcatctgcccaggactttacagtttataaagtgatttctcatcctttctcctttcttgtattgcacaaatatcgaacgagaacctgcagtgtgccactgtgcagggtgcctagaataaaggagaaaagccactgtgctttctctgaaggaatcacagggagtgaagctagcttcatggatgccagaatttcacagatgaagggactggaggcttggagcaattgcattgcttgagatcccccctgctcatggatggtggctcccaaatcaggacatgagtcttctgaatcccttaaacctgccctgtgcctgcctgttctcccagcacattctctgtactctcttgtgctgctcctcaccccctctccaactgtctctccttctccaccattgtcctctgcccactcctagtcccttctttcagctctgtttcttctgaaaatgaggatctttctctctacagtgcctcttgtgggacgggttctgctgatgggggctgtgtttgggatctcgcctggaaacacgatctctccaactttccctgggagcagagccttgggtctcactgaacccacctccccagcaccttgtgtggtgactggcaggaggtagccattccctcctgtcctctctgcccttgtccactttcctgttatgagtcagttgctgagataggctatgaggagttaacagagtggataaaaaagagctttgtccttctttaaagccttcaaaatatacagatgtattagtcagggctttccagagaaacaggaccaatagaacatgaagatagatgcgtatccatgtctatatcaatatctaccttgatatttatatctatatctaggagatttatttattataaggtattggctcatgcaattatggacccagaggggtcctgtgatttgccacctgcaggctggagacctaggaaacagctgtcgtgtcacaaagggcagagggctggagaacctgtagtgtagattccagtccagattcgaaggcctgaggaccaggaatgccaagggcaggagaagatcgatgtcccaga

SEQ ID NO: 131686 - DNA, 1034 bp, Homo sapiens
atgtgtctctccctgggcttcatgtgcccttgctggtttctggactgtcctgttctgctcctgtcctcctactgacagcctttcctgctttcctttccctcccatgccactcccactccatacaacctcttcccctgcacactgctcctagaaccccttggttagccccatcagggatgtccctgctttcctgggacccgaggcacacagaatgaggatgaaacagttgacgtatcatgtagtatcccccacctggcttccttctcagccaggcgtcccaaactcaattgtctgcagaggccaggcaggcaacaaaaataagtgatgtgggcctcctgggcagtcaggagggcttggtgcagaactggaagcaccagaggtagcaaggaaccaggagatcaggccagcacctgctctgaatggtcaggcacctccatggttgcatagcaaatcagttgttgagaaatgttttgactatggtccttgtgtaggcccagtataaagggggaaatggccagtctgtggctgctgattatggccctgaaagtctgcaggcccagaatggccagacctggttgttcaaaggaaaactggcaggtgggaagggcggagggccttgccccttcccatttgcctcctgtgcctgacagtgtcaccgtagcaatactttcctggcagcaggactttgtcccataacaatagttgattttagtgtgtagggcttttgttgttgttgtttattccatacttggaaccagctgcgttgtgctactatcagagatgacagcccagcctggagctctgcaaggtcctccaggcttctcagttctgatcattccaccagcagatcccatcaccaaaggggtgtacttgcttcatgcagctgctgcttctcccagacctcattgtcccccttgtgccttttccatgttcaatacaggatttgttttttatctgaaattctacccgttaaaacatttggtatgtttcctcttctcttgtgaggtgtatttctgtatttcctacctttgcat

SEQ ID NO: 131687 - DNA, 1016 bp, Homo sapiens
ctgcgtgctgtctgcaccccgtttggctgcttgcccacaaccatgactgctcctgaggggctcgccagcagcactgtttcccagcctgctgtgcataaaggtgacgcttcgggttttccacagtgaacaatggttcccagagtgggcaggactccctagtgtctgcaagggtgtgtgaccatgcagggtggaaacaaccttgtcaaaataaaccagggcagtgctgaggggggaagtgaggctagctggggggaaatgtgggctgagtgcttcttggggggtttcctctgtaccggtgcccagctgcccaagggtcccagaaggcagaggctgacacacttcctgtgaccctttcagactcgccattggcccccaccagatcaggaatctgttttcccttgttgaccttgagccactcacagagtgggaaaggtttgcctatggaacgaaaacagtcctccttccatgatttcccctttgctcccatgttcatccatgtgggctgctgtaacaaaatcccataaactgggtggtttacaaacaacaaaaatttatttctcatagttctcaaagctaaaagtccaagatcaatgcgctgggagatttggtgtctggtgagaacctgcttcttggttcagtgtcttcttaccgcgtcctcacatggaggaaggggcgagaaagctttctggagcctcttttgtcaaggcactaatcccattcatgaggactcaacactcgtgactggatcgcctcccaaagcccctacctccaaatcccatcaccttgagggttaggatttcaactatgaactttggggagacaccgacattcagactgtagcagctccccagcacaatcctgctcgaccgaattcaccttcctgaccaggcacgtcaacaatctttctgtccctctgatgccagaacgttatgtttctgagggtgaaacttgagtgattaattgacagtattcctcaggaatccttgctgattgctgaatgcataaatgagtgaaag

SEQ ID NO: 131688 - DNA, 1025 bp, Homo sapiens
ttctcagtgcctcagatcaggaggcacctggtgttggcttgtcacattactaatgatgtttacttccatcacttgattaaggtgatgtctgccagatttctctactgtaaagtttctatttttttttctgtgtaatgaataagtatcttgtcaggagatgctttggacctatgtaagtatcttgtttctcatcacactttcaccaaactaattttagcattcgtggataattcttgtctgaaacagttattactacagtgtgtgccaaacagtgattttctacttccatcattactcctacatttgtcaattaaaatgttactataaggaagatattttcttttatattgaaaaaatgcaattttttaaaaatcagtctggactcttggattctcattatattggttataacccatgactataatacattttgtgctcagatttttctagattttacattgggatgcccttcaagttgggttctatgtatttttgccattttactgttgttttttgagcactgccttaccttttgaccccacaagatattctaggctcagtgtacactttgcctggtccagccctggaatcagccattgctgctgtgctatccttgacagaactataacctgaatttaacaaggaggaaatatcaggcaaacacaaatggagtgacattctagttaacaactgatcagcactctttaaaaatgaaagacaaagaatgactgaggaatgagttcagattaaaagagacgaagggacacgctccaactgtaactgcaacgcatgactgcgggctgcgttctgcattggaaaaaagtgttactgatgaaatttgaatatcgtctctagattgagcaactaagcaataatattgtattaaattgctagattgggcaatagtattgtactaaagttaatttcctgacacagttaaataattgtactgtgtatataagatgtcaaaattgagaagttgcaaggctaaatggaatttctcagttttttaaactcttactttg

SEQ ID NO: 131689 - DNA, 3758 bp, Homo sapiens
tgtccacaatcaattggaaaagataagttgtagtaccatttgtatagaattggcccatttttgtaggagcaagacagaacaatatagtgcacatacatatttatctacacatgggagaaattctgtgaagggtatgtacttcctgttaacagacatttctgggaaatgtgtttggaaggtatgagacaccttttactttttgatgtctcctgataatgggaaaacagtaagaatgtgggttgtatgcatgagtgtgattctacacgtgtaggtttaggtttgatgtactcccatccagcttattctcttttgcattttccagcacaggcagtgctgtgcaatgtcttgcccagtggacacccacctaattttcactccacaaaccactgtcctacatctgatccttaacaaagtatgttagttgtagacacaaaggtggcctacatttcatacttgttgacagtaatgctagttgactcatcttacctttgtctgaggaggctggaaattgtttgtcctcagaaactttagggagaaatttattactaagattgtatcattttggtctccccagagaaatgaaaaattagaaattggccatgtgacaatcgttgcatttacctctttaaggagcagtgattctttaagtggtgcttgatttatctaaacccgattaattagtgaacggtcatctgtttctcccaggaatttttaatgatcattaggcttttgtagttactgtgaaattttgtttacgtggatttatttttgtgcaggattgtatacagggcagatgctccttaatttaagaagggagatgtgagaacaaaagtgtcttctcttgagtgagggcctgttatgtgccctgacttgttacaaatatcgactaatgtaaccttctctaccatgtacctttcttccaatttatcaatgaggaaactgatgcaaaaatgtatgttcccacaggctctggtgtgttcactgagttagctccagaaagaactgtccccttctcatgcctgttccctacttcttttgcagctaattctccgaaatggtttctgtcttcagctttctgggctgccccatcacctgtgttgcttctaaatgttagtttcattgctgccttctgggttcctctgcttctctctgacatgatgtctctacggatgcatctctcagtaatgattataatggtggtgatgataataaaaagagaatacacaagtgtttttatcaatccctgaccatgctgggcacaatgctaagcatgtgcaggcatgatgtctttattctgcccactcagctgatgagattgaaggggctccctgcaggttggggcctgaaaaacacagccaggtccatctaggaactagaagctatggtcaggcttacatgcttttttcatatcagtgttcatgtagatgtttaagctcttgcagtaggtttttgcaagctagtgaacgctgccaaattatgctcgccacacaattgcagccacctattcccaggcagtataaatatatggctgaactaacattaatacctatcactgttttatcaagtgacataatcaagataattatgaagtatccaaatattaattttcatagattaaaagcagataaagtattagaaatctgcttatatcattagcagaaacatttttgggggccacagggtaaggaaaagaggggaaaatattgtccttcaacaaaagtaatcatattctagtaagtataataaaagaaatgacaagcttttcagaatttccacgactaaaaattgttttagctgcagctaaaaaagcatcacataacaaaatatctcttgtttaaaatatttgctacaaaaaagtcctattctatatgtcctgcataagaacaagtatctttatataagaaatgtgtttaatagccctctttcattctttttctgaagccctccctgttaaattgcacccaaaggggaaacattaattgaactgtaaagctttttttttttctgtctaaagacattaaagacatataggtggtattaaatgaacctttaactagagctctgtgagttttcaaaatagattttatttttctttaccataggccaacagagattttgagaaacacattgaaggatctgttaacacttgatatacccaataaaagcagtggttgtgccagtgctgatctgtcttgatgtgaatgtgaacaatgggaacctgagctgagcaggtaaataatcatgtagtacagtcaccgtcttcagtgtttgagatgactagcagggtaaaccacgctgtgtctaagatgcagtgttaattctgtttgaagtaaaaatatgcaagtgtggtactggatattttggcacgcaatcttgcgaaatttctcattgatgagattctgacataggaactacatttgagtaagaatcatagctcaatacagcatgatttcaggaaagtcgactaagataaaagtgtttctgaggctgaacagcaagaatcttttgctaagagttagaatagattgacaagaacctaaaatcagaagttgcaattctgctgagatactgcttttcagttctccggtggaagcttcattggacatattgtacatcaagcctctatgtgactgattcctgcctctttatgtcttgttttagattctccatggcagtagctttaggcaacccagttttactgaatgcagcaatggtttcagtgaccattagagtccaattttaggatgatacttctccaaattgttaaaactccctggtgcttttctcttataaactgcaaaatgtcttcatatttcatcccgcttttcagttaatgctagggtgacagaaactggacctctcccaagacatgtgacagagtaatacagcagccaacttcttcgccaaattaaagttttacaagatttaacctgtcatcaagacctgggattttggtggtgagtcatcttcaaaagccaagttcggtccctggtttgccttcttttccgcacaagaacaagggttttgatggctctggtctccaggaccatctgtggctttctattagcaataatcgcacctcggtgaaacctcattggctacgatactgccactgcgcaaagctcatggctttctttaatagcaaatggcctctgacttttaagaagccatgtggctacccctcagcagacttaggagaggtcttggctattatttgttgttttataaggtgtcatcattgagcatctactctggatgaggctctgtgctgggcttgaggggtacagggaagtttcacatgtcccgtcttgttgaatcacacacacttgatctcactacaacagcagaaaacaagttaaagttccccaggggttgacacatttgcctgccgtgtttattgctgctgtgatttctgcagcatggtccaaagaaggcaatcagtcaacagtgaatgggttgagattttgtgattttggtttaggagtcttaatctctagaataaaatctaatgaaagggtggggctatgtttttctcttgccttgacttctttgactctatttgtaaattccaaatttacccaggcctctggctcattctgtcttaaggtgcggggacctctaaaatgtagatggcaacaatctttagactatatgtgtcttgatggtagggcaatcaaattgatttcctcagcatatacgagtcatgttttgtaagcatggtgggtacttagtcaatgtctcaatcagatttgcttctg

SEQ ID NO: 131690 - DNA, 1424 bp, Homo sapiens
tcactgtcaaataaagtacttatttctgataagctctttggcttctgtgaagccgcctggccgtgtctggccgtgggcggtgctgataatgaaccgaacagagaacacagacttggcggggaaggtggggacccagtgggtagaaagaatgggctttttagaccatttcaaagtaacaagaaagctttgagagtgcttagtgatgtctgctaccacattcatttcctctgtttccattgaaattgaagttctagatggactgaacctgactaagaaaagggaatgtggacaggaaagctaatgacaaatgcaactggcttatttctggagtgctttgtactctcagagtcttgtgccctgaactttcttcatctggactctaggggcacttaagcaattagcatgccacaagctgggtgctgtggaaagatcatagactttagaaactgtccaagaaactagtgggactccacaccttgtgagttgtgtatccttgtcaagtttaatttaccatgttgagcctcagtttcctcacctaagagaaagaaaagagaaatagatttatttatttatttatttatttatttatttatttattatttatttatttttgagacagggtttcactctgttgcccaggctggagtacagtggtgcgatctcagctaactgcaacctctggtatctgggttcaagcgattctcgtgcctcagcctcctgagtaactgggattgcaggcgtgcaccaacacatcaggctactttttgtatttttagtagagactggttttcactatgttgaccaggctggtcttaaactcctggcctcatgtgatctgcccatctcggcctcccaaaatgctgggattacaagtatgagccactgtgcctgtctgagaagtgattgtttagttagagtaactctagatgacataacaaataaacctcagtattctagtagctcaaagacacctctttctaagtcagataatagtttgaagctgggcgcagtggctcacgtctgtaaccccagcactttgggaggccaaggtggtagatcacgaggtcaagaaatcgagaccatcctggccaacatggtgaaaccctgtctctactaaaaacaccaaaattaactggctgtggtggcatgcgcctgtagattcagctattcgggaggctgaggcaggagaatcgcttgaacctgggaggcggaggttgcagtgagccaagatcacgccactgcactccagcctggtgactgagcaagactttgtctcaaaaaaaaaaaaaaaaaaaggtttgagaagggttttcctggtcattaggtggcttttcttcattctgtgatctagagacccaggtctcttccatgttgttgttctgccatccctgggaccttgaagttactccaactggcagcggaga

SEQ ID NO: 131691 - DNA, 1080 bp, Homo sapiens
ggacaggatgcaaattgttcaaatggcatgatgatattataaggaaagaaaaagatgttataaaaggtcacataaagtcacccacaggtcagcagtcatgtcatgattagctgctctgtgccagacacaggctggaaattggtagatgctctccccaggaagtgggcagcagcccctttgtgcctctgtcacctctgttaggctcctggaagcccccttcattgctgcatgtaatgacatcttcgtcaccacatgtaacagcttctttaccactatgtgtaatgccattctgtgtgcttattgggctaaacaatcacagaggaaaagagtgctggagaaatgccagggagataggtaccgaaacgttccagatggaaagtctcgtcttcaggtggccgtagcagtaaatgtcagggtcaaacagggggtgtattcttgggagagcttcagctcgtctgtgacctagtgtccagccagcttcctgggaaggaggctgcatcctgacattgaagccctgtgtgctaggatgagtgtgttacgcagagccttacaaatgagaaaatcttgcgtcctcaggacaggcagttagtgttgctgtctggaatacactggctacctccctcctccccccaccacttaaaattccctgaatccgacagtggtagggaaagggctgatcctggagaagattgttccttgataatcctagtatgattcataatggttgcagcagatgagccgcgaggtttgtggctcagtctgcagctaaggaaggctcttccctggggaggtgtgtccagcttcccggaaagacctcagctgtctagctggtctgggctgcccagttcttagcagtgcatcagcaatgagcagccgctgaccatcaggcagcgtttcccacctgccagagaacgtcagagccactgcgtctggaccagctgaaggcagccacggtgcccaggatgctgctgctgcctccaaggaaaagaactctgaaaatgaggaattacagcctggtggttttgttttatgttaattttttacatctgggagataatggaaaaaattaaaaattgctat

SEQ ID NO: 131692 - DNA, 1054 bp, Homo sapiens
gcctcgggggccagctgctgggctggcagcttctctgaggagctgtttcttgccctctttgtacccctgtctctcaactacctgtcaggcaggtaataatcccaccatcacctgatgtacccagaggagaaggcaggaggcctgcgcaatgtgcacagaacaaacactggcaaggtgcctgagagccctgcaccaggcaccttcagccctcaggggagagagtctcctgtccagctcaccccaggcacccttctccaaatgcccagtcttgcaccattcccagaccatttgggccacatctgaaagaatttgccatactgcctgcctttgattagatgttagggaagatttaaattcgtgcagaatctcaatacagctcccttcctgttggaaccatgtgacagactatttccaaggctgtttcttacaagaggatctgccttactaagtcagagcattgcaataattaacgttttgaaagctccctgatttccaaagcattttcacatacattagctcacttaaggtctcccaaaccctgtgaatggagcattctttttagccccattttacaggtgaggcaactgaggccaagagagcttgagtagctcccccagtggcttaatgtagaataagtatcagagcagagactggagcccagatcttccttatgagaatccagcctcctttttttttttttcttttgagacagactcttgctctgttgtccaggccggagtgcaatgttgtgatctcagctcactgcaacctccgcctccagggttcaagtgattctcctgccagagtagctgggattacaggtgtgcactaccacacccagctaatttttgcaattttagtagagatgaggtttcaccatgttggccaggctggtctcaaactcctgacctcaagtgatccatctgcctcagcctcccaaagtgctgggattacaggcgtgagccaccgcacccagtcccagccttctttctgattcactcttgttttgtagttgtggacatttaagaagactttttatttttttatttgtatt

SEQ ID NO: 131693 - DNA, 1138 bp, Homo sapiens
aaagaataggttcctctggttttgtaaccagcttttgtcatttaatgtaagttgaattttttttctgttagggaatttttctgcaggaaaatattttaaggccacctggtatgttataatacaaacatgttatatccatttgacagttgaggagctggaagtgctgagatgcaacataagttccccaaaattatgctacttgaggcacagctgacatccagaagcttctctgggaaggcttttggagttccccaaggcagagtcaacaagaacataagtttcttaagaacagggactgtgtgcctcacttactgtcatctccccagcatctgccacaaagtggacattctgttaatagttactgagtgaatagacacaggaagttcagtcttcttttttatctcatttcttgctcaaagctcatctcagcattgaacgtgtctttccacatggcctcctcactagcttctgtacccctcaagtccaggaccatgtcagattgtctttgaatccctcagccccagtcccaggcctgccctagagcaggtgttcagtaaatgactatcgaattgtggaaacagggatctctccatcctggattcaagacagcgccctccctatgaagcttttctgagctctttcacaccaaagttctcccaaccatcgtgttgacagctatctgcctgctgccctcagtccaggagcaacttggacatcagctctgcctgtcacactggggtcggcgcacctggcctgttccaggacagatcacaaggctgagggttaagtaacacctggagtggttaggaggctgggcacctccttgtgaatctcccgggctgcgtggcgggtggcgggtggctggcaggggagggacccttggcactgctgtggctttgtatttgctgccagcggggcctttgatgccccaggggctgctcgcccagccaagggcattgtagaacacaaaagctgcagaaagcagcacaaataaagtgaaagcgacccaggaaactgccagggagcttatcagcctgtttcctgatcataggtatggggtgtagggaggcacggggagcatttctgggcccggtgattgcctgcacgttgccagggcccctggtattgcgtacaaagc

SEQ ID NO: 131694 - DNA, 1047 bp, Homo sapiens
cggcacgtgaatgggcttgagggtgctggcctctggagtaacaagcctctgtaaataatcaagtcacccatatcccagccctgccctgaagcacagtcttcacttggcctgtttaggatcatttcacagattcattgacagggcccagttcctgctagttgactccttggggacggaatcctctattgcttgcaaaaatatgctctgcagtaggctgtgtcttgctaattgagagggattctgagaagtggagcagccctgcctcactagattcagtaagaggaggccttataggtacgttgaatctggcctggtggacaaagcaccctgctgagagctgggcaggtcttcggaaggagatttaatgttcttcagtaggaaacatggtaattcctctctccctctccagatgtctgcaaccaagtcattataacacagaagggaccttgcagccattgtgtctttgtgctcaggtactgtctgagggagggaagggaggcagaaggaaggggagggacggatcagctccatttgctgagccaacctactcagcaccaggtgcccctcctcttggccactggaaggctttctttcttctggccacaatcaaacaccgtttcttctttctgccttggttccctgtgagtcaatgactgttgccgtgggaaatagtagctgcttggcaggggagttcatgaaggttgcagagcacctgctcaggttcttgcctcgcctcccttccccctttcctccctcctcccacctttccttacctggcagctacctaattcttctctttcaaaatacagttcagagaacaatccacaccagctggttggggaatcatccaaagagacaatttctaccctgtgcccacctctcctctagttaacacctttcagtgttccctcccttcctgttgtccttaagttaatgccctaaagtcatggcccttgctcagcctctaaggccctggtgggtgctgcttccccttgtagctgggtgggtttcaggaaatgccccatctggtcatgagagataggcagc

SEQ ID NO: 131695 - DNA, 1284 bp, Homo sapiens
agacagaccaatcaggaggctattgtggtaatccagggtattgcagtaatcctggcctggtggaagcagaggagattgtgagacatgatcagattcagaatatatctcaaaggtaggatttgctggtggattggctatggggtgccgtaagaaatatgatcccgattgttgattatcctgtgcaactacagaatgaagtttccatttattgatatgggccaatcctcagggtgagcaggagtgcctatttgtttttttgtggatagaggtggaattgttatgttagagatgttggtcagacatccaagtggagacagtaaggaggcagctgcatgtacagatccagagtgtccacttggccaggccatggtactcagacatgtgatcaaataccagttgagatgtcacatggagtacgttttgaatgaggttaacatttaaatcagtagactttgaggaaaggacattaccctccacaatgtgaatgggcctcatccaatagttgaaggctttaagagtaaaaagactgaggaaatgggaagtgggaattctgaccccacattgcctttggactcaagccgcagtatcagctcttcctaggggctccagcttgctggcctgccctgcagagtttggacttgccagcccccataatcacacgagccaactccttaaaatctctctctttctgtctctctcttcaacatacacacatcctactgattctgtttttctggaaaatcctaacacatggaagaaagggataaatttggatatccaaaatttatgcaaaaatggatattctgatttgtatttgggacttaagttatttaagccttaaatatgagcgtgatcatcaagagacaattgtgggcagagaggagccagtccatggggccgcacagcacagattaagagattcagaaattatgtgtgtatgtttgtgtgtgttatatgtgtttgggtgtgagtgcttgtgtgtgtgtatgtgtttttgtgcttttgtgtgtgtgtgcttgtgtttgagtgcttctgtgtgttgtttgtgcttgtgtgtttgtgtatgtacatttgtgcttgtgtatttgtatgtgtattgtttacgtgcatgtgtttgtgtgtatatgtttgtgcatgtgtgcatatgtgtgtgtgcttgtatatgtgtgtgttttctgcttgggtgtgtttgtgtgcatatgtttgtgtgtgcttgtgtgtgtttatgcttttgtgtttctgtgtgctttgtgctcgtgtgtgttgagtgcctgtgtgtttgtg

SEQ ID NO: 131696 - DNA, 1305 bp, Homo sapiens
tgacctccacacccagcctcaggcacagagatgtaaagtaacttactcaaaatcacccagctactgacaggcaaatctgggcccagagcccatgctctaatctaaatcattactacctccctgctggtaacaaacaaaacctcagcacagtgcctgcaacacagtaaggactcagtaaatgttaaataaaggtaataatgcttataacaaccatctttgcccccagaaagatccttaccttgaggagatagcaaggatttgagatgttcaatataaaataccaagtatggtgcctgtgcatagttggccatcaatgagtggtggctatttactattatacttgttattttattatactttagcacattgtgttgtacttaaataccacttgtttgccctacttatctttgtccctcctgagggtgcggagtgagccttattcattccagcattcctacaatcttgtacatccatacaattcttgatatgtagttgacatacactactgtaaggtacatgaatgagtaagtagataaaggaatgaacaaatggaccagtggtttgttggggccactctggccagtggtttggggacatgcttcctggagtcttatcccctcttgtcagattcaggtttaggacaacggtacagttgttccattgttcccagataacatatcctatcttaacgtctttgctggggcagcccttggacacaccctgagctcctgccctatcactggccccacttgtaccccttgtgggcaggcaccacggcagcctgctctgaagggagctttcatgtggccgaccaactctactccttgactcctcccttctctcattgaaaaaaaatgtttaaggggacatttctctctcctaaactttttatgttccattgaagacctggaaaacatgttaaataaaaatgctttgccacagctgacctatgtcttctggcttgtaccccacaacatcttatctaatgggtaagtcagttcttatctttatttcactactgaagaaactgatgcataagtgttatatgctttttaagttacgtagtattagtgaaagagcctagggccagaaccagctgtctgcacgcaacccaatgctttttccacaagagttacccacatggctgtatttgttggtattttctacccttacctgcttccagaagactttggaagggtgtgttacaaaagcagtgatccagggcaactttcaagtctgttagctccttgtgacaaccgagctgccctgtaaggcgtaatgaggagcggcttcataatgagctga

SEQ ID NO: 131697 - DNA, 1187 bp, Homo sapiens
tgcagaaacacatgcatgatgagaagagaatcttcattacaacattgtttgacacagaaaaacgagactcagcttaaatgctcattagttagtgattggttgattaagttgtgataaaatggaacactaatacagctgtttaaaaaattagtaaaaaaaaatcagtatgtgagatgatgcacctgttaattaactcaacttagccattccacaatgtatacatcattcaaaacttcacatcatatattataaatatatacaatttttatttgtgaattaaaaattaatctaaaaaaattagtggctatatgaagtaattgggaacaatcttgaagctatattaactaccaaagagcaaagtcaaccttaacaatgctgactttttaaagaatagtgcctagaacactgtgtggagtatgctaacagctacacactaatgcacagccaccaaccccagatcagttacgtgaacttctgcattcacaaacacacttaacacactctgtggctattgcctctttactgacctgtaagtcagttctagaagacagacgatccatgaaggcaggtcctagcctgcccatttgcattggtatctccaaggccaagctagagaaggcacacaataggctttccactaatatttgtgaatgaatgaatgaacagagagaggagttttctttccacagtttccttctacctgctactccttgagcatatgaggctggaatctaagccctgaggtcactcactgctctcctgggtactatccctggcctcccgtccttttccttgagcttctgtgctctgcaaggctttctcattatcctttaggctacagagaaacaaggagacgggagagccttgaaatggaccttcaagattacaatgtgtagctgacattgtcagttaagttgggcagatctgacttcgctgattaagtggatgtatgagccgatcctccccagaagctgggatcagcttccccatctgatggtgagtcagacctgctggggtttgggtcctcgctccagcatggctgcctgtgtgaccttggccactttacttaaccttgctgaatctcaatttcctgatctgtaaaggaagctaaaaatgcctctcttgaggttgtagtgaggattaaatgtgatagcataagtgaaagtgccctttgaagaaagaggaag

SEQ ID NO: 131698 - DNA, 1781 bp, Homo sapiens
ctgtgttctgcagccagccatatgtttaagcttgatagagatttttatctggcttggtaatattacccagcaagggatgacatttcttatcagaggccctgaggaatcagagataggagccctttctttttcctggccgccaggcctccatgtgcagggctggcagggaggctgggaggggctggctgggtctggtagtgggcatcagctggccctcatttcttaagacagcacttctgttagctgacctacacagaagcaggtcatttcgagatgtttgcgtcttggagccactgatagaagcagggcaagggagagtgaatgaggaaggaaggcgggagtgtgatgacgcatgcccagctttgcgcggaggcagagcacttgcctgtgtggggccctgcccttctcttgagaggcaggcgggccctagctgcagcgtcaaggtctggggattctgtggctctgtagggtgaagggcactggagacctaccaggggctgggccattggagtggtgggtgctggggagcttccgtgggcccctccaggtccactccttgctcttctctgccttgttttgtgcccagaaggctgacctgtgtggatgcattatcagggtggatgcaacacagggctgccatgctctctggtatcagtttggaaggcactggcaggatgggaaggcaggcggggagtgaggtcagggggcctatccttccactgcctccctgctgctccctgactgattcaggtaaggtttacaccggggctctaggtttgaattttgattctggcatgtacttgctgtgtgatattaggcaagtggtggaacctctctgtgcgtccgacttctcatctatagtaacgcttttgcattccattgatctctttgcctctcatttgccctgaatgctgaaggaaaggacactgctgtatcccctgagggactgtctgagcccaaagtacactggggacaagggcttcagggtgggcaaggagatgaccgatgatcacgtgatttggaactatagcctccattggagacacgtgctctgggctctttccctcctgagttttgggaagtcctggcctgtgcagcctaattctcaagtactaatcttgcaatcataagaagaggaaggagaagtggttttccctctccctggacccattccagccagcagttcctgactttgcttccttcctgttggtgcccactctgtttccttccatcccttccccaacctctcccatcccatgcctcatgttgggcaacttgagtttaactgtctcttcttccagtggccaagtccaaattctgaaagcacagttctgaccatgtccctgtccaactcaaaaacagtagctccgtgtcacccacaggcttgaagtcagacctctcagggggcattaagtccaccgcaacatcactccagcctgtgaataaagactgaatgcctccgagcctcttatgtggggaatcagttctggtaaacaggtctcacttcttgtcttttaaacactacttgctttccttgacgtctgtgctttgatcccattgttttttctcccttggatgcctgagagatccatgggctctggcttcagagagtgctgggttcagacctcagctccaacagttgctggctctgtgaccctaggaatgtcacctcaccactccaagcctctgtatccttgacattaacctgggctgatagttcctacctgcagggttcttgtgagaagaacctgtctaaaggctcctactggggcttgacttgt

SEQ ID NO: 131699 - DNA, 1662 bp, Homo sapiens
tggcagggaaaggctcaatacgcagctcaacacaggtgaatgctcagccattgttgcccaggctcaatggctgggcagggcagttgactatgtgttggacactgtttacgtgtccaccaggggtggtcaaactatgcctcatgggccaaatctgtgcccaccactgtatttgtacaatcctagtgtgaaaaatggttttcacattttttagtggtagtgaagcaaatcgagagaagaagaatattttgtgatatatgaaaattacatgaaatgagaatggaaatttcaatgtccataaataacattttattaaacatagcagaccctttttcttaacatatctcctatggctgcattatgttacaatggcagagatgacgaggggcagtaaggccaggtggcctcacaatgcccaggatattgagtatctggcactttataggaagagtttgctgacccctgggttacatgtgtaagctcatccaatcccgcatagtgttggcagttatcataccatccccattttacacatggggaagtgagatgcaaagaggttcagaaactacctgaagccacatgcagcatggaagtggtagagttggggtcttgttcctagaactgggactcttcatcgttcagccatagggtaagtcattggtctttgcaggtgagggattgtgaggcaggaaaaaagaaagtcatgcactaatgtatggtagaataagaatttagaggctgggcgtggtggctcatgcctgtaatcctagcactttgggaggccaaggcgggtggatcacaaggtcaggagatcgagaccatcctggctaacatggtgaaaccccgtctctactaaaaatacaaaaaattagctgggtgtggcagcgtgcacctgtagtcctagctgctggggaggctgaggcaggagaatggcgtgaacccaggaggcggagcttgcagtgagcccagataatgccactgcactccagcctgggcgacagagtgagactccgtcaaaaagaaagaatttagaaccaggttcgttggcctcaaagttcttggtctcgctctcatgatgagctccttccaccactctagtctcctaggatcacctgctaaacgcagggccagacacacagaggcattcaagatatccctataaatgcagccacttcatagcaatgtcaggactaaatgtggttttgtacttcctactaaacatgagcttaataaatgtttgtggaataaacagatgaatctgatgaatagttcctggactctcggagtttaaactctgggaacagggcagggactcctgaggaaagcagacaactcctcaaccttctcatgggagggaaggagaccttctttcctgaacaccaattatgcttcccaggtggcatggggtccttaggccacaatgccaaacacttttgcagttaaacttccgatgaaggaaaactggtctgtcttctctgcccattacaattgtctttactctttttgattctgaatgttcttttttctttaaacagctttgttaagatataatttacataccgtacaatttaccaattttagaatattttcctcatctcaaaagaaagtctgttccctttagatatcacctcccaatctcccttctatccccagtcctaggcaact

SEQ ID NO: 131700 - DNA, 1010 bp, Homo sapiens
cctttcggcctccaaaatgctgggattacagacgtgagccaccatgcctggccatggattcgcctattgtagacgtttcacgtaaatggaaccacagaatatatggtcttttgtgaggaacttcttcacttggcataatgttttcaaggttcatctaagttacaacatatacttcattcttttttatgcccaaagtatattccattgtgtgaatatatgccccattttatttattcattcattagttgatggacactgggttgtttctttgggggtggggctgttatgattaattctgctctgaaggttcgtacaagacttcgtatggaggtatgttttcatttgtcttgggcatgtgtatacctaggagtggaattgctgggtcatatggtaactctatgtataaccttttgagcaactgctaaagtcttttccaaagtgtctaccctgttttacattcccactagaagctgctcgttcttgggctcattattcgtgtttatctttaaacacagaacgtgactccattcatatgacggtgctagaagtcagtacagtggttttctctgggacgatggcagaggaaactatgaagggcccaggaacactttctgggaaagggaaatgttctgtgtcttgctggtttggtgcatttgaatacttgcatttgtcaaaactcatcaaactgtttatttacaaattgagcattgcacggcatgtgacttatgcccgattttttaaaaaaatgtacaaatgaaaaaacatagaaagagaggaaaaagcaaaatatctgtattttaattatcacatgacctgactggctgcttatcttacccaccttcccatggacacagggccagtgcctggcaggcaaggccacgtgcaagaaaagctcttaattgatgtgattaactacatctcaatagggagcctggttaacaacaggggagtgaaaaggaggctatttttcactctcccaactggtgaatgcctggaaggggtgatggggg

SEQ ID NO: 131701 - DNA, 1032 bp, Homo sapiens
ctttccaacctacccctttatcctggtctttcctggcaccatgaaaaccagcactcagcagtacagtttgatgacttcttattgctaggtttcatctgtaatcgttgcagatgcttaaatacacacgcaggccaggcacagtggctcaagcctataatcccagcactttgggattctgaggtgggaggatcactttaggtcagaagttcaagatcatcttggccaacatgttaaaaccccatctcaccaaaactacaaaaattagccaggtgcggtggaggacgcctacagtcctagctactctggaggctgagacacaggaattgcttgaactcgggaagtggggattgcagtgagctgagattgcaccactacactccagcctgggcaacagagtgagactctgtctcaaaaaataaataaataaattttgagatttatgtgtgtgccagacacacacacacacacatatgtacacaagcaatttttgtgtgtgtggctcaagccaggcagagaaagacaaatactaaatgatctcactcatatgtgaaatctaaaaaagttgatctcaaagaagtagaaaggagcctggtggttatcagagtctggggagggggttggggagatattggccaaaggatatacaatttcagttaggtaggaggaataagttcaagaagtcgattttgactatagttaataatgtgttgtattcatgaacaaggctaagagagtggatgtaaagtgttcttaccacaaaaaggataactacatgaggtaatgcacatgttaattagctagatttagtaattccataatgtatccactgtgtccttcaaaacatcgtgttgtaaatagtaaatacatacaattttatctgtgaattaaaaaaaaagattaaagaaaacccccatccccacggatgagttaagactgatcactgacggagctagtatgtattactaaccaaagctagaactcattgccgcaagcatctgggtgacagcgctattgatagtccttcctgcagta

SEQ ID NO: 131702 - DNA, 2332 bp, Homo sapiens
agccacttgcctcctctgttgcaagaggagatgaggagacaaatgtggaatttttattcccattcccttccctcctccataggcagccactccagtgtgcttgctgcaggccctgcatgagggcctgcatgaggatcctccctgtcttgttctgattgggtatctgtttttaatttagacaaatgggattctgctatagatctcaatttggttcttttgcttactcaacactctttttcagagccagtcttggtgctctgtgttcacctggttcatctgaggagctgcatctaccctgcccatgccatagatcctgccctgtttgcttctcctgttgctgctagtggacatgaggtaaccacagcctagttctgtgataagctcttcacacctgtacccatatggactgtgggagagtttctctgatatggactgtgatgcgggtgagtcatagtgcacactcacacttaatttcacaagtactgccagattgtgttccagaatgactgtaccagtttacacttccacaggcagtgctcaagatttctgtttccctctgtcctcgccagcacctggtattggcagatgcatcaaaaaggatgcatttgacagctcaaccacctcagagcacttgattagcatccctgtgatggccctttctgctgcagacatcactttgtcataacagcattttgagcaggaagaagcatcaggcaggaaaaaaggggcccttttactgtgactccctatcttctgttagggaagaaaattttccccagaaatccccagtagacttcccctatgtctcagtggccaaactgggccaggtaagctcccagccagtccctgacagagataacaagattgtcatggctgtttcaagccagggccaattcttccccctgccatggactttttttgagcacattgctatctcccttgtccctgaatagaactgggaatattttaataaagaagaagagaccagtggctgatcagtaacttggcagccaacagagtcttctacatcagagttctgcatttgccaactttttgcatgcatgctgcctcttctatataagggatcttcccccacatctgtttgatttgcagagaatgtcagaagcggcgagtcactcatacatgtccattgctttggggattagatccatccagctcattttggaaacggcaattctttttgccaggcagacatgagacccatttccacaccagctgctccagctgaggttcccatgcaggttctgcgtgacagaaatcaatagaaagattcgaagggcagagcaccaaagttcctgccctgcaccatgatgtcaaagcagaatgcctgctgaggacaggtgcagatgaatacctgtcagagagtatcacttctgcaagcagcaacttccccttcttgtcagccacgtggatgccatagtaaccttgtgtttctggctagctcaagaaattaatttataggatgtgtgcagcaggtcatgcctgtaatcccagaacttttggaggctgaggcgggaggatcacttgaggccaggagattaataccaccctaggcaactaaggagacccccatctctataaaaatttttaaaaaaaaaaagcagttttggtggcacatgcctgtggtcccagctagttaggaggctgaggtgggaggatcgcttgagcccaggaggtcaaggctacagtgagctctgatcatgccattgctctccagcctgagagacagatttgagactctgtctctaaaataaataaataaataaataaataaataaataaaaataaaagaaatggaaaccgtatagttataatttgttgagcacttatctttgccaggtggcctgggaagcattttatttctacgatctcatagatatctcttggcagccctctgagagcattgatatattattgctacatcacaggctcctacagaatcctgattctgacaattatcagccatgtggccttaggaaagtcacttcattttttgtaccttagctttctcatttctacatgaagaatgataatagtatattgcacctgctcacagagttaataaacataaagtgcctagaatggcacttgatacttattagctactattgttgccattttttaaaatgaagaaattgagaggttcagaggggtcaatttgccaaaagttagttattaagtagcagggccatgatttgaatccaaaagcttctggctccgaaactgggcttttatccaagggaacatcaccattgcgcccctcatcagtagaatcaattttcaggtgaagactcggtgacaaagaccacaa

SEQ ID NO: 131703 - DNA, 1047 bp, Homo sapiens
aaaaggagcccagaaaactgccacattttgcccatatagaaaagcatatcccgaccgggcacagtggctcacgcctgtaatcccaggactttggaagcccaagatgggtggatcacaaggtcaggagttcgagaccagcctggccaatatggtgataccctatctctactaaaaatgaaaaaataaaaataaaaaaaaaaattagtggggtgtggtggtgcatgcctgtaatcccagctactcaggaggctgagacaggagaattgcttgaagccgggaggcggaggttgcagtgagccgagatcatgccacagcactccagcctgagtgacagagtgagactgtctaaaaaaaaaaaaaaaaaggggggggctccttcccactcatttctcccataacatgtaatgctttttatagtgatttggtcactgctgagctatcttcatttaatgtggttttgacagaatagttggtcaggaaaatttattttcaattaaaataacttgttgaactgtctcggttttgaaaggattccgttaggatggctaattatatagcggttgctacaaggagatatttgcactcaatttcagctcttaggtaattcaaatcaaatgcttgagattttcctccctggagctgtgtgcaaccatcttcctctcacactgcaggcttcccatgagttatttttagaaacccaaatttaagcagcaattttggcagagccatttctagtctagtggagtaaaccatatgtactgataaatgcagccaaagagttagtttctttaaaaagtaacaaaaccatctctctccgttcatgggggttatatgtttacaaactgcaaactatccgttgtactattatattcatttgtgaactctagctgaagtgagagatcatggatattactttaaaattacaaagatgtgtccttttgcaaactgttgtcataatactctttttttttcaagatggcaggccttggcagaattgactggagactctgttttggcctttggatttcccgtgaaacatggagatcc

SEQ ID NO: 131704 - DNA, 1045 bp, Homo sapiens
tggggttttggttcccctagtcccagaactttgttttttgcccctactgtgagtttctgttcctgaacaccccttagttaagtgttccctggttgagcaggtttctaccaaaggagaccaaagctcagtgcttttccgctgctgagctcgctggggtaggtgactaaccctctcctagcatctgcttcctaacctgcttgggcttcagggggtgaaatgagattctgcaataggtgctcaatccacatttcttttatttcccttttcctgttttatatggaaaaaaaactcataattttataagcactgaatctataactgagcttccaaaaacccaccctgggcattttttcacattaaccaagataaaccaaaaaggcagtaccacgaatagagaaaatgtcattaggaaggtgtacatgataaattcgttttttaaaacaggaatggtgatcgtttccatttatcaagcctctctgcaaatttttcagcagctgccttcctcattttaataaaatgcttgcagatctggtttgcatttttgtagataaatgtagaacaagtcacattgacactccctacatctgatcatcctcccagccatcaataccattttcattcacagcctggaatctttaagaaatgagtcaacctgacctatgattcacagatacttgatctgaaatgcttggtggtgtggggttggtggatggggtagaaacaaaaataaatttcctgacaccaaaagtcagttcaagtgaactagaatgggcagagaggggtcgtggggatggttcctgcccttcaggagctgcacttccaagtctgacttagggtgatcacacatccaggcttgctggtggagcttcagtttatgcctgtggtcccagcctcttaaacagttagcgtgcctgtccacgattagaaatgtcacacgttggaagatgtagggttctgaggagagtagagtggcagttcttaaaggccagagataacatttaatcatgtgtatctccagtgcctagcctcttgtaagaaattaata

SEQ ID NO: 131705 - DNA, 2246 bp, Homo sapiens
cagtgtagagcagcttaacatggtacctatgtgccaaagttccagagcaagagttcctgggttctaatcttggctctgtggcgtgactttagacaagtcacttagcttctctgtgactcgcttttctcatgtataaaatgctcagtaactgtgtattgactgttgaataaaggataatagtgatactgaattcatatgattgttaggatcatcgaatggctaaacattttataaaatgattagaacatcgcttggcgcattgtaattggctgcagatgtgcttgtcaaagtaaaattaaaagaaaagtagtcactattataggcctgggtttgcatcttgatcccatcattgggccacttgtggtatttaagcagaaccttcaccctttcactactgaggctcatagagcatgaaactccccctaaaatctgtctcaaagcagccacaatggtggtttctttttgacaaaaaaaggctccttagagaacgttggcttgcaaaggagaggctgtgactaccaagtcgtgtcaacaactgaatggctgaaatacccaaacttgcccatgcaaatgggcttgggtctctcctggcagccgcctttgaaggctctagacttatctgtgaactccttttttgagagggtctttccaactagtggtttattctttgactctcctcataccttttttgccagagagtgagagtgagaagggagggctaatgcctgagctcctgccctttctatgcagtgagggtcaagatcctcagctagtgtttgagggaactggtgtaacctgggtctctcattttctaccatccaagttgccacctctgtcggggtcccactctaatttgggcagccactaagcaatattttgaaatataccttgttcatgagtttaaaggatcaactggtaggtgtgtccattagcaaatcctatggaacaaatatctgctctttttaccccctacttaccttctccaccaaggacagttcagacaaagttgtcaccacctttagcctgatttactgcaggagcctcctaatctatcttcctgtttctactctatcctttatcccccccttggcagccaggggatcctttaaaaatgtgaaccaaagcatgagactaaaccactcaaaatcttcccatggatctcatctcagattaaaatcctaagtgccttctctgtccttagtgaaccccaggtgcacccttcctctgccactttcccccttgtttattctactttccacactggcctccttgctgtgggccagacatatctgagaccagtgtggcttcagggcttttgcacatacgattttccttttctggaacactctctcttccttgcacatctgcctggctctctgctcagatgtcaactctcagagaggccttttctgaccactccctctaaaagagtttcccccgcccctcatttcccatcattatctgtagtactgatgacttgcagatgttattacaaatttggttattttttgcatcctccagcaaaatgtaagccaagtgaagaatgaggtatcgttttgttcatcaaggaatccacagaaaccagaacattctgtagcaggtgatcactaaatatttgttaaactacaaagagccattttaggttagaaataaggtatagctgacagaattctaagcctgatgtttcttatgagcctgctcaattggccctgaaaccacttcccagaaagctctagatatgttctgaataatgggagcaatgctggaccagtgtttgaggttccaaagtgaatacatgaaagtgaaaatgaagctacatgtgactggatgaaccctcttgcattggtttaaaaatcctattcatcatgattagttcacgctctctttttcttgctttgctcccaggcaccagacaagtcattccaaatatggggtcttggtaccagtcagaacgaggttcccatctgtggtggtttaaaaacaaaatgaccttgttccttgatattctttccattgaaagatgggatatatgacttttccttgagtctgtgcaggcttgtgactgctttatgcagctcctgcctggttttctgagcataattattccagggaaagcactgggactgtcaagccgaagaggtccctggtgggtgctcttgtttgtagcctcagctgagctcccagcatcagccagcaatcctgagagccgccatcttggatgcacatgtaggccctctgcaccttca

SEQ ID NO: 131706 - DNA, 2592 bp, Homo sapiens
ttaacactctgggcatcaggtttctcatctgtaagttaagagtgataacatatattgatgtggttgttgtttcaagcaaaagcaagttttgtccaaaacctagcacgcttctccacacaaacaatattttctcaaacttaagatgctttcattttacgactcacccttaattcatgtgtactaagaaagaaacaaatgcttccaattaaactactgcattactgtatgccactggttgtaggacacatacctgttttggagatattgaaatttgaaaagatgtatgtcttagcatctttgatttaaagactgattaacataagcacctagctaagcccaggcaaaaaacgagatccccaagattagagtttgtgaagtgtaagaggagacattaaagcaaatgtacctttgtatgaatgtctccaatctgccattctgttttatacgataaaacacaaagattagtacagacatccttgtggtccagacaaaaagtgccttccttgtcagccgtcgaatggttagaattcaaatgacatcatgtcacagttattgagccaaaatgtattttgcaaaagggatgaagtcagatccctaaatctggctgtgagtcgataagttgttttcagcagtaactcatccctagtaatagtaatagtccaagccccatttctctttggttcttgagaatttcctttttttaggacacgaactagtagttccttgagtattccagccaatgggcagaggggggtctaggcagtgggcaaaaggatgacacagggagacccagggccacatctagggggacagaagcataagcatcagcttcctagcaggcttgacgttaagtgttcacatggagctctgcagttagtacggctgccccaagtgctactatgctaatcctcatgtgaaaggcaaacctacttcaggacaagaggggttaagtctcttccccaaagtcacacagcttgattatgtcaacttagaccatcagacaccagagcctgtacttatacccacagcactgtactaacaagaatgtttgcaaagacacagaaatagtcataaaaggctccaacaaacccaaagctcacaccacaacagctgtcttgtcagctttacctaaacagagaatttcttttcatccataccatcttactttgttcagtatgggttttccgataaggatgttcttacctccttctctttctggtaaaaaccaaaacatccttcaagacccagctcaaatggaacagcttaactccttgttcctacagggtgggccctggctgcgtttggctccagcatattgtcccttgggctgcatggctggctctcctggaattgttgggagtggtttctgttgattactcctattggactggaagtttcttgaggttctggagttagactgagtttgactctatgatttacagctatgtccttggacaaatgtcttagctttcctgagctttaattttcttatctacttcccagaattgtcataatgcagcgtctttgcttaggttgcacgatcagtgcccaatattgtttactgttatgtgattggcaatagtggagcatctttgtgcattatctcagtcttcaatagccctctgaggtaggttctttcactaccacccctttttcacagatgaggaaactgaggtgaaacttcttgcccatggttccacagctcagatgtgacaaaactgggctgtaatcgtacctttttaaactcccttccctcgatggaatcccagtgagagcctccatgaactgattgccaaggatgttttgtcatgtatcagtctctttagatgtcttttaattcagatcttaattttccactcatttgtgcctaggtgacattatcctagtttgccggaaaatgatgctgcaaccagctttgtctctgtaaactgtggttgtttacacatttcaggcatctggcaataatgtgtccctcccccaggctgttatgcgtggcagattattaacaccacaactgccgttttagttaatgaatcaaaaacatggatcactcccattattggccttgaaaagctcaagcaaactcttaagcataactaagggcccacatcgttttccaacccaaagaatgccagggctatgcctcctatttactttgaatgattggctcaccaaagtttttgctggttttctgtgttgttgcaatcatggaaaccctctaactctgctgacattcctgatgtgctactttttttttttttttttttttttgagatggagtctcgttctgtctcccaggctggagtgcagtggagcaatctcggctcactgcaacctccaccttccacctcccaggttcaagcattctcctgcctcagcttcccgagtagctgggattgcagacacgtgccaccacacccggctattttttgtgtttttagcagagatggggtttcaccatgttgtccaggctggtctcaaactcctgacctcaagtgatctgcccacctcggcctcctaaagtgctgggattacaggtgtaagccaccgtgcccagccgctacttgttttttttccctcaagacataacag

SEQ ID NO: 131707 - DNA, 1758 bp, Homo sapiens
cagcttctagaacagtgcctggctgcgggtgagcactcggcaaatacctgccttagaaaggtgattaaaagatgtagagttcctggcacacgatagaatctcattaagtggtcacattgccattgtctgtactcaaccaggaattggcacactatggcccacagcctgtttttgtaaataaagttttattggaacacagctatgcccatttctttacatattgtctgtgactgctttcctgctatagtgggggagtggaatcgtgagacagacctgtgccctgccgagcctaaaatatatattgtctggctctttacagcaaaactttgtggtttctgctctgaatgtcagggtaaccctgtctgaggatgatcacggatttcattttcccttgtttgttagcgttgcggtcagccgcaagttgaaaacaaggaaccagcttgaggtacgcattctcgatgccctttctaagatacttatggagacttttcttttccactccaattctgccatgctctttcggcatggtcagagctggcttctctgtgccctccagatctcatatgtaagatggtgttactttcatttctttgtaaaaagaaactcaacccacctgtcaattgctggtatattcattagggattaaccatgggtcctgcaacaagtaggctcagagcacagaggacatgagtcaaaataaaaaaagataaccaaccaggtacaactgtgctttgtaatattatagaatagaatgctgatggggttcaggaaggagtccactgtgtttgtggggcacaggatacataagattctgatttacttttccatcatggtgaatggcatgatcttagacaccttagttagctttattcaaactcagtttttcaatctgtaaaatggcaatgttcactatatgttgtcactctctttgatgggcagggcccacagttaggagcctctcgaggccttggtatctagaatggtgaaggagagctttctggaatgagtgaacatgtgtcaaatgctctgacgtcctcatttgaagggggccctgtcccctgtaccagctgagcaatgcgagtgggccactgtcctgctaccattttatagtcagcggatctttttttttttctctttctctccagaaggacagaataacgggctcccagattcacaagccccaccaagaggatcaccccaggaacgcttggaggctgaggagttcactgaggctactgcatcttgagactcaggatgaagacccagcttggggctgtcaaaggtgcgacctgccagctgagacctccaggggtcgagcccaggcccctttgccttgttcatggcttaggccagtgcttagcatatagtaaacaacttgtaaatgtttattagaggatgtatggtgggtcatcccttctgaatggcacacagtccattgtcattgtcctcagaggctccagcctcaggtgcttcttaaactgcgatgggaatgatggcagcagatgggcccagggctcagcatgagagctcacagcaggctgtgctccaccccacccaggcccccagtcttgccatgtttcctctgcctccccaggctggcctagaaactgcttccaactgaaaccagccaaatgcctgcccctaaccacacctacaactctagggttacctttagtctagatcaggggtccttaaactgtagcctttgctgggtacagtggctcacacctgtaatcccagaactttgggaggccaagg

SEQ ID NO: 131708 - DNA, 1027 bp, Homo sapiens
tagagaggccatgttctggttgtgtgaccttgcacaggttacataacattctgtgcctcactttacttgtttttaaaatgatgaagatgataactacctggcagcgtgtcttatattagagataatatggttcctggcactttgtaagcactcggtgtgaaattgtcttctgctgctcctcttcatcagtccacccctcctctgcagaggtttcctccatgctgagcaagctggcagcacctaaattcctgttagtgcaccctagtgccttctgcccaggcctcgggacccccagggatcctggcccctgtggacagggacttttgtgccctccttctctgttaccagcaagagtgagtcctgcactgaatttccatgggatcattgcttgctaacatttgtgagtgagttactgtctagaaagcagcttttctggacttttcccattaatttcacgaaagttatcttcctttgcccttactacatgttcattactacaggttcattaccccattttacagacaattaatactccgagatgaagtgactcaccaggggtcgcctagctaagcagtggagagtgggcctcccacccaggccttctcactctgactcctgttctccacgtcattgcatatggcgacatgcgggtcacgtgatcacacatccctagccgatatggaattgtgagcttctcctgggtcttccgaggaaggatgctttcaggagtgctttggaatgaaggcagtggaggccaagagacctctaggtcaaagccaggcgggagggtcctctcaggggcccagccgacaagttgcatttctccctcagaggcctgaagaggcagaacaccccagaggagcctggggccaccacccagcatcactgtgggaaaacggcagcaggaaatgtcctctcgcctgcgtgctccacctcggtccacgccttccctccttctggaagccttgcctgaccactggcctgccccttctatgggaatcactactgaccttgcagcttattatag

SEQ ID NO: 131709 - DNA, 1093 bp, Homo sapiens
acctctggtgctccggagtggcaggccagtcacaggtgtggtgcatcagactatgaagaggctgggtggccacaactctgtgctgggatgctgacctctttgaggcaaacagcatgagctggaaaaagtgtgtctatctcagagttaaaaactggtgaattcccctgttgctctttaccatctcctgggtccgtatgatctgactgccacccactttcccctttcctcactgggctccagacacactggcttccttccttcctgaagcctccatctgctgccgagctcagggctttgttagacgctcaccctgcctgtgttgcttcctgcagtgtgctgaattgtgtctcccaaaagatatgctgaagttcggacttccagaacctgtgaatgtgaccttatgtataatagaaatagggtcttcgcagatgcgatcaagttcaaataaggtcactctggatgacggtggcccctaatccactggctggtgtcctgaggacagagacacacagtggggaggccttgagaagatggaggtaaaggtgggaatgatgcatctacaagccaaggagcaccaaggattgctggcaaccaccagaaactaggaagaggcaaggaaaggctcttccctacagctttcagagggagcacagtcctgctgacaccttgatttcagactgctagtcttcagagctgtggaaaaatacttttctgttattttaagctccccaatttataatattctgttatggcagccccaggagatgaatacatttctttctcctccttcgtttcatacctctagtgccatctccttgaagagtcgttctttaactcccagtcattactaggttcccaagttctacacctttagctctgcagcctattcccacgggagattctcttggtagcctcccccgacacagtgtaagcccctttgtgtccaggttgctcactatgggtcctcagtctctgagagcgtcttcagcacacattgcgtgagcaatcaatttttgttgaatgaatgcattgcaatctggagtgagcataagatcccagtcagaagattgccctgggtgcttcccctagaaat

SEQ ID NO: 131710 - DNA, 1037 bp, Homo sapiens
gcctgttcttactgtttagcatgaaatgtgttttcctgctaagaacatgaaccagaaatgagttttaccgagtggttagcaagaccttaaatagaaaggaaactccaaaaaatgtaacttctctcacacttaagcctccttttcaacttccctttcctgcttcccatcactagaacctccagatcttatttcctgggtgatgatgaatggtgggccctatttcagacctccccaaattctgctgaacttcctctctttgggttttagacagagaggtatggtaagtgcctctagaactgacatctcctgtgagacccttctcttacatgctatgtaggtttggctgctgatggattcagaatggtttttattgagcacctactaagtgctagcttttacactacgcattttgacactctgtaacttctttttcatttaatctgttccagaaacttatgttcactatgatgtgatcttgcttttgatccattttactgatgaggaaattgaagctcagagaggtcaagtaatttgcctaaggtcacacagttaataaatggtaacgccattttcaattctacatctgcctgactacaaagttggtggttttcctttcctaaatgttacaactaaaaacccactctagctcaaaatggcaatgggctttattgtaaggatttgggctgtgcctgggactgtctggtggttatccagcagcctcttaggaggagttggcctgttggatttatggacttgggacccttggtatgtgctcagcacatgccacagacctggcaagcatgctggcctggggtcatctgctcttggggctgtgttttctgattaagggacattaggctagccacttcccacatccagcttcagtttccccaactataaaattaagacatagatatgctttccacgctgccatcctgccctgataatcagattttagtatcccagggctataacgccccattcttccatacccctcaaactcctgcctttctatcctatctggaactgtggcttac

SEQ ID NO: 131711 - DNA, 1004 bp, Homo sapiens
gccaagccatctcatgtggattctgtaaatgaaacctgaacgtttgcatttaatatcatttgcttgcaacaagtttgagtttctccctttcttaaaggtaaagaaaactccaaaatcaaactaggctcttttttcccccttttatcaggggaagaggggctttctccttttattgggagctcagaattgcctttctccttttattgggggctcagaatagctttgaccaacaaagaaactaggttgcctgccctagtagtggttgtgaaggttcttctaagagtcatttggtgactctttttcacctgcaatcttaaacctgacatttacgtctgcctccaaagaaaagccactggggtcttaggcagaagcccagccagctctctccatgtatccaaacatcttctcttcttttgagagaatgctgaacatatttattgagctttcattgcatgttaggcagcagtttttacaggcagcaattaaccctgtatgttctatatattagggtggactttaggcatcaaggtgcaggttcatgcctcagtttccctccctgtaatgtggaggtacatactctttggtgacggagaagtagaatattttgtttaaatacagtgtagatatgtattcactcaaatacacaacccacttttaatggactcttgataccaggaatagaagaataagaacagttagatctagcgtttactgagattctttcatgtgccagggccttatatttggtattagtcagctgttgttgcaataatgctgcataaaaggaaacaaactcaaacaaaaggcttatgatcaacaataatttgttctaggggtcatggggttgcactaccacttagctgattgaggctgagcttgggggggggctttgcttcaagctgtaggtttgctgggctttgctccaagagtatgctcagtacatatttgctttttgtatgtttgtttgggggccagggatgaaaaggccaaagctacctgaaaca

SEQ ID NO: 131712 - DNA, 1374 bp, Homo sapiens
gaggatgacaggctgtgcagaacctgaacagggttaaagctacaatgagaagccataattttgtgagttttgctgagaccaattctccatcctgtcataattagagaacccgatgctgattattttttaagttcctaaaattgatcttttttcttttctttttttaggtacacaacaaaacatttgaatgatgagactacctccaagcaaattaaatccatgctgcaataacaattctggaataagcacctgctgtagacagaagacagtattctgcaatgactgagaatgcagttttttagtgattgcaattactatctcatttattcttgcttttatttctttcctctgttcctcttccctcttttttaatcatgttcttaagacttcttttctgtgccaaaatcagtaaagttacactctgaagggatatcatcctttcaaacgggccatctaaggcagctaattatgcattgcattggggtctctactgagaaaaattctgtgacttgaactaaatatttttaaatgtggattttttttgaaactaatatttaatattgcttctcctgcatggcaaaactgcctattctgctatttaaaaaccctcaatgactttattttctactgccgcctttttcatgtgcaaccaaaatgaaaatgtttaaattaactgtgttgtacaaatggtacccaacacaaactttttttaaattagtaatacttttgtttaaagttttaagtttgcattttgactttttttgtaaggatgtatgttgtgtgtttaacctttattaactaacgttaaaagctgtgatgtgtgcgtagaatattacgtatgcatgttcatgtctaaagaatggctgttgatgataaaataaaaatcagctttcatttttctaagtgtggcttggtttactgatgttttgtttttaggcttctgaagttttccccatgtatgtttttatggaatgcatatatacattacatgattttttcttcttttaggggagagccgggtcttttcattagaattttgatcattgtctatgtatatacttttaattgcctttaaaattttgctaagtatattaagaccagtgatcttttcattaactggacttttattcttgatttactcttgtatggatgtagtaatggaaggaaaaccgcatccttgcttgattctccatttccaggggagcgggtagcaacatgaaggcagagtagccctttaatcatgggaagagagtgattataagagggacttcccaggagaaaagcagaggccatgatctcactagtggtagaaaactaacaggtttcagtttaagatcataaaacctaaatcatgaaatctaaatctcatggttg

SEQ ID NO: 131713 - DNA, 1041 bp, Homo sapiens
ccaatatttaatgatatcatgagtctttcctccttggtttctttctgaatactccctgtgtctcagtcaacctgatttttctcccaagactttgtctttctgattggtcaggctctttgaagccagcaagtggcaggaaatcttttttaaaaacttgaaggtaattgagatctaggaggttttaggattctttcttgagcttgaaggtagtatgcctaactcagaatctacgtttcactttaagggtagttcagtttccttttccttagaatgaaagcagaggagaccagtgatggcgagtgaaagacagggttgaagtctcccacaaagtaatctgtgtttgagggagaggggagggaaggaaagcaccacggaggcaagagtcacctgtcagtttggtacattttctttcctattataatagataatggaaactagaaaataaaatgttgcttttagaaacaacaaaatcaggtctgacttgggactcaggcactttccttttaaacaaacaccctagctgatgtagataatgctgatactttgaaaaatatttcttaaaggaaatccatctagcctttaatatgttttactgagagcacatgtttagaaagcattttgtaaccccaaaagtactacacgagtgttacacacctccacaaaatagaacttaaagaccaaaagattttaaatgagagaatagttccatatgtatgtatatgtttgttttgaatgctttcctgtagtaattatttatatagaacttcctgtgctactaagagaaggcatcaagtcatatgtccattttacaggtggaaaaatggaaccaaatacatttaatcataagagggaaagaaaaaaagagagctgggagttcagattcagtagtagataattgtcttctttattaaatttaagagtaaaggtaaataataattggttttctttagtaaaacagtcgcacttggaaaaaaaatttgtttttgtgcacaaaggaaaataatgccatatatcttcatgttttattttcacgtatattag

SEQ ID NO: 131714 - DNA, 1027 bp, Homo sapiens
attgcatgtgtggtatattagtttgactgattttgttctcaaaaagattttgttttcactaagtgagaataataactcttaggttgggtttttttctgttctaagaataattaatttgacatagtatgtaatctcttgagttccatagttatggtcttgatttattttactattttgaaaaggaatgttacatgaaaaaaatggctgttttaccttttctgttttctttttctttagatgaaaggttgtatcaaagttcttaaggaccaacctcctaatagtgtggaaggtcttctaaatgctctcaggtgtgtatatgtacgtgtacgtatgtacagaaaaaatctgtaaggaaaatggtcgatgtttatgtaaagaaaatgcattaagtgtgaataggatataaaaataagtgttcaagctagaaatatgaagatcttattttgtttattgataatcttgcttccaaacactggttacggtattttatgatgaggaatgtgtgggacacatgacaatagcagcttcattttctggttgaagattttggcttttacttgttgcttctcttcaaacagagattgcttgtttttgtaataaaagtattatataccagttataaataaaattcagaaaacataagaaaatgtaaataaaaagaaataatgtaatctcaccattttgagataagccactattagcatatagccttccagagttttttctttacatatatagataatagctctatgtagtagttatctttttacaaaataatatcttacaaagtggcttgtaactagctctttcctcttaatagaatgtaattacatttgtgctcagacttgtgttctgttatttttatgtatttcctacaataaaaattaagtagtcattatttaatgtcttttcttagattagttttacttaatttagttgctcaaacttctacaaatgctagaacattatttcgttatttagagttggaatctcgctctgtcacccaggctagagtacagtggcacaa

SEQ ID NO: 131715 - DNA, 1071 bp, Homo sapiens
aatgtttatttcagaatgcatataaaaagtcagtagtgctgctgggcgtgctggctcatgcctgtagcccaagcactttggcaggctgaagcaggaggatcacttgagcccaggagtagaagaccagcctgggcagcatagtgagacccccatttctacaaaaaaaaaaaaaaaattagccaggtgtggtggcacacatcggtagtcacagctacgttgagaggctgaagtgggaggatcccttgagcccaggagttccagcctgcagtgagccacgatcacaccactgcattcagtctgggtgagagagagaccctgtcttgaaattaaaaagacagccagtaggatgctccagtggaaaaagatgaagactttatgtattttccctcccctacctagtcataataatttgtgactatagttggctctcgacttttcttctctctgtaaaagtttgtattagaaatagttttctaatttctctacttcgtagtttctttccccaacctctcacatctagttcattagtgtttggtgagaattgtcttcccgtttccctttcatagctagtttaggctcttagcatttcggatctcgattactgattactagccaagcttgttgccttcatgtacacctgtcatatgtaaagagaaatgagttaatatttactgtatggttgccatgtcccaggaattttacgtttgttctcccttgtgactctgaaaatactcttttaggtgtcatctccctttactgacagggcaactaaagtttagcagatcaagtaatagaattgctagtaggccgggtgcagtggtttatgcctgtaatcccagcactttggcaggccgaggcaggcggatcacctaaggttaggagttcaagaccagcctggccaacatggtgaaacctcatctctactgaaaaaaaatacaaaaattagctgggtgtggtggcacacatctgtagtcccagctactcgggaggctgaggtgggagaatcgcttaaatccaggaggcagaggttgcagtgaaccaagattgcgccactacactccagcctgggtg

SEQ ID NO: 131716 - DNA, 1018 bp, Homo sapiens
tacctaccatgtaaaataagataaaagcaaaaagcaaagcagccaatcctatactatacccatccttgccatcacttaaggctaaagacattagtcatcttggttctcccttttaccctcaataattacaggtaaaatccaatttttttcaagtgaaatatctctgaaatgtcttctccatccccctttccatctcctcctcccactgttccaacagagagcctaattcccactctttctggcagtcactctgcacagcataactcattttcggacctacaagtctttttccattttggtacaatctgcccacgattatcagttaattttctttaggaaactgacttagttgtcattcctttcatctaacacactgaatggctccccattccacatggaagaaaaatatgaacttaagctagcatttatggcactatacagtctgaccccaacctgtatctttcgttggttgcagccccttattacactgaatatgctgaattactctttagggagtcatttgaaaacatactctttcccctgccagattggaataccttgtttacctgcccaatatgacctgcaaaaggataactcttctccttagtttcttctgttccaacttaatgttctctgactccctttttgtgttatcacctgttagaatcttaccatggatgttgtatggatacttattgttcataatggaggacggtacaattttataatcatttttctgtcctccataacatttagaatctcttgtatgtagtagacagttcatcaaggttttatttaaattctttaatatcatttaaaatatttttgaagaggttaatctttttttaaaaaaaataacttttttttaaaaagaatatttgagtattatcgatacatgagagtctaaaatgtaattgaggcaggcaccctgcctgggtccttgtataattgttattatatgtaataatttgtgaactaacatccagtgcttttaccttccccacaggcagaaggagaa

SEQ ID NO: 131717 - DNA, 1109 bp, Homo sapiens
gtgtctgtggagttgagaagactcacccttagcactcaatatagaatattcaacactcagccgtgcgtggtggctcacgcctataatcccagcactttgggaggccaaggtgggtggatcacctgaggtcaggagttcgagaccagcctggccaacatggcgaaaccccatctctactaaaaataaaaaaattcagctgggtgtggtggcgcgtgcctgtagtcccagctacttgggaggctgaggcaggagaatcacttgaacctgggaggcagaggttgtagagagccgagatcacgccactgcacttcagcctgggcaacagagtgagacgctctctcaaaaaaaaaaatattcaacactcctagattcaatattctatattttatggattataccagtgtttcctatgtttgctaaagcctacattttaatgtaaaaatgaacctttttttttttttaactctaactatttttattctttggattttgaaggcaatccagcatccagcagatgagaagttgcaagagaaggcatggggtgcagttgttccactagtaggcaaattaaagaaattttacgaattttctcagaggttaggtaagttgaaagttttgtaattgtgacttccctagtgaaaaagatgtttattcattccagaagtttagagtttttttatgttcataatgctgaatttggcttagtatctgttttataagtaaagcaagcttgttagactgtaagattatagttaatcttctttcaaccctggccttttaattcatttagaccatttttgtccacaagttattttcctcatcatctgtcgttttacatacatgaatctgagcattgattttaaatgattttaagaacacaaaagtttgactaaccaagggcctgaggattactttcccatatatgggaaaaggacttactgtagcgatggagagagattctaccaagtgatttctcataataggaccctttagcatccaaagaaatcaaagaggttttcttgaaatttttactggttacgcttaattcatgtatctaaaactgtagaagatgagaaataggctgggtgtgcttgctcatttctgtaatc

SEQ ID NO: 131718 - DNA, 1671 bp, Homo sapiens
accatgttggccaggctggtctcaaactcctgacctcatgtgatccacccacctccgcctcccaaagtgctgggattacaggcgtgaaccaccgcgcccagcctttttttctttcttctttatttttttttcttctttttttttttttttaaatatagaactcttaggcttttttttaatggggtttcgctctgttggccaagttggtcttgaactcttggcctcaagcagtcctcccgcctcagcctcccaaagtgctaggattataggtatgagccactgtgcccagcccgggttttttttttttttttttttaattgcagtacttcccattgggagaattattctgcttctgtgtgtgggaaggctttctacaataaaataataatagtgttttctctaaagtctgtttatatatttgattggatgcatattaagattcatttgtaatcttttggaatagagtatagtggtagaaaagtttatatataggatatatcaaagagactttctggggctgggaaaccaggatctcgtaatgctatgaccaaagattgaagttttgcataggataccgtagtcactcagtagtgctgttttcctgaggaaatacaagacatagccacgcatagttcactcaaaaatagtccatgattggtgatgtgagaaagtaagtaagtgtctccaagtttaaaagaaaagagaaagtttacatagaaaaataacattgaagaacaccaaaatataagggaaaagtaaaaagcaatggtaagtaattcatcttaccaggcttgaaacaacttataaaggtaccattgttaaacattgataagtaataaaagagaaataggcattgaaatacaaaatatgtaagctaaaaaacggaaaagctgcatttaaatctactgtagatcggggacaaatatgtaactattgaagcagttgaaatttttgttgagaagttgatgcaggtttaatgatacaaagagaaaagatttctgaagagtagagaaacaaattaagaaaggaatgtacaaataaaagatgaatatacaccaaatatacaaataactgatgtgttacaagagtcataggtcaataattaaattgctaatagtgttaattaataagacttagagcagccaactattctacctataaaaaagcacagacaacagaaaaaatggtcagctttgctagtaagtgcacatcactgtgaagaagttttggttggtttgtgaagaaacagtaatctcagttagtgcaagaagtattgtaaaatgggtagtctttttggaggtcagtttgaagtatatttaaaaaaaaactataaaattgtttgtgctcttgcaccaggtacttatattttataaaacattgcaaacaactagtttaagaggaaatgtcaatgtaaaaactggtatggccgccttattcatagtagcaaaaatgtggaagcaattcacagcgttattatgaagataaaattagacaatccatgtaaacagcatagcaccgtgtctgatacacagctaaaatgaactgagagttttcttattatcactgtactaataatgttgaattatatattaatatattttactttaaataattttttaaacattattaaatagaataaaatttgatttaagatagaatctattaaataaa

SEQ ID NO: 131719 - DNA, 1344 bp, Homo sapiens
tgtcactgtaaattttcttgtgctttcctgctgtttagatgcccagcctacagagtctgagaaggaaatttataatcaggtgaatgtagtattaaaagatgcagaaggcatcttggaggacttgcagtcatacagaggagctggccacgaaatacgagaggtaaagcgcatttatgtattttctagttaactgaaacttactgtcccacctctttgtaatctcttgttttctagacttcagaattctatatttcatattaagtattatatttgaaggatgctcacttggcattgtttcagaagtgattgcagtgaaatgagcataaaaggaaaaactgtgttccataaataggtagtttttgtaaattaagaaaatgttatttactttttgggttgctcttatacctgaaatttgcagtatttatgtggtgcttcctaggagaaagtggaaatcatccttgcagtcagtacaccttccccatgactttacatcacaaagaaaatatgtagtgtggtctccctcaactttcctctcccaaactgctgaactttttcaggtttgcattcatctcattttttgtttcttttgtttttcagaagaagctgtgtccttgcttctttccaagactgacttctttacctttgttcttcatcctgttctgaaactttactcttttaattatttcttcttctcttaattaaatcttctatcttttttcttttactgaattcttccccgtagcatatccatgtttaggtgtccagaactacacagaggaactccctgtcccctgggccttcatctctccccttctcattactgcatttcttgaagccattgcccgtgctgtgtttcttgattcttcccatcctctgttttgtttattattgtctataacaaagagtgcagaggtcatcagggtcactctttggggcatacattccatatggggcatacattccatatccaccttgatttctcttctgacattggagtactagtgaaggcagaatcaagtgcagacaccagaaggtggtgattcaaaacatgtgttggtgattgaccaaatgtttagggcaagggaagagagagagttaaatgattccatggtgtttattttattttgagacagggtttagctccgtcaccctgccggagtgcagtggtgcaaccacagctcactacagcctcaacctgctgggctcaagtgatcgtcttgcctcagtcgcccaagtagctggcactcaccaccatgcctggctgatcccctgccaaatagaggcagggtttgccatgttgccgaggctggtcttgaactcctggcctcaagtgatcccccgccc

SEQ ID NO: 131720 - DNA, 1022 bp, Homo sapiens
tttggtaatgtaattattgaattttaaaaaaaatgtggtatatttttgactatttggcaggtttattaggtagaattgaattatgacttgctccaagcacaaaataacgttaccgtttttagggatctttactcccagtttcacgtgtaaacaaagtttctttacaatgttctaagtaaaggaataaagaaatcattgtgtatttgtggtgaggtgaaaaggagcagaaaagtctagttaactaattttatatgattggtagacaaagatttaccaaaaaccttcttgtttgttaaaatatttttaaacttaaaagaccagtgtgatagtattaaaaacgttcttacttcatcttataaatttggactgattccttttccctcataagagaaaattttagcatggaggaattctgccagtcatttttctctaaaatatgataatcataatgtttatgattttaagtgctttatgccttacctgtggtgctgaatgtggcctagttggaaagatttgtaaagaaaccttcatttcctcttagagtccacctttttccttaaaatataaaagatttgtccttagagaaacaaatgaccagtattattaaaagcaagatttctgttaacttgagtcaagcagagagaaatccagatttagtcattcattaacatatgttttgtggctaacaccacaggtggtgaaaatgcccatatgtttgtgtccttgattctgctttttataactgtaattcttccttcatttttctcttactcccaagtgtgtaggaactcagattttctttagtatttcaaaatttcagtagtagtattgtagtgtagcttaaagtatctagttttcagcagctgagtaattgtggagcagttttataacttgaaatcctctgcacaggattcttgaccttctgttcatcagcagaatagttcagtgatactctcttgggtttgttgttagatatatatatcctctcttctttaacctataatatcatatatgttgagaca

SEQ ID NO: 131721 - DNA, 1072 bp, Homo sapiens
tggtactttttttttaaatagtaaagccatttttttctatggaaaatcaaagtgacaagtcttggttgcattatatagtaccgttttttgaaaaaaataaaataaaaagctttgttttatacagcttttcccccttcctagtatttcacccttttgcatgacttgctttcagtaaagtagtgcttacttgtctgctattttctgtttgtcttcatttctatagcagtcttcagcagctttcaaaattataaatgtgactttcctgtgacagtctaaaaaatgtttaatcattgtggtgctgggtgtttttctcaccctaaagggaaacttaaatcttctcctctatttttaaatttcttggtacttattaaacctttactagttattaaccacttacaaggtctacttaagtctacttgataatgtttcgtttgtatgttaagtctcagtgtcacatttttatgttaacagctagtcaccacacctaaaatacatagtctagcattttcaaacttcacagatacctttgatatataatagctaaactattgtcctttgtcatgaattcccacttcatgaattcaaactaaatacgtgtctactattgatgttatgtctgtagtttcacaattccatatgaaaaagtgtaagactgtcgttttttgcatgtaaaacatatttttctctactgaatctgatgtaagtataaaagttatgaagtgtgcttttttaaaaagagtgtatgtctgactattacattggaaaatatggtctggctaaatgtaaaatatttagcagtaaattattactgctaaatagcaaagcttgatctataagaaagctaaccatttagttgcaatatcagtatttgttcctagtgataatacctttgtagccttggatagagagtctttttaatttttcaattggctcctcttgtataattattttgtcacagtattttcctcctaaaaaatgatttctgaaaagaaatttgaaaaataagggaacagatatgtaaacacattcttaagttgactttacatatgaatgttactttattgttgctgta

SEQ ID NO: 131722 - DNA, 2485 bp, Homo sapiens
aaaagagggacaggagctataaactcagagccaaatgtgcttttgttgttccaaattctcaatgccaaaagcatataaacctgcacctgttgataattatgagcaagccagcctttgccaaatcccaggcctctgcttaaaattttttactggaactaaatgatgttgccatttttatttttaggtttgctggcatgggtaatctcattaaggtgctaaccagggacatagaccacaatgcagcacattttttcttggactttgaaagtaagtctctttagcccttcacagctggtgcataatggtaaaggtgaaagatgaattatactcaccacagtgaaggccagccagaatatttgttaattaaacatgggaatcaaacaaaggttgcatgattttttcttaatcgtaggcaaacatcaccatcatatgtataatttagtttttcatttgctaaaatcatgttgagtgtgtagccagtgctgtcctttcattagtccatgaagcaagtagccttatgatgaacattctaatagtatgctttagtgactatgtcaaacaatattcgcttataatcctgtaataattttattttaaaaatcagaattgtgctgcataccttgaatcagtagtctccgtacctccacaaattattgacaatccaaatttggttagaaatatatgctttattgaaccgcatgcaggaagaaagttttatactgttttaagatgagatgcaaaggtgagacatggccaaatgtattaatatttggctttgaaataaattgttgtttcagtgctatactaacagtactacatgtaaataattcttgatcagaaatttctttttcagaatattagcactattggaatacttaaagaatttttcattataaggccattaatgaaacttgtcttgggagaattttgagaagaattagagcaacagttgtgccattgtgtacaggaaaaccacatttcacctctaggtcctacatatcaacaccttgagaacccgttttgctgtctgccagagcacagtctgggtaacctgaagaatgaattcatggcctaatgaacattttccctgttactatttttctttaagtaaacttcagatgttcttttttataaagggatattttctcttttctcattcttgtcttgacaggtaccttaacatggggaatcttcttaaagttttgacatgcacagaccttgagcaggggccaaattttttccttgattttgaaagtgagaagatgattttatatctatttctctttgcctgcagtagactgcgtttgtcttgcactaaatgaatgtttccactttgccatctttttaactgctttgcatgactgagctatgaattgtttgagtaaatttctggtgccttctagaactggaagtcctattttatagattaaattgtgatgataaaatgtctttgagtttttataagagatttcatatctcttagttggagattattttgtaatttacgatctattctctaatgaaaacatttttatgaaaaaattttgttggaaaggacaagtactacctcaagatttattaatagaagcaatatttggggaaaacttatattatagtcaagaaaaatcgaccaggtttcagttattgtagggtacatatttaagtatttcaaatatcaatctgttcatgaaggccattcagagctcagtaatttgggcataatattaaaaggtaagtgtgaacctaaattatttaatctttgcagataatttgaaaagttaaaaaaatagaatgtatttatttcaggaatttattttttctgactctaaatgaaaggaaaaataatgggttcacagacctttaagtaatttgccttctgtttgttttatgttgcatgacctattgtaatatggtctaagagtggcaggtaagtgtcattgaccttggtgcatgttgcaaagcttttgctttttttggctgttgatatcgctttagcttgtctggttgttaaattgagaagaattattaaattggtgttttagtgtgaatgatgctattttaactgatcaatagaaaattgttaggaaagggtgaagaggtatttcttaggtttttaatcatgtgatcccttatatttttaagtgttagaatgtatttttatatacttaaaatttaagatgttttctgattttaaaaacaaaacaaataaatcacttaaaccccagaaagtcactgccttttcctccaacttcaatttagtttttacaattttatgtaattcattctattttatgaatcattctaaaccatggcagttcatatgaacacatcaatttatagctatctccattttgtagaataatttgtggtctctggttattttctacttttattccatttctataaaggatctgttacagtttgggtactgtgtacaggctagtaaagagtagtaaatcaatatcaggtccatgtgaaattgggt

SEQ ID NO: 131723 - DNA, 1301 bp, Homo sapiens
cagacactgagtcagtgcttaatctaatttaaccctcataataggaatttaagatatttactataattacctgtgttttaccaatcaagaaatgagtccccaaaagggttaactaccatccttaaggtcaaacagctagtaagctagagtcgaatttctggtttgattccatagattaaactcctaaaaccaaatggtgtgctgcctttttcctactgaaaataattatagtcctttctcatgatatatttttcatctgtagttccaattttgataccactaggtaattttttgtgtatttggtctcagttcttgttagtgagaaaatttatatatgtttggatacagtcattccatatatgttggaaagcttttaaaaattaaagctgtgaaatatgctatttccaaatggtttcttccaacatctattgaagaactttagtaaccaatttgagataattatttgggtgtgatgatttaggaaaaatgtttatcttttcctttaatataaaagcttggtattattaaatgttttacaatgtatacagtaattaagtcaaaatattaaatatttccctcttagcttaatgtcacctaatccacttgtgtaaagtattgtacaaaatcagaccattgaaattctgtgtaatagaaatgttaatataagaagaagatagatctccacctcccccattgggggaatattgtttcaaaagggaagaaccattcagtacttaccatatatgaataaattggattgcttttaacattttataagaaatttgtgtttccgtacatcagactttgacctctaaagcaaatagctatttgtatttcctcatgggaagcttacagttagaaacatatgctgatgttggagagtaggtggaagagggggatgccacaggtgacgggaagtgctaacttttttcaagcttcttataatgagagtgagtggcaagttgtcttttttcttaataaaaatattgttttatgttttgccttatttacatttgccagcaacgggatctttggagaaaaacacatagcaattggaggaaaagtacagcagttggagggaggaggatgtgggtagccgtgataccatagtttgcctccccttttgttactctaccttccaggtttgaacctggtttcctggatgtttctgaccccatttcccactttcatcctcactgcattatggaaatcttgggcaacatttatgccaatgccgtattttcactttttgtcctccgcaaacctactaagttgtgataattgctggctccctgtttgct

SEQ ID NO: 131724 - DNA, 1026 bp, Homo sapiens
ggctgccacaaaggtctctgagatgccttcaaggcattttccccattgtctttgatttgtcattgaatttgggcggagacacaaattcaaatcatatcaacctggtaaagaatttggattttattttgagtgtgttagtgagtcattgcatggctttgagcagagaaaggatgatttatatgtttaaaagagtgctttgcctcttatatgtggaagagattgtaggaggaggctgggttggaaacagggagaccagcaaccctagcaggaagtgagggtagcaagaagtagggaggtgtggcagtgggggaggtgagacgtgctgccctttaagctaatgataaaagtgtgttgaggaggatgaggggagtgtcagggcagatgctcctggcaggcaaggtaaggtgtgagggctgagtattgacactggaattagcaacgtggaagttacctgatggccttcccagtgcagttttggtggtgtgggatggggataaaagccacattgcagtgggtttaatagagaacgaaaggagagaaacaaaagatgctgagtgttagattattccttttaaggaattttgctgcaaagagaagcaagggaatagggtgggagctggtgagggaaatagaatcaaggtacatttctgtttatgttttaagatggaagaaataaatgtatttatgccaaacagaagggtactgaaaaagaaaaactgaagtaggaaggaaactcaagataatgtattgttcagaatgtcaaattttgaagaaagtgttttcaggaaggcgtgggtgataactgggtcaagagctgctagttcagtaagttgaagtgtgagaattgtcctttagatttagccaaatgcaagttttggtgaccttgacaggcacaggtttattgtagtgggcataaaagccaaactggaatgagttgaaagaatcggagtttgaaaggtggaaagaaacagctacagacagttcatttgacaagtcttgctataaagaggacaggaaagatgatgt

SEQ ID NO: 131725 - DNA, 1052 bp, Homo sapiens
aagactgggttaggtattcttttttctgtgtgttcagaatgccctttgcttttttctttatgaaagcatacccacacttgcttgtctggtctcttccacttgtctgtgaattcctcagcaccagatattcagtattcatcatagccattggcagacaggtgctaagtaaatgttgtttgatttaaaacgactaccaccactgatactgtaaaagctaaatatatagaagtatctgaggcttatataatgatacattttaaaaaactgatcatccatgcgttgtagcatgtgtattagaaagaggtaggtacctgaattccattctaagcttttttgttgggcatctttcagtgagacatacgtgttctctgagcatcaatggctttacatttttaaacattcaaaattactgattcatacaagagtgtgcatacttcatttgtaaattgtgaagcctaaaaataaaactcccacaaatccgccgctaattgaggaactagaataattctcaggtttttaaagttgcccaatcctatgattgtctccccctgtataaataaccagtatctttaatatgatgtttgatttaatggtattatattgtgtacagtttgccgatagcattatagttctcttattcatctttatcgtatgtagctggagttaatttgtttgcacagtattatagttcattatgtgaatattgcacatgaacttcagaaggaatgtcagactaatttcccaaacttctcatagtagtttacacttccacccaattgtgcccattgctcttgcgttttacatcagcctagtgtaattttgaaatatataatgaaatgaaacttttctaaaataaaatatttccagaagtaatcattgaaactattggcatatatttattttacagcatgatatataaagaaagccatagttaaaagcagaatgctactccacaaaaaaaaaaaattctgacaattttggtaattaaatgtgacagtggacttgtgtgaccaggcttttcttttgagttgttgacatgaaataaaattcat

SEQ ID NO: 131726 - DNA, 1069 bp, Homo sapiens
tcgtggtggcttacctgagcctgggatgtccaggccgcagtgagccaagattgcatcactgcactttaacctgggtgatagaacaagaccctgtctctaaaaacaaaaacaagggtgggcgcagtggctcatgcctgtcatctcagcactttgggaggccgaggtgggtggatcacctgaggtcaggagttcaagaccagcctggccaacatggtgaaaccccatctctactagaaatacaaaaaattaggcaggtgtggtggcgtgtgcctgtagtcccagctacttgggtggctgaggcgggagaattgcttgaacccaggaggtggaggttgcagtgagccaagatcacgccatgcactccagcctgggcaacagagtgagactctgtgtcaaaaaacaaaaacaataaaaacaaaaacaaaaatccagcccatcattttattagagctggtacaacagttacttctatgacagtccttcagaattgttatcaccttgcttactctgtattttacagttcagaggttcttaacgagtattttttgtgccaaggacctctttggcaatcttatgaagcctatgaatcctgcctcagaataatgattctaataatgattcatgattgtatgaagtaaactacataggattaagaaggaaacgttacattgaaaagccattaacaaatactaaatacaaatttgtgataagtaatatgtgtgcttcttacattaatatgtgtgcttcttacattaatatgtgtgtttctcatgttagagaataagcattaggagtaaatatactatatatcataattttaaatagatgttgtgtgcaaaaattgtaatacaaaaatacccatggtttctattaatgacaaattcataggttttctaatactactgtagtttgttactaatattcttgattgaaggaattgttaatttttgtatagaggttagtgaaaaggttcccatccatattcacagatccctgaattctctatggactccccatattaagaacctcagttagtgaaaattcagctagacctttctccatcatactt

SEQ ID NO: 131727 - DNA, 1085 bp, Homo sapiens
gcaaataataggttatggtcacggaataaggattttaataccttgagtaaaactgattattaatacattgaaactgaatgaacttaaactgtgataagaaatataaatatgcctcttttcatagttttaggcccctgctgtaagactaaagaggaataactaactttccttttcttaccctttgcttcataagctatgatgagaattgtgtacttgtcttcgtacactttttactctctgagtatgttgacggtgacaactgggttgtcttacctattgttgtttccagggcttaatatgatgccttactctaaataggtcctccataaatggtggttgagttaatccaaggaaataaataaatatatgtgtgtatgtataaaatgtgcacgtgcatgatggcattcgtaaactttaaagttaactgtaataaaaacttgttttaaagtataataatgttttagactttcttcctttttttctttccttaaacagatagaaggacaaggacagaatcaccagcactggctgaaggtaaatatgtctttgggggaaatgattattcaaatataaatgaaaagttatgatttcaataaaaacttatattaactatatataatttaagggaaatgttctatacacaatattgagttgctaaaaatgttgttaggaaatattgattgtttagtttttggcttagaataggacctggtggggaaaatgtaaattaattagaactttttttaacagctttctttctttaggagaggtatgtgttttcctttgaattaagtcattttagctgtcaccagtatagttgatcaagaaagttctaagccataattttagtagtttaaagtatatatatgtacatatatattttttttcattgaaaacagaagggaagacactttacacataatcttaagaattctatctgttactggttttggtcctttttttaaaaaaaaattttttagaaacaaagaatcgttaccataaaaggtagttactgttaaagggtcctgagtactgaaacatttgtaatcctgcagttgttttaattataacaagttattaagtat

SEQ ID NO: 131728 - DNA, 1017 bp, Homo sapiens
tagttctaggtatatcaaggagggaggctcttaatgtaaccattgtgctttcttctgatcaaactattttgtggtagtaagcatggtgtaggatgacatagaggaatcctcaggtgtttgagttctggtgctgttagacatggttttcttaagagtactgtacttgagatttagtgtcagtagagagatacatattattgtaattttaatattaaatattaaatacaaaaggtaatgaccatgttcagcaaaactagcatttccattaatctacacactttgagtttatttttgctcttttacaaaggaaaaggatgcatagataacctaatttaaataagtgaaaatctgcattttacaaataaagatgctcaaataacttaataatttaaataattggaaatgcaacccaagcctgatttcagaaccagttctctaaaccattttaccatatttgctttttattattagggagtatacatttttttcataatttattgttttgcctccctgttacaaattatcgtttatttttttctgttgtcttcatgtgatttatatacactcccatgaactattttaagacattttggtatcccttatctttaatttttacatgattgattcatctttccattttaaattttttatagtgctttatattttagcatattattcctccaaagataagtaagattctttgttctattttctgagatttagttttgagaaattaaactcaaatccatgtgtaatgtatagtttgagaagggtctgtcttagttttccatggagttatttcaacaccatttacttacttatttattttttgaacagagtcttactctgtcacctaggctggagtgtaatggtgtgatttcagctcagtgcaatctctgcctcccaggttcaggcaattcttgtgcctcagcttcccgagtagctgagattacaggcatgcaccaccatgcctggttgatttttgtatttttagtagagatggggtttcgccatgtt

SEQ ID NO: 131729 - DNA, 1006 bp, Homo sapiens
atggtcaggtttttcaggtcttacagtacaggtaagaatgatgactggtgttttctaacttggatggatgaatggtattggtatgtattaatacataaacttctttaagatcagcgcttaaatcttaaacagtttggtgtttctagaacctagtacaatatctgccacatggtggatatttgatctgtgttgctaataatagctacaactaagtgaatgtttgtgatttttcctaagcagtaaacatgcattctcattgaatcttatttaatgcttgcaacagtgctgtaaggtctgttaactccatttgacaaatgaggaaactaatgcttactagctgtgtgatcctgagttatggtaattgtcagaactaggattcaaactggtatttgactggtttcaaagcctctagactaaaacttttctacctatatatgctatgctgtttcccttcgttgtaaaatacttaagcactgcatattaaatagggtacaaaagacttgagaaacaaattttatcttccctcagttatacaactaacatctgcagccaatgagtagcagtgtactattggatgaaaatgctttagaattatagggattgatgtgggctggagtcctcgggaaaagcctgttgaaagcaggaatagctttaaattggccctttaaggataagaatctttttagaaggaagaaaggaatgcctttttaggaggaaacagatttcagtactggaatgggcataggctgttagggggctctgctctagtagcatgtttattaggagtagcctgaaatcagaatggatattcattcctaagtgtgccagtttgagaatgtatcctgaagagtattgggagctattagaagttttttttttttaatagagcagtgatgagataaaattagtgtctcttatagtgcttgactaatattaggtactcaggtatttgtgtgatagaaataaagtggggagagaactacagaagtaggttaaccatttagga

SEQ ID NO: 131730 - DNA, 1846 bp, Homo sapiens
aatttttagaatagtacttttttttttttttttgaaagtgttttcccctgatttggtttgtaagttcagacttgatagtccaaatttggaattatataagctatccaataaatagaaataacagaagggcaaacagattaaggttcaaacatggatagcaaacgggatagaaattattgaataaatcagtgcagttttgtatttattaggactgaaaaatcttacccggtgttcttctgaattcttggagttgtctcagtctcagtttaataaagcctttttcttaaggattttagtattattttattatgttaccccattgttaacaatcataggtagtaattaaaatgctttgtataggagaagattttccttttccagtttagtgtatatgctaacataaatcttaaaattaagttatttgacttaatttgaagcatataaaaatgtctttggaagttgttagtagtactggtgtttttttaagtatgtaaggcacccagacatctcacttctctagctttctctgacattctcctctagacataatgaaattactccctcatctgttttcccatagcagtttaaccacagaactccagcatagcattttatttaattgtactgtattgtagtaatttgtttacatgtcatctcatagactatgagctttatgagggcagatcttgtttttacacagcattttgtactttgccatacatagaatgtctggcctattgggagtctgtaactgatctttgttgagttttgaggacgtttttaacactatgtgacaaaagtatttttcatagtcttaaaatctattgttctattgctaccaagacatgcggtaatatatgttaccacatatcagatatataatatcactccaaagtggttatctatgcctattggtgcaactgagttttatcagtccagaaaaactatatctatctgtaggctgggtgggcacggtggctcacacccacaatcccagcactttggaaggccgaggccaatcactggaggccaggagttcgagacaagcctggccaacgtggcaaaaacccatctcttaaaaaaataagtaaaataaaataatttaaaaactatctgtaaaacggtggtggacacaccttagagtatttcatttgaagtctctttatttaatttttaataggagaaattacatatttttctaaattttaccagttttctgctaacgatacattgacctctccttatctctcttttccccaaacaaatcattttagcagaatgacagccttttggaaccttaactttagacgggttgcatttattctaatgtacttatattatttatgatgtttgcttattcactcattcagcatctatactttggagactgtgatgtttcaggcattgtgcttagtgcagagcagagtatgataacaatgaacagcctgtggtagccactttgagtcatgggaaagggtccagcgttttgatgagtgatatgatgtgctgtgaggcctacagagaagatttttaactcacacatggaatatacctttatctcacactgtcctgttctctaaatttctgttgtaattgtagtctgtaacaatactttggtgttgacagaattattatgaattcgttactttttatatatgcaagtattatttccacaggaagtcattaactactttcaggataaagattgttgttttcttttttcaacccttagaaaacgtaaaaagcattctagtgtgcgggtagaacaaaaagccatgggattaggcatggtctgtgggtggtttgcagacccctgctttagatagacaaagcaatattatcatat

SEQ ID NO: 131731 - DNA, 1853 bp, Homo sapiens
atggtgttttttttttttttttcttaagagatggggttcagagtcgaggtcttgctgtgttgcccaggctagactcaaactcagggctcaagtaatcctcctgcctctgcctccttaataactgatgctacagacgtgtgccaccacacttggctgttaacggtgtcttttgaggtgtaagcattttcacttggtagagtctagtttaacttttttttttttttgctgttaagaatggtgcagtgtgtgtcatatctaagaaatctttgcctcaccaaagattatgagatttactcttgtgttttcttctaaaaggtttctagttttggtccttgcatttaggtctatgatccatttttgttaactttatggtgtaagttactaagttcaactttttgcctgtggatttccggtagtctccgaaccatttttgaaaagactatcctttcctctactgaattgccttgatgtctttgttggtaatcagttgaccacaaatgtttgggtttttctatagacttttatttctgtttcattgatctatcattctgctagtaccacatggcttgattactgtagctttcatactgtattttaataatgaaaattcttgtaaacatacatgctcatatttataaaaaaattgaaacaatatagagtagtaaaagaaaaaagcaaaaatcaccacctaggtagtcgctgttttggtgaccatctttccagccatctttatgcatatatatatgttagatgactacacacacatactctccacatttattcatagagacatatccgtatttgcctacgctcattgttcttgtgtacttttttgagtgaatacatttattgtcagctttaagagagaactgattatttttctttctgcagggacttttgtaattttgtgcatttttactgacttaaacttcttagcagaccgaagcctctttgagctaagaactatgagtgcatttttcttggtagcatgtttaaatggaatttacttctcacttcatctggtaaaagatgactttaaaactttttttttcttgtggagacagagtctcactgtcgcccaggctggagtgcagtggcgcaatctcggctcattgcaaccttcgcctcctgggttcaagcgattctcctgcctcagcctcccaagtagctgggattacaggcacgcaccaccatacttggctatttttttttgtgtgtgtatttttagtagagacagggttttaccatgttggctagcctggtctcaaactcctgatctcaagtgatctgcccacctcggcctcccaaagtgctgggattacaggcatgagccactccacttgactctaagacaattttttaaatgtgtgctctatgaatgcagcacattatgtgtagaacttacaacaaaattaattcccaaatccagttttaggcatttaaagtttttataaatctgctcttgagtattagattaactttttggcagttggtgataatgagtgtggagccagtagatatatgtgtagtgatacagaattttatttgcaatcatgtgaggactgatccccactgcaagcttagttttatcatgctaataaagaaatagccacctttgttcttttgcatttcagaatttggtcccagttcctgttgaaaatatctcaggatccagcttcattgaggggttacaaggttgaattcgcaaattctgaaatgtttctctccgctagtgtagatcacatcccattattaggaactcctctgacacctgcatttttcttgtagtatgattttatatggtgcatacatggttcaaaatcatatttagagatgtaacagctctaggagac

SEQ ID NO: 131732 - DNA, 2028 bp, Homo sapiens
ataattatattttgaacaattgagttaatggcaaggtcaaagaatcttagactgtaacagcattttgtaattatgtggcaaaaaattttgataaagatgttgattgccctgagctgtagttttttcaggtatcttgtatatttttaagactgctggctgggcgcagtggctcacgcctgtaatcccaacactttgggaggccgaggcgggcggatcacgaggtcaggagatcgagaccatcctggctaacatggtgaaaccccgtctctaccaaaaatacaaaaaaattagccgggcgtggtggtgggcgcctgtagtcccagctactcaggaggccgaggcaggagaatggcatgaacccgggaggcggagcttgcagtgaaccaagatctcgccactgcactccagcctgggcgacagagcaagactccgtctcaaaaaaaaaaaaaaaaaaaagactgctatattgggttatctaatttgctttgagatctttgggtgaggaagtatagacatgattttgtgttatactttagttcatagaatggatttgtttgcttagaatgggcacttgatatatgtatcttgtcagcattcatgaacaacagtgaattcaaataatttattgggcatttagagtttctacaattatacataaatgttcttggatgtgtgaactcattctatattatgatcagttcactaaatcctggctcttaattacgctgtagtattgaacacctactgtttgccagattccttataaccattaggttagttttataacaactctgtaatgtgtaggttaacttctatttaatttctaattaacattaggaaagtaaggctcagagaccttaggtatgccattaatcataattaaatatttccaattaggtatacttgttcaagtatactcccaagtgggagacgttgaagactggcatttgaacccatcacgtttacttaaattctatttcaacctactaatttgaggtcttatattttatattaagtatttgtaaaacatacttaaaacagcaaatctcaaaactttttctttttcagctgccaaggaggatggataatgttcacttgttctgtactctcctgtaagcatatacaggattgacagctatagcttcacccctttcccacttatgcaagtaattagaatgcaaatgagtcacatttgtaaactttttaaacaaagaaatcattcttagaattttgattatttaaatataaacatttcttgcaacacaccttcacatctcgataatggtaccatgggtcagaatgactactttcaaagatattgtgtgattttgttgaagtagaagacttaatgcagagatatatttttgtagctattcattttgaaaagattgatcatcaacattaaggtactattgtatgtgacactgtgaagcctgagtcctgtacagttattttctgctaatgcagtaatctcttcttggtatattttagttgatgcattatgtatgatatatattaaattctagattgatacagaccctttctactgtgtctagagcaggggtccccaacccctgggccgtggcctgtttggaactggactgcaccacaggaggtgagcggcattactccctgaggtctgcctcctgttagatcagcggagatagcattagattctcatagtagcatgaaccttgttgtgaattgtgcattagaggcatccaggttttgtgctccatgtgagaatctaacgcttggtgatctgaggtggaacagtttcatcctgaaaccattccccctgtcgccctgtccgtggaaaaattgtcttccacaaaaccatttcctggtcccaaaaagattggggaccattgatctagaatatttattccttccaatcatacattggtatgtcttcagataatccaaattaacctgaatactactttaggtcaagcattttcagaaaacacttgctaagaaagaaattatgacatagtcccggatgtcataatgtgacgtaatatgtca

SEQ ID NO: 131733 - DNA, 1527 bp, Homo sapiens
aattaatgatcagcgtttaaagtccagattctcagtcttagggtgtggtcttagtgtgtttccaaacgcgcaatttctactataattacccaaatctataactgtcaaactctagtggaagtggcaattgctgtgtgtgtgtgtgtatgtgttttaacctcatggctattctgggtcatactgagtaccttttttatttttttcatggaagacttctatgatggattaatttcctctgagtgtaaaatttggcagaaaattagtattctttctactcctctggattcctcctcacttggccccttgactgatttgcaacattacctgttaatacattgctgtagaaatgtttgttggtgagactttgttgtctcatctgtcagcaacattgtttgagtacccctatgtgcggaatactgatgaaatgcctgaatccttggagtaccacaaagtgccattctggataagacaaaggtttttggaatttgcttacacgttttttgctacttctgtgtaagtgtattgagtttgccacctttttaccccttaatctctatgtgaaaaatgtatgtcagtgaattttgtgtgttttaagtcttacggtgtgggagatcggcattccaaaggagtgttttatatagctaaaagaatttcagtcactcgggtgtttggtgacttactatcgcaaattattttagactaatatacctcaagaaaaacacactgatccttttaattctttaattgtatttagtaatagaaacagaagctttgtgtctagaactgcttgataactggggtttatttgatagcctgtttgcaaagtgttgcagttaactgaaactccctaatcagcattcataaaatgaaatgacagcacttttttttttcatgtgactttcatatccataataacgaacgagaggctcttagtcctaaagtacacctacctgcatatcattatgatggtgctattgctgtaagtatttatggcagcattttctaacagcttcgtttttggggagcttggtgttaaaaaggtacttggctgtttgtccccgcttaggttttggataaccacttcagtagtaagatttcctaactcatgagagagagagagagagagagagaatgtgtatttgcagaacagttttgctagataataatgtttaagaattctttaaaactttaatagtgatgtagctgtttgtcagggaactcttgctttgtaaaatgttctaggatatatagtatgaattctagattatataattgggtagaggctagatttttgtctcccaagaaagtggttggttgatcagagggaggcgtggttagtaagttaattctagctgccccagaaaaagtataatttcagatgttgagtaaaactaagtgaatgcagtttatttttgatagatttttgattgacgtttaacttaatcgaacttaaaattcatttttctgaactctccaggaataaacgggttttaaaaatttacaggttaaattagtgtccctcttgag

SEQ ID NO: 131734 - DNA, 1062 bp, Homo sapiens
aaaaacaccagtgacatgctagggaatgagtgaaggtaggtggggttcacctttggaagggtgatggggggttcacctttggaagggtgatgggggaactgctttgaatccgaaggctgacaaacagccaagtgaagagactggaaagtgtacttgaggtacagaagggaacagccaatgtgatgcagtggcacccttttttcttcctgcaggtcacctgaagggttggggaaatgagacttggagttgccccacttgtgagaaatatgttagatttgcagatgtgccggaggctcatagataaaccttataactcgggggaaatatggctctaaggacagctttatggctcctgtgagactggttaatgttttgctaaataacaggaaggtgtcagtttgattggttgccttcttacttgggttctttttgaatagcggctctgatgtcatctttcaatgctggatgagcttctagcccttcccaggggattctcaggcctctgtcccctgtcctcttcccctttcttcgttaaatatccatggagtcctcatccctaaggcaacactggagtccctgactatggtggaaatgtttggagctgttttctaaaggattcagtgttcattcatcctgtgaaaaggaagagagaaacagttgatagaactccctgaatgttcaattgaggagcgagactggatacagaggcagcaaaaactatactctaggtgctgaagcatattgaaagatgtctttgagtgaaggctggcagcaaaatatagagtcttctctaaggacaattgggcaataacaaatcaggatctaaaaaattttcagatcctttgacccagtaattacaatccagggagcttacgctgaggtcagagtttttttaaagggaaaaacaaagaaaacaaaatgtctctaacaaaagttaacagtcaataatgacatagtgctttggagctttgaaagtattttcttatacagtcttcatgagagcttcccaacatttccgagaagtagattgtcttatctccatttcacagataggaagcaaag

SEQ ID NO: 131735 - DNA, 1191 bp, Homo sapiens
gcaatcacgacccactgcatccttgaccttttgagccaaagcaatcctactgcctcagcctcccaagtaactgggaccacaggctcacaccactgtactcggctaattttcctttgtttttaaattttttctacatacagggtctcctcatgttgcccaggctggtctcaagcaattctgggctcaagcagtcctcccaccttggcctcccaaagtgctgggattacaggcgtgagccaccacacctggctggaattctctttttctgtaggcaaagatttaattctgatggtatgctatgtaaggtgggtggaaaagcagagatgaactaacctctccataggttttggggtcacagtggggtgaagctcagaagtgaacggcccaccctttttctcccttccgttcctctggagccatctatgattttatggcatcttgtcccttccttcaggtggcgccctcctgtgcctgtgccttttcctgatggaaggaatgggattgtcagagctaaacatgccaagtgagcagtccttcgtgctgctgaaccacaccaggggctgaaagagctgtttgtggaaggggtggaaccttctgatcatgccctcttggattttttttgcagccagtgagtctgtaaatggagccatgggcttggtctgcaaactgcttacagcatcagtcagcatggtggggaacagcctatcccttgggaaaaacctctcctcgagggtagggcttgggaagaagtgaaggcgtgcagaaaatcttttcctcttctccctattcaaatcttggcaagaaagcacactcttcatttctgtttcctgtatcagcagcacattcccaatttgaacttcaaggcatcgtccttgcttcgtcatacatcagcttttccggctgcaaacaattttgcttctctagttgacgaggactctaataactccaggtggtgaatgggcggtggggaatacagttctgtagaaatacagctctaaagcaatacaaacacagagggaaaaaatgggaagcttggcaagggggaagtgctggaataaagcattttacctttattgacattgaagaaacctcccttcagctgaactccagaatcattcaacacttcatggttgagctgcacagcggagtgttatatagcctttaacagcgatgtggctgacgttcctttat

SEQ ID NO: 131736 - DNA, 1036 bp, Homo sapiens
ttttaatgtattgagaaccttaggactatataactttattattatttttttgctttgtttttcttttgagatggagtctcgctctgtcacccagactggagcgcaatggcacagtctcggctcactgcaacttctgtctcccaggctcaagtgattctcccgccccagcctcccgagtaactgggactacaggctcccgccaccacacctggctaatttttgtatttttagtagagatggggtctcgccatgttggccaggctggtctcaagttcctgacttgagtgatctgcctgccttggcctcctaaagtgctgggattataggcgtgagccaccctgtctggccaggactatgtaactttaaatcatgagaagacatgggagtcattgagagcaaacccttcatttctgaggtgaggaaacaggtccagagaaaataaatgacttgctcaaaatcgtactgcccccaagtagcaaagcaggggcttacattgtaattaaagtgattttcattaattctaaagatggttctttcagaatcctactatgccctttccctatagtgggaaatttaatttgtgtctggcttttattataaataatgctgcagtgggcagctttataccaacagcatcttaatgaaagcaagtctgttaataaaaacaataataataagtaatagaaaatgttaatatttactgagctcttaaattttctgtgccctgtgctaagtactctacatgaaataatttacatctgacaatgagtaccattagtttcttcatttttttttttttctttgagatggtcttgctttgtcacccaggctggagtgcagtggcgtgatctcttctcactgcaacctccacctcctgggttcaagtgattctcctgtctcagcctcgcaagtagctgagattacaggtgcacgtcaccacgtctggctaatttttgtatttttagtagagatgggcttttgccatgctggccaggctggtctcgaactcctgacctcaggtgatccgtctgccatg

SEQ ID NO: 131737 - DNA, 1047 bp, Homo sapiens
aataaccatacaattgcagtgatggtgtgtgctgtaaacaagaagcacagaggttgagagcacgtgcacaggggatctgacctggtttgctcaaaatggcaaatgcatggctgtgatgaggaacccaggccaatacctgggggctctaggcattaagagcagcaagtgatctcaagtacaagttgggaccaggtgaaggggtcaagagtccgctcacgaacagcactagggtccctgttattggataaagtgcaggacaagtccttccctggacatctccctgccaccctcccctgaccttcccaagctggaaggaactcttctagccctttaattttacaggatatatcatccgtgtcatttatttggcagttgtgcgttgctttgtattggagtaagtagtgtgcctttcatcccctagaagacaagtctgtttcctacactctatgtcccccaagtaggtgaccctagatgaaatgcttgatggatcagttggctaatgaaaatgcctgtggcattcagttagtcttagaatgtgggcctctttcttcttgcctccaaagcagctgatcaacagaaggttcggaatgaagaacagtaacacgtaacagttccaagtgttcctttgtgctaaaatttaccaaagcttctgtggattgaggcagttaatggggggaaattctatcaacctaggagtagtttaatagatattagcttggaattaaaagttcaaggtaaattgtctttcctttatctactcacttttctttctgcctgtgtgattctatttccattaatagagtaactaccagccatgagccttctgtttgctttggcccctcctatctttccttattttctccatcaggttctctcccttggccacttctgcttcctcttctcttccatatttctcctgttcacactcttcctttttaaaatgccatctttttggacaaacaaaatggttcaaaacgttaaagaaaaatgaaaaagaatattatttcacttccacattcatcttgttatcattgagttttaccttct

SEQ ID NO: 131738 - DNA, 1060 bp, Homo sapiens
ttgaagaatctaggagtgaaacataaggcctggaggatccaaggcttaaagtgttgccaaggcttacacagtttttcaccatctttaacgctgcctcccttttcttgtggattgtggtccaaaatggttgtcagcggttctagcaggaggtaaaaaaaggccactgttccagtagttcaacaagtcttagaactgagtccaactgtctttctgattggtcttttctgggtaacatgcacagccctgaaccaatcgctgtggcaggcaaatgcgacgctctgattggccatcttggatcaaatgccctccccctgagggagattgggtgcagcttgcacctgctcaggtacagagactgagaatgagggaaagattgcaggtttccagggaaatgcgggtaccgtttgtgaatggtgggtaggcaaaagccaaggatgtccaatatagtaggtttttaatcagtgtttactcagtgaatgaattaacagatgaatgagcaaacaggagcgtgctgctgattctgcgagctggttatgcaataccccgagtggggttttaacagatggagactttgcagaggggagggatagaagagggctctgaaatcaagtcatttaaggataccattaaattagctgaaatatttaacaagaaataggagacaggggagacatatgatagctgtttccaaacgtaaagggcattcatagggaagggacattttctgggtccctattttatgccatagatgctgggctagacactttaattgacatcaccccacgtttatttttattttaatttatgttatttcatttttttgagacaaggccttgctctgtggcccaggttggtgtgcagtggtatgattctagcttactgcagcctcagtctcccaggctcaagcaatcatcctgcctccctcctgagtatctgggactacaggcacacatcacacctagctaattttttttctttttctgtccttctttcttttgttctttctttctttctttttttttaaacagggtttcactctgttgcccaggctggagtgcag

SEQ ID NO: 131739 - DNA, 1038 bp, Homo sapiens
attaaatttagtgacctggaatacttctggcagcatggtggactaagctgacttgtgtgagtccttcctggtatgaatacagaattgatggaaatataagaattttatctaggggagcgctgaagaaagggaaacctgcaaatgtcaaaaatgaggataggccggccgcggtggctcacgcctgtaatcctagcactttgggaggccaaggcaggcagatcccttgaggtcaggagttccagaccagcctggccaacatggcgaaggcctgtctctactgaaaatacaaaaatcagccgggtgtggtggcgcatgcctgtaattccagctactcaggaggctgaggcaggagaattgcctgaacctgggaggggaaagttgcagtgagcagagattaagccactgcactctagcctgggcgacagagcaagaatccacctcaaaaaaaaaaaaaaaaggaggacaaatttaagctaaatggtggcatgtgagctgaagccatgactactcctggggcttttgcacagaagctatagagcctgagggccaaagttttaatggcacggtggctctaggaaggaggcctggactcaaggtggaattgagtgctctggagccttgaaggtctgactttttcatgaaaaggggctagaaaaacttcaatacttggagaaatagagaggaagcttgacttgactggaaaaaaagttaccagcaagaacttaaacacatgggattgtactatatatggttgtggaatctgtattttttattacttatgaggtatgagacccttcaacctgaaaaattaacgtaagaactggtctagtaccatggaaacctctactgcgaacgcaaagtcattccataggcatatttcaacaacctatacctaacagcactcccacagtgagaatgacctctgaagacgagttcacaatgaaaaactatattcaggaaaccattccaagttggaaataataaaaccatttataagagactataaaaatggtatatttaaaatgattaagatgtctt

SEQ ID NO: 131740 - DNA, 1058 bp, Homo sapiens
gtattacctccttggggaagtctttcttcgattatccatcactttccatcccctgctgagttaattaaatacccttttcagagattgcctcatcccctttccttcagagcgttcatctgcctgtaattgctcccctaatcttggagagctcctgggtggctgggacggtttaattcatggaattatttccatggccacaatgcttggcacacaataggtgatcagtagctattgagtgaatgagtgtcctcactttataacagaagttaagtgacttgcccaagtcagatgctccgaaagactgagaagggatgagacacatgctatgaggctgaagaggaggcgagatctggtttctagagctgtagtccaggctttctgcctatagcttggaaatgaaaagaagccacacttgtttagaggcccatgttacttctatcagagccacactctatgccctgggtgtgctgggtgtgtgagtgatgtggggtgtgtgtgtgtggtgtgcatgtgcgtggggtatgttcctgggatgtgtgtggggtgtgtgcatgggatgtgtgtatggtgtatgtgtggtgtgtgtacatggaatgaatgtgtggtatgtgtggagtctatgtgtgtacataagaggacatagtttgtgagtatgcagtatgcttagatggttcttttttttattttctttggagacgggttgctctgtcacccaggctggagcacagtgcacatcatgggtcactgcagcctcgacctcctgggctcaagtgatcctcctgtctcagcctgccaagtagctgggactacaggcatgtgccaccacgctcagctaatttttaaattgtttgtagagacgagagctccctaaattactgggctcaagtgatcctcccacctcagcctcctaaaatgttaggattacgggtgagccaccgtgcctggcctagatggttcttaaatcctcttcttggccactgagcagttcggtgattattatttaaaagggaatgtgaaaccacactcatgccatagcaagaagaacgacagaaagaaaa

SEQ ID NO: 131741 - DNA, 1106 bp, Homo sapiens
tcagtctagtttagaaaaacggtcatgaattctgaattaaagtaattctgaatatccattattattataaatagcagatgtttattgcatatttgctataagccactgtactgggggaaagttttattaaataaagcaataaagcgttgttagaaatattacagagctcttgtaattgaacaggattataggcataagtttataattttattaacagggatagaatgaatcatggtaaagaaaaaaaaacaagtgataaacaagccaataaaataacaagatgaatccactgaggggaaggagtaattatttaaattttttttttgtttaattaacatttattgtcttctgggtaacaggcactgttagggacttttacatctgctattttatttaattacaagagttcttcatttccagataagatttcccatgggcttcctttgactaatgagttatcttagcctggtgcttgtcagtcccagctgcacatgaaaatcacctggggagctttggagcaatatggtgctggggtgcttccccagagagtctgtttaattatgcagagtggggacccggctgcagtatttttaaactctggacaaaccagagatgtcatttcacttgcaggaaaaatacagcaataagcaactgctgcaaacttctgcagtagagcatgctatgccaagtagaataagcaaaacacctgttttccttcgtctgtttcctattaagtgggatgtggaaagtgtcagaataattatggaatgaagcaggctagaaaatgttgctttaaaagtctcaaacccagaatttccaggtgctcttaacttgtagcctgggttttgctccgtggcgtttatcagaaacatggtgccagtgacttgcataataaaagtttttgtcttttttattttttaagaaaaaaggaaactatttaacaatcttttatactaaaggtaatgtgttttaatgaaatacatacatatgtccagagtacagaactgtggataaaacagtttaggaggacacagaattgtaaggaattctttcttttggtggagggattatgggtagaaatgtcttccttaaaaatcatctgtttc

SEQ ID NO: 131742 - DNA, 1076 bp, Homo sapiens
gttgtctgttggcgtgctcgcagggttccaaccgatacaaaaactttacattgaagacatcagggtcagctgatggtggctttgtaaggtgtattaaagggacttgcgtcccagtctgtaggccgtgggagccagcggaggatttgtgtactagaaacggtggggccgggcgcgatggctcacgactgtaatcccagcactttgggaagccgaggcaggtggatcacttgaggccaggagtttgagaccagcctggccaacatggtgaaaccccatctcttctcaaaatacaaaaattaactgggcgaggtggcgcctgcctgtggaatcccagctacttaggaggctgaggcaggagaatcgcttgaacctaggaggtggaggttgcagtgagccaggatcgtgccactgccctccagcctgggcgacggagcgagactcagtctcataaaaaaaaaaaaaaaaagaaaaaaaaaaagacaagaaaaagaaaagaaaaggtgggaggtggcaggcgagagaatgtagtccggggcccacaatgagagagggatggtgtgtttgcatgaatggagggcttggggacttagctcagcctcccaggtgccatcaacaagccacagtcagacccgaaatggtagccagggtaggaagtgggacctagtagcaaccagcagcctctcattaacccgcagaacattgtgtcagcgttatgttgcaagtgacagtaaccaaactcaaggtagcttaaatctagaaaagatcatttattgtgtcaagtcactacctggttaggcatggctgatccaggggccccagctgtgtgggccaggttttgtctcctgtgtcgtggccctgcttttctttcttgtttctcaagcagtctctcctttcaagatggcaagaggccatcagcttggattcaggtttttatccactcatgttagcaacgctgtagggtagggggaaggtacccctttcctagtggcttcagccaaagtgtgagagaagtctcttactgtctagttaggggcatatggctgcatttgagccgtctattggttctggaggttccg

SEQ ID NO: 131743 - DNA, 1087 bp, Homo sapiens
gaatgataatgccagattcttaccttgagtctcccctgccctttcccacttggcttctgtttccccacggcccctctgtcctcctgggtcttcccactggcacttcctcaggacatccattctgcttcactgtgtgccaggcactgtactaggctcagaggatgcagtggtggatggggtggatgagtccctttcacatctaaaccaggaagtttagatagaaggagacccagtgctgatacagggagcttgtgatgtagggaagtctgagctgccgtggcctgtggggtgtgaggtgggggttgggggacattgatcccagcctgagaggttaaggagggcttcccataggaagtggcaaccaatcggctagcggctgtgattaattactctttaggttcttagctctaagcaaagtgccttggtgttcaatgaatgaatgaaggagtggatgcctgtaaaagtgtcttacaaactggagtgtgcagtgcaaatggtaagcgctggtattatgattgtggagggtagagcaggggcacctaaaacagggttcatttcccagtttcctgaggaccagctgctgaccaagagctaaggtctgcccaagagcacagccaactggcgtgttggggtcagcctctgtgtcttgtcttccacccagggaagcagattgccatctaccatgttgacatctttagcctacctggtagcctgcagcccttcctaaaaggacctaggtttgcatatccaggcctagtcctctggaccacggtcctcgggctggtggctgattaaggaggtaactgactgggaggaagtatgtgtgtgtgtatgtgtgtgtgtttagaaatctgtgatgcccagcaaatgctaaaaaacatctggaatgcaaattcacatcactaacctctaaccctccatgacagttgccatccccagtgaagccttctctgttctcctctcctccagcttactgagcttgtggtcagggatggcaactcattcatctttgtaactccagtgcccagcacgaggccaggcacatctgggtcttaggacagtttgctgaatgaatgaacaagcttca

SEQ ID NO: 131744 - DNA, 1074 bp, Homo sapiens
agatggatcaggtccttttgcttcagtagaactttggcaattaagtctttgatagtcttaaaatgggtgattggcctcaccaggctgaaagaaaggcaactttgttagcctaggatgcatgaggttgagagcaatattttttttttcctctcctccttttctctttctagaggcagtgaaggttttggggccctacagcctgggttcacatcctggctctgccactcactagctctgtgcccttggccaagatacttcctttctctttgtctttctcttcatctttcaaatgaggactaacagtcgccacctggaagtgttgctgtgacgatcaacccagaggttgtatggaaagtgcccagcagagagcatggcacctagaggtgctcagcaatgtctgtttcttccctcagcccctggtgctctttctgtccctcccctggtcccatcatctgtccctgcatccaatgtcttaccctcccctgacagagcttcagtttcctttgggaatagagcccttggctggcaggtcattcctggattaaacttggagcctccaagctttatgaagtccaagtgtgctattttaaaccaattgtggacttttgtgtggcgcttccgctgaatggaaagataattgtaccagagcttgtcgagaagagtacatggacgagtcatggagcttacattctgtcccattgattttttttttccttcttttggaggacttactagctgccatctgctccttgaacatcgtgttcataaatatataaataatcgaagttgatgaggaggtttgcttaaagaagtgttgctgagagtgatttttataaatatttaagataatctgaaatcattaaaggaattgcggggtttattaaaaaactgaagacgtgttttggaaaggatccttttctttacaagctgaataaatgtcaagagtagagaaatgagggaagagagctttctgaacgtggacatgggatccgtgtgggtgagtgggcagccagtctgtctgactctgccaggcctcagcgttctttttttttttaattatttttatttttattt

SEQ ID NO: 131745 - DNA, 1100 bp, Homo sapiens
cttggataaagcatgtcccttctgtaagcctcactttcctctgaaaaataggacatgattaatcgtttctcacaaggatgttgaggaactcactttgtaatctgttaatattattataatcaagcagtgatcatgttctttgctaagcaactgatgactacagcagagatacctgcggggaatgggaagctgtcattggtgtccctagcatcattcctaggggacattgtgtgtgccaccattacgtgcctcgccagatgtaaagatggtgccacacacacatgctaactgtgatgtgaaattcacaaagacctcacacatgcatgatgccaactaagaccacacgcggtgggtgggcaagccttcaggagagctgggcaggcctggttgactctgttccactcttaaaaccaccttcctctctatcgatttggcattggaagccaatatgcacgattttgttttttctattgaaggcccattacatgattctctttagtgcaatcaatactaatctaattgaggtaattagaaaatttttacaggtaactggcttacaggccaatgcagcagacaataaaattgccattcgccaccatcagtctcaaactttcacagtattcttcctccacggtaaccagaaaacaagtgatagtacatagcagccttttttttttttttttactggctagaacaacactttactcacaaagagaagagacagaacaagattagctttgatttgagtatggtaccccgcagtgggtcttgccaggcagctgacacagcttaatggtctgtatgcatcctacctgggctgtgggcaaagaaaccccttccttcccaactaggaataggtaatagtactgggattggccaggtgccatagcagccttttcatttgcttttttttttttttttcttttttaaatgtatcacacaagcctggagagaagggattttctttagccccacttaacagagaaaaggcttagcaaggtttgtgtgaggtcacccagctgtaaaggcagccaggcgccctggttcagagcaaggactctagagccccacgcctgtgggagagcatgtcacctctctgg

SEQ ID NO: 131746 - DNA, 1173 bp, Homo sapiens
taatcccagctactcaggaggctgaggcagggaattgcttgaacccaggaggccgaggttgcagtgagcagagatcgcgccactacactccagcctgggcaacagagggagactccatctcaaaaaaaaaggaaattttgaaagcattctttagatgattatgtaaatacctttgatttgatttacttgaataatattttgctattgatattctagcacttttagatcctaaatgattcttatttgttgattagcaccagttctgcaaagactgcccttggcccaagagttcttcctaaactacctcagaaaggtaagatctatcatttttacatttacatgtaattaaagtgtcactaccccctccaaggggcccaaggtttttatctcccttgttcattgatccatcccaaatgcctagagcagcacctggcatgtagtggatgcctagtaaatacacattaaatgacgaaaggtatttataaactcaaatttggtgattagcaaagcaccatacttttccagaatacataataattttgtagacattacattattataatccccaggaaccattctttctccccttataaacataatcagagagacttgggaaccaacaccagctctaccacttagtagctgtgtggccttgggcaggtgacgtagtagcttcactaaacctgagattcctcatctgtaaaatggggaaaataatacttcgtgaggttttgtaaggacaaaatgaagtcatgtttcagaaagtccccagcaagtgggtggcaaaggaatccttccctaggatggcatctgttgtgcagagtagagatacccatgctctgcaaagtacaagaaagcagtgtctataaatactgtttttttgccaagctaagacactcagctctttgactgagtcttctttaatgctgacaaggttttcatttgtgaaaccaaaatttcagtcttcttattacaacacaagtgatagttatgccttttttgttgtcgttgttgttaccataccttacctttaaagctgcaaaatacctttaggagcatctagatcattccatccttctataagcctgcaaggccagcagggcccaccttggatacagacggaagctccgaggagctcagggcctgctccttggattttcagtgccagcagca

SEQ ID NO: 131747 - DNA, 1198 bp, Homo sapiens
caggagtttaaggctgcagtgagctatgattatgccactgcactcccacctgggtgacagagcaagaacttgtctcttaaaaaaaaaaaaaaaaaaggccacgtgtggtggctcacacctgtaatcctaacactttgggaggccaaggtgggaggatcagttggtctcaggagtccaagaccagcctgggcaacttagaccccatcttgaaaaaataaataaataaaaaataagaaaaaaaataaatgccctaccttgaagaacatcacagctctgaggattttatgagttaccaaagaagtccttaaatattaagttatatgggctcatgaacatatactgatggttagtttaattaaaattaaataaaactaaatttgaaagcctttggttcttctagtaatgccagtttatctcatttcttcttgtatcaatatcatagaattacagaacattctgtccaggaggtgagcaccctgccagcctctccctcttcagtaggtgcagtcagaccaggaggtgataggtgctagagtgtggtgattcacagtacagaccctggaagagggctgctggctttccatcccagctttgacccttaccagtgacctgaccttgggcaattgactttacttctctgtgtgcttcttcatatataaaatgaggggtgattatactatttatctcataagcataattactatgagtatgtagcacagtatgttgctcacagtaagtgctcagtaaacggtcgttgctgttaataatgttactatcagggcgtcttgatgggtaatgaagagcacattgatttgtggtcaggactcccaggtacaccatttccccacgggacctgcagccatttattcatttagtctcatttccttatcttatgatgccagtctcatgctgtgaggaaggaaggctggatgaatataaaagcatgtgggcaatcggtggtgctattgagcagatgtgcagtgtagtgaggatcagttagttttttttcagccctgccctcttcatctgccctcctggtgctcagcctcctcagccagcccattcccagtgccacctaggcagtattatagtcttctaggtagaggaggagaggaggctgctgaaagaagagaacaagagtttccagagcagtcataggaagaaaggacaaggaaatgaactagagccccagagacag

SEQ ID NO: 131748 - DNA, 1082 bp, Homo sapiens
tgacttcaagtgatcctcctacctcagtcttccaagtagctgagactacaagcacacaccaccacacctggctaattttttaaatttttatagagatggcgtcttgctgtgttacccaggctggtctcaaactcttggcctcaagcaatcctcccacctcagctttctacagtgcaggggattacaggcatgagccactgcacctggccaattttattttttttttaaccaaatttttgaaaccctacttgtgagttattaggttgatggagttagccatatccagccttttgcttttgtctctgtgtgtcataccacattctgatgtgtggaagtgatttcatactggctgttttgtatctgtgagactgggattaatcttcctgcccccattcaatttcctttctaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaagttatcctaaagtcagggccaaagctgctggggccaggcagcgtgtggggctccactgggcagtggcctgttagcacattcagaaagtgtgccaaaatgcacacacatgctgggtgctgactcgggtatatatgacatgattctacctgtctcttaagggaaaggaacattttgaaaaatatttaggccattaaaaactaaaaggtgctgagcacttcctaaatcttactcaattataatagcaactctgtgaggtaggtattattagtctcgtttatatataaggaaacagaggctcagaaaagcaaagtaatccattttcctcacaacagccagaatggttttcttataaagtgtaaatcagctcatggtcacttttctccttaacacccttttgagatttccttttgagcttcagataaatgcaagctccctatatcaaggcccacagggccctgcatgatcgggctcttatctcctagaccctctcctgccact

SEQ ID NO: 131749 - DNA, 1080 bp, Homo sapiens
tctgcaccctacagaggactgtgagaagcctccagactgaatacaataatggaaaaagtgactgaaagatttcacatctcctgagtgtggttaccaacatagcagtggggacctatctagacaggcacagcctatgcctgttcagagagcctctaggtcattgagagtcctgaaaatggtttataggagaaaatgacaccagagtcctgggggccaagagaccccctcatttccctccacccccttctgtaattttatctcaagggggacaacagaaacccataatatatactgtctgactttgtgccaggcatatctctcatgtcttgaataaattctaactagctctttaccaaagacccagaagacaaagactaaatttatttagtgttccagctgctgaaacaagtgtttgagacttggccacagcaaccgtggtcatctaaggatacagtactttccccacttcccccaaaaaaagcccataattgaaaatagaaatcctccctacaaaaaccaagagtgttcttcatggctgttcacagcaggacatcaaattcagagatttggcctgtctgctggtgagacatagggagtacagccttctcatgacttttataagggatttgaagtgtgcgatatcccatagctagctcagctcacatgcgcttacatttggaaaactgataatgtttagaatggagctcttagaagacattgttaaagatcagctgatactctgtgtgcagagataattcttctctgtttttttggcccctatgttttttttcatttccttctgttgagctgatagaaccatttgcatgaaaacaaggatgccttggatctctcatttgagttccttgttctccatgacaaataaagcagaggtctctatttgcagcagaagtcatttcctcaactgaatttaggggtctgaaggacccctaaattaagtcttccagtgagacagaaacagacacttgagataaagtccccacaaaagcgaagaggagaaagaattattctgaatctagctgagaatattttcaagaaactccagctgcctcatcgaaattc

SEQ ID NO: 131750 - DNA, 1235 bp, Homo sapiens
ccaccagttgggcctttttattcttaaaagaatcctttgagacaattatccctgctcccattttatgaatgagaaaatggggccacagattggactgggaccttaaaagcctacgtcttaaacttcaaagactcgttttgcctttcagccaggaatttgcaagtttgaggcccatttaataagaagaaagcttttaattttggagacaagtcatcaaaataaagaaggctctgcctgcaattgtttgcatttcttcttgagcctgtcacatagcagtgcagcttgtctaagcagagtgttgcctatagtacacctacagatgattcattgaaaactaggaataaggtgggatttgctcagtgtttgtataatattgggatgtttcagcatttaaattaaaatggtgcacatttgctgttccttccagctttcccaggctaaatctggaaagttcaatccacacgtccacgtagaatatgagtggaatcttcgacaggaggagatagatgagagcgatgatgatctggatgacaaagtgagtgtaaattatgtcctcgaattctcaacaactaccccaacttttctagtctgtgtagacaagatccatttttggtgagattgattgattgtggttttatgatccaatgtatcagggccatttatgttgttcagtccttattgggcaccatttaacagctatattaaggttgtccagagaaacagagccaacaggatagggagagagacagagaaattttttttaaggaattggctcacatgattgaaggagctgtcaagttcaaaatgcacagggcaggccagcaggctggaaatcccagcaggagttaatgttgcagtcttcaggctaaagacagtctggaggcagcattccttaccctttgggggacctcagtctttttaaggcctttctttggctgattaggtgaggcacacccacatcatgaagggtagttcccttgactcgaaatctactcatttaaatggtaattgcatctaaaaaattcctttacagcaacatctagactagtatttgaccaaacaccaggacactgtagcctgttgacacataaaattaaccatgaagctaggcatggtggctcatgcctataatcccagcgctttgggaggccaaggcagaactatcgcttgagaccaggaattcgagagcaacctaagcaaaatggtgagaccctgtctctacaaagtaaatggat

SEQ ID NO: 131751 - DNA, 1022 bp, Homo sapiens
tgaaatatcccttcattttcactgttaagtgtccccactgacatggacttgcagaaaatacataccttttgctaaactccttttcctggctcctctccatttctcatcatttctttctcatccttgcattggatgggtccctcattgagtcctctccattccaacattccctttattcagtatgcccacacggaaatgcagtctccttgtatattcgttcaagtcctcagttatattgattttttacttttctcatctgctcctctcctctctctcattttcccctatgtgtcatttttcattctttaactctcaccttccttcaagtttgatttctttgtttttcctcactttattgctattttggaagggggcttctcttttggaattacttgacaaaagtagattttttttttttgcagtggcaaaaaaaaaaaaaaaaaaaaaaaaatgaccatgctcttataaagacttttttcctcttatgtttttaccaacagatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcaggtttttgtccccatatttgaacgagcttttacaacatcctttctcttcctgtagaatataaaacgatctagttattgaaaaaccttaacccctatggacacactcacatacacacacaaaacacgtattcccaacgtgatttttcctaccgctgagctgcttttacctatgctgttttctctacctggaaagccccctcttgctctcctaggtgtcactgccaaaatactacctttcctataaggtccaggtatataagcaccatggacattatggagagagtagggggcatggggtccacattttgtatcactgtccaccactcccagcctggaccatctcacactgagtcccttta

SEQ ID NO: 131752 - DNA, 1010 bp, Homo sapiens
aatgaaacagaaaatactgaattagctggcactctccagtttgtcatggaaatccatttggatcaaataggaccttcccctctcctcactgtttattcaaaagcagtgccagatgtatgcatggtatttgtggttattttattgtattcttgttgcacttaagaagaataacctcgacagaatgaatcatgtagctgttttattgccgtgtgaccttgtgtaagtcactgaacctcttggagcctcagtttttttttctgtaaaaatatgagaaacagatagagcttttgtgaagattagcaataatatacacaaggcacctggcacataatggcgtaaaactaaaataatattaaaattctacttttactggttttcttcccaggaacttaaatctgtgttgtacctgaaagtaccctgctttctaaggtttcacttatttttctttttttttattttagataatagaacatatcactttcaggcagaagatgagcaggattatgtagcgtaagtagttttgaaataaaggtgcgatgccttggattgaaaaagcacctctctgtttacaatacacatcaacattttcttttcatttgtaagaacctcgcctggtggctccatgcttctttcccgcctgtgggccatcacatgttgctcttctctctgtctgtggttctccctcttgtctactcaataagctctggtacctcctgcaagattctgctcaagcctcaccctctctggggttatagctcactactccttgcccgcggcctcttcataaccttctgtgatcctgtggtgcatgtctgcagccctttagagaccaagagcttttcgagggcaaggaccgtgccttatgcatcttttaatcacatcccttgccctcaggaggggcctttgctcagtttttggtggccaaacatatcagccagcctacctgggcacttgaccattattgtaagaggagcaggtgagccaggccctgaaggaaggaaactgccatg

SEQ ID NO: 131753 - DNA, 2216 bp, Homo sapiens
tatttttagtagagacagggtttctccatgttgatcaggcgggtctggaactcccgacctcaggtgatccacccacctcagcctttcaaagtgctgggattacaggcatgagccacctcgtctggctcttcagctgttttctcagaaaaacttgcaggcccacaagctcctgcctccccttctaggtttggtgacaagttctggagtacaggaatcttcccaagcactgtttcctctttggcaaaattctcttgtacttgacttctggttccattcctaaatcaaaggtacatgcattgaacatggaatcccctggggtctctcacttcctcccctaaagcagttcgctttggaatagatagatatgggacaaagggcattgttttctatgtttaatctcattgaaatcatagagggagaaagatcttgaaaaatggtccagagagcacaggaagataaatagaaattgtttaatgcccattatttagaaggagaggtggcagtgtgtcattgaaggtgtcttgattgtatgccatctctgttgtttcaggcttactgatgtgacttgtctctaactccctccccctctcttttccctgaaaattttaattcctcagctggagatgcacctggtactaggattttcagaaccacagctctcaatcgaaacagggatataggtccaattaaagagtttcattgcttatttctccaggcttctcgtgttcgagcacagcccagcctgggcactcaaacatttcattccttggtcagcttctgcaggaaggagggatcctagtatcagccattgtccagcatgtgaccttgaacatgggcaggcaggagagtgttttgaccagtgtgaatacgtggtgagacttcctaagttagcgtgactatctagatactatagggtctgttttatatgtgtgaccaagagatttgctgataagttatatgaaatccttatcaaattttctctctccccagatattggggttcattaagcattgcctcacaggtagtaattgtcattgtacttctgagagaagtaatgtaaattttgcatcacaaccaaaatttgttgaatccatggatacctgggagatcaatttggggatgattgattaccggggtcattttgaatgaataaatgaaatatagctcagctacatttcatagtaagatacagcattaaaagtgccaactgttggtgcttagttatgggtaggttccagaaaggtgcatttccatggaccatgccgactgttcattggaagtgaggtggattatttttttattctcttctgaaaaatcaccaggatatttatgcacagtttaaagacatttagtaggacacctaatttttttttccatctttaatgagattcagaattcaactgggataaataaaactttactaaacttaccagcttatatttgagggcagaaacctacagatctgttgtcttcttgcagcaaacttggaacaatgctcagatgtctgtttcttctttgctgaaaatgtatttttgtaccactgagcaggccttatgaacagcatacctgccctacagggcactgaacctgcagacaagagagtggagctgcatgtaacttctccattttctctttttttccagtctaacaggcaaccagccaagttgaaccttctcacctgccaagtaaaacctaatgccgaagacaaaaaatcttttgacctgatatcacgtgagtcctttttctctctctgagttggttattgtggcttctgacacctgcacatttccattctccaggtcagcagcttttccaagcagggctcctcacagttggcattggaacagttattcctgcatgtgctgctctaggaagatgccccaggtctcttaatttccactgagcccacctgcagttgacaaggcatagcagtgtcagatctgaccagcaatagaatagaatctaggatttgtacattgaactaaaccaatgcttgactgtgagtacacagctttatccccttggagagatgtttcttagtatattcccatttctgtcttagatctactgaattatagttgttggtatgaggcccagacatagtttaaaaaaaaaaaaaaagccactaggtgattgtaatgtgcacctgtggttaagaagcacggatgtagacttgggaatgcagatgtgccactatatctgtacaacgaatttgc

SEQ ID NO: 131754 - DNA, 1043 bp, Homo sapiens
ggagggaagatgagggaactggccatttaagggcagtaagaaccagaaaaggcaaaacagtaaagctatattttgactgactttgtaagttttcctagggcttggcttgacagggaaacagtgtgataagtgagaagagatttgttcagaattcagctttgccttttattttttgtaaaacataggttagtttacttcaccttcctgatccttggttacctcatttatgaaatgggtttgggaacagtacctaactcatagagtcattgcaaaaattaaataatagaattcatataatgtatctggcagtttaggtactcagtttttcaaaaaattgttaccttttatctgtttggaaggccaaaagccaatagtcttgattgctaaaattctggcgataagatctctctgcagtggtaagtgttcagcatgtaccttaatttcttaccacggttgtagttattgattgtatgccaaaaatatatgtccctgtagggcacagtaggtgtctaaaaaactatttattgaatgaaaactttgaaatgaccataatggtctgagcagctctgttttcagacactagcataggaagtgaagagagctttgtcattttatttttacctctttccacgcgtcagcctcatcctggctgggtcaggcctattttccaagtaattaatgttcacttcttgtttgtaaagcagagcaattcagtaagatgatgggaggaaataatttcatttctgggtactaattccagtagcagctgttttctgctaactgagaaatatgcctgtgctaacaactttacacttccagcaaaaacactggaaccatggtgcacactaagctgtctaaagacaaatgtgcggtgtttattttcttttaggaaacacagaaacattaattgggattgactcattctgtttctgcatgcatttctacttacttatttgatgattttcctagctaaacagccactttctgttatgtcagagggatatcttcatcacttctcttcatgaaatgtacccagagcttcc

SEQ ID NO: 131755 - DNA, 1047 bp, Homo sapiens
ttggtggtagtcaaagaagtgcacagtaagttttgccctttttaaaccaacagaaaactcttttcagttcttaaagatgcagagattgtagtggaaaatgtaccaagcaggaatggaaatggcaaagtatatgccaagacttttttaatgtgcttgctgtttaacccagtaatctcagtttggattttaaaaactcattaaattacagtatcctgtgccaagtgatgtccttggggcactgctcaatgaattgccagcagaatagtagaaaagagagatgagcatttattatgttggcaattttgtatgacttacagctgactttagatatctatcagggaggaaaggaagtaccacttaccttcataaactttatttcagttaatcctcccaacaacccatgtggtataataaccttcattttacagatgaagaaactgaagcacaaagaacagctgtaacttggctagttactcacagaattggaagttcaaactcgggtgtctgtctgacattagtccttgtggcctttctctctcttcctgcagaacacatcatcttactagactgtaagcgcccccttgggcacttactagtcctgttctttctgtcttcagcctctcacacagaacttgacatacagaaggctcttagtatacacttgtggcccagtcctttgtggtaaatgactgcacacatcttaaagattgttgtcctttatggaacttgagcagttgcattgtctctgtcccttgcccctcgcagcacacttttcagtgattcttcggaggaattcctcagaggtctgcaatttccctcaaacagcccagctgagatttttagctgtcatgccagttgtgtccagctacccatctgatatcagaaatcctgtctacagacttggatctgtttgtaattatgattgaggctgtctaacagttattcatttcttcagcaatctttttttttttttttttttttttttttttttttttttttttgagactgagtctcgctctttcacccaggctggagtgcagtggtgca

SEQ ID NO: 131756 - DNA, 1020 bp, Homo sapiens
tcagtacttacttcagttcccaaagtgattttcagtacaaagtcagctggtattcaacagtgaatttgcctaggtagtaatagtcacgacacttccgtgtggatgaagctactacactggagaaataaataaagggaacagaaaagaagggcttttaactgtttccaactcatttcagctcactcactaattactgctcaatttcagacatgaacattgtcgggaacatgctgctttccaaacagacatatcctccagttcacctgctccttttacctcctcacaagtgtcattatgacctgcagagttaacagcatttataaacattgctttattatctgtcattttacagataataagaataatagctaacatttaccgagagcttattttctgggacgaattatataggccctgcctctaagttccttacatgtgttttctcatttaatattcccaacactcaagaagttgtagctcagaaaggatcagtattttgctcaaagtcatgttcattcatttaataaacgcttagtaaatgtgtcaaagcagacaaagtaagcacaggaaaccaaataaaaatataaattggacttcaaaattaaaaacttttgttcatggaagtatattatcaagaaagtaaaagacaacccacagaataggagaaaatatttacaaaatatttttctgataagagtctgatatccagaatatataaaaaaaactcaacaacagtccaggtgtactggctcacacctataatcctagcactttaggaggccgatgcaggaggatcacttgagcccaggagttcgagaccagcctgggcaacacagggagactctgtctctacaaaaaataaaaataaaaaattaccctggtgtggtggcacacgcctattttcccagctacttgggaggccaaggtgggaggatcgcttgagcctgggagatcaaggctgcagtgagccataatgacttactccagcctaggcaacaaagcaagactctgtatattaaa

SEQ ID NO: 131757 - DNA, 1046 bp, Homo sapiens
ccaccttagggtttttgtaaggctgtaaaaagtgaaaaagaatgcatgtggagtgcttagcccagtgcctgcgaccttgtatgtgttgacagctgtgatgattctaagtggcatttaaaattatttatttatatattttattgtctaggatatttctcttaaggaaaacctttttgatgatcaaattgttgtttacataaatttgatgataactttttttcaaagtaaattgtaccttatataagtgtctttcaaaaataaaaataatatattgaagtagaaagttttcaccttcttaagattaagtttgtttattgaagacctggattaactaacttacttttggctttgtagtgtggttgggcagttatgaaactttggcctgtgttctaatggtccctgattttagtattgggtggaattttttatctttcatcaaatttagttttcctggaaacatttaattcctttgaaagttttaaagaaataagtgaatctctcagtctcctgaattctgcagtactttggcagcaaaactgatttcacctgactttagaaatctattttcacgttaaattctctaagtttataaggaagagtttggcctacacaaacaagagtttttcaaaatagaagatgctttgtaaagtatacatatattagccttcgctagtaatggtgatgctaacttgtatagctaatgcatcctccctttattctcttattctttgctttttccctttccacaaatatgtattagtcttttaccaaagatcagctactgtgcccagttctgggacagagataaagcaaggcttttccgctcaggagttaattgtccaggtataggaagtaagtcagatccattattaatcataatggggctggacagtgacgggtaccatggagcatcaagaggaagagagacggctgggcgcggtggctcacgcctgtaatccccgcactttgggaggctgaggcaggtggattattagattacaggagttcaacaccagcctgaccaacatggcaaaaccccgtttcta

SEQ ID NO: 131758 - DNA, 1050 bp, Homo sapiens
tgtttagttacctcaataaattagtgggttattcttacttttattctttaatttttgagtagtaaaaattctttctgattcacctctttttcctaaagtttcaatatcctatggtatattctttgatgagaatgctattctgcgtactttctgcaaaaaacaatcaatctttccagtttttgaccacataaactatacgtttgagatccactgcaccaaggggaaataataattctagaatgttttgctgtgttttatttctgcttgtcgagtaaactaatcataaaataatttataaaatgctaacactctagtcaatttgttttgaacactttgtgactgcgaaatcagcattctctaaactgtctaaaggacaccaaggcttggtaacttgtgcagattcaggggtgatgttcagccacctgaacccatggctgaagagccccatctggaattaatcaacgcaaaaccctgttttattttcacagtatctcattaaagttaatgaaatcaagaccaaaaagggtgtggatctgctgcagaatcttataaagtattaccatgcacagtgcaagtgagtagaatattgcaagcattgttattagcccaattactgccccctgtacttcattatttgtcttaatcctcttcatatcttttcttcatctcgtgactaaataaagtgatataatgacctttttcagctaaatggataagaaatagtgtcttccatcttcagtgttttatacaaatcagtagctcaaattagggcttaaaaatattgtcttccttacaagaagacaaatacttacaaatacttcttcctaaatttgatcgcctgtggagctcttattacagatgcatgatcccctgtcactgaagagtcctttctgatgaccccctaccctgactctcttacttggcattttgcctttttttttttttcctttgagacggagtctcactctgttgcctggctggagtgcagtggtgcagtctcggctcactctaatctccgcctcctgggttcaggcaattcttctgcctcag

SEQ ID NO: 131759 - DNA, 1035 bp, Homo sapiens
atagggaagtcacacaataaatagtttctactaagttctctttaagaatcaaatttcatttggtcaaagtgataaatgtacgtaaactaaaacatcagatagtgcttttactagttaagacttactctgtcagcatgtaatggaaaccccaaataacagtggcttcaacattgttaaagtttatcatagaacagagcattctaggatggaccaggtaccctttgtagcacttctcacttatctgtattgtcctccacaatctaaactcagtgattttatgtcatacctaatggtacagggttctttacaaatcatgacagggaaaatattaagtaggcaacaaatgtgcttctaatggaaacacagtggccttctgcctgcccctcttgatcctgttagtccctcccctttttccaactcttttacctgcttcctgacttatctacacgttcctcagtattttcttgctctttctagctttagctgtgatgtattgctgtggtagacgaggattacattcccttgcatagacaccccatcactttcgcacccttgttcatccattgtggttaatagaacaatttttattaaactagtttcagtgtttacatttttataggtataagcattcattgctaatctgaatggtagaataggattgaatttctgttcttagagtacagttgtttactttttcttaatgacataatggcctcatttcttcatttgcttagttctgtgtgaatcttctgtgaattcttatctgctctagcagatgtcagacacctgtcaataatatttctgtttataaagtacattatgtattttattagcatgattatatatctattagtattaaattgtgtcagcttcttctttcctggagacatccctttgcagagctctttagatcagcagtacagctgccatcctgggatggcgtttgactctctttagttttaaatctaattcctcttgactagtatagttccatattttggtggcccattacctccagtagttttcagagaacag

SEQ ID NO: 131760 - DNA, 1043 bp, Homo sapiens
cgcctaacctacagaggtgtcatgtaggttcaatgaaataatgcatggaaagcccttcaacagagcctggtgtgtggaaaatgctcagtcaatagtagctggttttattgttcatgtggactttattttttaaccatctcccatcttccctttgctttttcagctccagggtttgagccacaatgtgatcttcaccttggattctttgttaaaaggagacctaaagggagtcaaaggagtaagtgttcagaaatttgattttcactttaacttgaaaggattaattttttttttcctctttcaagatcatagtagtacttgtatttgaaagactctttgaacattttcagcgttaaaaatgctcttggaaaatgatcattggaaaaaatgtgcctcttcacataatggtattgacagaggaatgagattaggcactttcaagaagattgggaaggtcctccatgggtgggagagagaagctaagcccgagtcttggctcccacagtgtgaccactggggacccagcccttctgaacctcgggctcctgcttcatcagcatgaccagggcgcttacccttctttcctctctcaggcttcttgtgtatataacacatggtttgatgttggccaggcacagtggtcatgcctataatctgagcactttgggagaccatggcggcgggtaaattgcttgagcccaggagttcaagaccagcctgggcaacataataagacccccatgtctacagaagaagtacaagaattagccaggggtggtggtgagtgcctgtagttctagctactcaggaagctgaggtgggaagatcaattgagcctgggagttcaaggctacagtgagctgtgattgtggcactgcactccattctaggcaacagagtgagaccctgtcaaaaaaaaaaaaaaatggtgtaacgtgcataaagtgaagttcccagtgtcctataaaggaaacaattcttgctaagatgtcatttcaaaactatttattaattttcagcaaaagtagttgcaattttaatct

SEQ ID NO: 131761 - DNA, 1057 bp, Homo sapiens
cacaccccctccttttactttctcctttgtcttggtcttataaatcctagctacttcccctttccatataattatcgtcaaatgaaatcagatgctgcagataatgcacagggaaatggtactttcattttcacttgatgtaggagatgatgttaaatctaacccaccatttactaaattgaattagataaaatataattgcattattttaagttaaggaattctcatattccctggtactcttagacctacccatttttctttctagcatttccagtaaaatgtactttatgagtaaattcagtcttgtcagtcccgagtgcctttagcacatggtgtaatttgtcttgcatttttccttgggcctttcccagatcttccagagcagtacctctgttcttcattgtaattatgccttagaccataggcaagtgatttctgctctctggctgtaagtctttccttctctaaaggaactttggtttttcttccacttggacagcctttagtctaaggcagtggttctcacacttgatcttgcatccatttcaccttgagagcttgttaaaacttaggttgctgggacccactcttggagtttctgattaattaggtctgggatttcataaccaacaagtttccaggtgatattgacactactgatttgaggaccacacttttgagaaccactaggaaggattgtcactctggacagagatccagaatttcctagtgttacggagaagctgcaactgtttttctctccagattcacttttatattaattgtttttacttttatacatgacatctgatttacatctttatcactgaataaagaacaagttgaatgagaaataggctgctggttaattatatcaccctcttgtgattttgcatcatgtttctttttaataactttgtacgtacaaaaataataccacttcattgttgaaaactcagaaaatgtagggagaaaaagactaaaataaaaatcaacagtaatcttatctgttatggagtgtgtgtatgtgtgtttgtgtgtacaccctctgtct

SEQ ID NO: 131762 - DNA, 1011 bp, Homo sapiens
aaataagaatatctgataatgtacaggttggatctagatttgtagccagcagattatttctcaagttcttctttgaaatgttaaaaagtatggagagcatggatgtgcctaatggtaaaattggtagcttctgggtgccctgaactatataatgcatttttaaaaccttatcttttaaaaaaatggtcatcaatcattggcagttttcagcgtttgatctaccaggtatccccttatttcctgacatgcctcactgcctcactaccaattaatactgtgggacattttgtgaaatgtgatctatccatgtgggttggtgggtgggtaagagggaaaggtttatttttaactccttctatttaaaaaatcatacatatttattataaaaatttgagatatatggaaaattttaaaataaaaattataattctagcttctgttaatatttaagagtagtatttgaaacaattttatggatttgtacacagagatactgctgatttgcatagatatctgcaggtataggtatatatctcattcaggtccaaaatccttggggttagatttgtttcaaaattcagagttttaccgatttcagaagggtgacagggtgtacatgccttatattatgcagcacaccccctagtgacttcttgggaagatgcttataattaaacacagttttgtgtctgcagtgaaacttgaatattcacatgaagtctgatatataaagactattaggtgccccacctcaagtctagtcaagagattaccaaccaaatggagtcagaacaggttttgctattaagtgagtttaagctaaaaaaaaaaaaaaaaaagccgtgtattttatatatatatatgcaaatttgctctaacaggctgcatactgtttcattgtatatctgtaccataactgattatttgaattttctgtttgtcaatacaggtataccttgtcttaaatacatccaataaacaggtatcctagtgtatatatacctcaggctg

SEQ ID NO: 131763 - DNA, 1049 bp, Homo sapiens
ttcgttttgataatgtactgtttaacatatataagatgttactattgggggaagctggttgatgggtacaagggacctctctactagttttacaattttttggtgagtctataattttttcaaaataagtttaaataaaagtataacctatcaaattattatcaaggagagaaaagtaggggaaagtgtttagtatacattgttacataaaaatttcagcataaaacaaatgtgcagaacacaaatcaaactcacttcctgatactctttgagccaactgatctgcagtcctcagtcctgcttccttcgcactttaataggttttctaatttcttcctctaattgaagtcctatatgtggttgctattccataaaagtaggaatgattagctatttcctcccagaagtgagtctagttgtcatgattgaatatatctagggaatgctgcctcttagtggtgagaagccagagaaatgtggacaagatctattctattgctgttgtttttactatatttgtggcatacttacaagtgcatgggttttgatttttaatgaggcctgtattaaaatactcagcatcttacttgtgtgggcttgttgagttctttgagtcttggtttcttcatttttgtaaaaagggtttagtaatccctccttgtgttcatttatgattcattctgttacttattagggttctacataagcactgtgggtaggctgtagggatgcagcagtaagaagaacacagacaagggccgtatcctcttggagttgccattctggtggcatttttagaaataatttatgtgaaatacctatgaaagcattcagttcgtagcatgtacttaacagataatgacatttttaaaaacattttttaaatatttatttagttgccttgcaatctctctaaacttatccttcctctcattaaagatgccttcctaatcaaagccaactccagacataacaaacgatttgttgttcatggaatatataccatttcacgcttccatgcctttatagattccattccttccactttg

SEQ ID NO: 131764 - DNA, 1015 bp, Homo sapiens
ctctaatgtttctgtgcttttggatttaacaaatccatgtttttgtaaatcttagattatataaacctcatttattcagaagagcaccctcggttttccttcactctgagcattgcctgcactttcactggaggccttgctcaaagtgtggtgtggtagaaagagaggaagcaaaacaagactgacagttcactttggtaatagctggtaaaggacttgcttgggcaggaagatctgttttctctgagatgggtgttttcgcattgatgtcttgctttagtttccaaggaccaaatgtattggcttaagtcaagagtcatcacctccaaggttcctggaccaatctcatctctacggtttgctacgctgcaggttcctttcaactgtgtgtatatgtgccatacacacagctcagtggccattcaggccaacattcatcatctgcgtttgctcacctaatacatttgtttgtctccatacaaaaccatctgagatttattgaatgtttttgatgaacctggcagtttggtgggtgtgttatgtagattatttcattgaagacattacaacaatcctgtggttactgtacctttaatccagatgaggaaactgaggcaaattgagatatataacttgttcatttaccctattagtatgtgttacagacttgaacccaaacattctgtctctgaacccgttgcctttgctcttctacaatatcctgcctctgtcacctcatgctctggttgtgctgtttccctcagcagaagtactgatcaagctactcccatatacatacctcaagctacagccctttttccacacccactcccctttaaggagtagaagtctaagaaaaatctaaaggaaattgctggaaaacctaattcatttagtaaaggaaaacaaattttgcctttgaaagtggtggtggcattcctggtgagggagccaagtagaagaatcagtttctactgtagtttggttactaagaaaacattattctgattgaata

SEQ ID NO: 131765 - DNA, 1010 bp, Homo sapiens
ttttacacataaacttttatcagtactagtaaacattataaaaatgagggttttttggttttttttttttaaacaaattgtctccatgcaagccctttggtttcaagattgttctaggaatttgtgtctcacttttccttgttgtgtatgaggacattttaaaaaacaacacaaaactcaattctgtgaactacttagaccaatggaaaattctccaagccattcagttttcctgtgttgttctctaagttttgaagttttaacattattaatctgtgaaacacattgtcgttaaggaagtctgccttagtggtccctctccctttcccattttctccctccttcgcccttttgctaatatatgattaaaatgactagtagtttcttgggcactgtggaggttttaatttattgtaattcttgggcaattttctttagaaagatagagcctaatcccctttccccttgaatgtacaccagagttactaactcccttctaatgaatagaatgtagtagaggtgatgccatgtgatttccaaggccagtccatagacaagatagcttcaacctcgtccttctgttctttttctgatcattttctttggaggaagccagctaccatattgaggatactcaagcagtcctatggagaactaccactcacttactagccatgcaagtgagacgtagaagcaaatctaaccccagtcaaactttcaggtgactgcagccctggcagacatcttgatcttgatctttgtgagagaccctgggtcagtacagtaggagtggggctggctttcccttggaagcatgggcatgtgaatgcacgtaagtcaggtgtggcttgagaaaagagcttactgcttgcttctcagtattgtttaaaaaacacagtgagacatactgcacttttagaaatggaagcatgtggttcataataagcgtgggtatactgagttggctattctaccaaatgaattaggttgaaaatgttaatctttttgag

SEQ ID NO: 131766 - DNA, 1050 bp, Homo sapiens
ttaagtgattgtaataaacactaaggcattaaaacaaatagtacatgagaaatagcagcattattgagttccagttttcttctgtacagctttaattcttgatgcttttaatatagaggcagatttatttgacagatatttattgagccctactctgggcctaacataggccctgccctcaaaacgtatacacacctaacagataatttatgcctacgtaggagagcagacttttgcgagctagttttatgcagtaccttttctttggcttgggaagttgatagcttggtggtgttttcttggatggactaaatccttagaattgtttaggagatattggtcgaaggtggtatgttaaatttttgccaaggatctgaactgtgaagtaacttgtcaagtggggcccaaacctttcaaagtttaggatttacagatctttcctgttctttggtcaaattccagctgagaaccatgcagccattaagctgtaggcaccgtagaagacgttaaatgtttctgacagaaatctttataagcacaggagaatcttaaggacactttttatagtctaaaacagcacagataaacatcttaaaacctttatttgcagataacataccaactttcaattttggggctgtgttatgcaaatcaaattttattttaggttggtcatttccccttcatggcagcctcaatcaactcatattaatcttgaaactaacatgataacatctttacctcttcctttcatataagctgcggctgccaggtccctcttcctctgttggcaagtattctgcactgctgcttcctggttgaaccccactaactgtgggtgttgttacacaggatgattcttagcactccacacctcaactcctcaaactgctgtaattggagttcctatttctgttctgcttctctctgcctcaacttgtctttcctgtctgcacccttactcccattccttcctggcttgttccaagaggagtgtcagatagaatgccatgggcgtcttctcctccaggattgcaggggttaaagatg

SEQ ID NO: 131767 - DNA, 1903 bp, Homo sapiens
taatcacgtctttgttctaaaaccctagaggctccatcttggccaaactacggcctccagaatacaatccagtctccttaccatggccctttcctccctgtgtgatgggtcccagtgtatctcttcatccctcctgtggccacttgtttcaggcatctgatctccctgatgcttcttaacaacaagggcctgttttctcagaatgttggcatgcacgtggttgttctctgtctactccaccttgaagaagagaacattcttgtcttcaccaggtatccccacacctagaacagacttgatgcctggaggtacaggtctttgtagatgtaggagccgtatctgcctgttcattccgcactcccccctccaacccccccggcacccgccacattcctcagcacagactgaatgcttgagtgacctctcaatgggccagagttaggattagaaataccaggtagataaactattcctctttgataagtaagctcctattttctttcctgatgccacagataggcccactaattcttttcaaggatttttctaccaatcagtcactctcagtggtgtttttcagtaagtcaccagtattttaaagggcacctggaagctttcacaagcctgtgcatctccacgtggtgttgtggttggttatttatattaagcctattttctgtatgcaggtacacatgccagcgatcagttttagtgaaaatgatgctcattgtcaagactagttttcaatttgtgaagtccacaaaagctgtggttcccagggtgtgcctgaagctaagtggaaagcccctctgtggttttaactgacactcactatgctgagcaaagtatttagcagatagacctatgtgaaatggctgatgtgcagctcacgtctgacctgcttgggtggcacaaccccagtgacctgcaagttgactccttcccactttgctttttatctcaactactctttagctgttttacatagagcctcctggaatgggaagaaaaaggtctttgaaactgattgtctagtggcctgatgactgaatccttgttgttgtttttttttaagggtcctccatcttttgaaccccattgtgtcaggttgaagggttggagagcaacatggttatgaatatagaccttgagatcaggaagacctgctttggaatcctggctctcttattagctgcatatcttagggccattctgatgttcaattttcttatctgtcaaacataggtaatagaaaccttcttataagttactgtgttgattatataagatgatataagattaatggcaatgtcacattgtcattttatcatcatcaatactggggagaaaagagacaagaatgaaccaaaatcagactctgaggaccattggggaaaggaggaaaagaagcaaacacatgtctgtgccaggtattatatgagaaaggtgttaacagtacctttagtatcagagagagtgactaacttgaccagggtcacacagtcagtgtgtggtagccaagcagtgacacaggtctctatgacctcaaagcttgtgtttgtagccgtggctttacacctctcaagatggtagcttgccgcgtgataggctatgtttcttccaagaggcaaaggttggacctcttaacaaatggtagttgatttctggaacattaatggtcacttagaactgtgggtactcatagtaacttagtgccagatggtgtgggaccatcaaggattctactgattaggtgcagagaatgagcatcccagagaaaagcaaaacttagcttagccctcagaggtgggttgagttctctttacagaatgtatggaatggctgtagttgtttaggatgacaggtttgattttaagggttgtattagtttgttttcacactg

SEQ ID NO: 131768 - DNA, 1487 bp, Homo sapiens
gcactgtcacccggcatgtttctagaagggaaggattcaccctttctcatgttcatattcatgggttgaggatgaggagcaaacacattatttattagcacatagtgaagtgaattgaaacaaaatgaaatatgttgtgcgtgaatatctggtaacatttcaagaatacagttatagttccaaaaaaagcttagataaccattgcttgctagtattgatcaagaaaggagagacaaagtaggcttccacagtcagaggtgttgcttgggccacttttccttccaagcactattggtatctaagcaggcagaggaaagggaggataagtcctgctagccaagtcagctgcctggcacgcacgactgcctttgctgactgagaggacttggctggcctgagagtcgtgtccatctggacagagtgctggtgaccacaggatcctatatagatcccagcagcgttttctgacaggtcaaccatggaaggaccaggtgaaatgaaacatcagcacttttctctctccatttccaatcctatttaggagcctccgttgtttagctagcattcttgatttgatttgcctttaggttaagcccatctctgatgttctgaaatttcattctcttctccttatctggaggtagcactcaagaaagacatgtgtgttgtgtctctctgttgacctccacaccatgtcctgtccatcatatttaggaatcctctgccttttccagttgtggttttttcctcctcactagttttaacaggggctagaacctaagttgtcagtgtgtgcaccacagaggtctgtggcaagaagaatgtgtgtgagtcattggcctgtcattattgtctacgttactttagacacactgaactgctctgaacctcggtttcctcatctgtgaaatatgcccacttttcaaggcaaatttgttgtaaaacagatgtaaagtgtccctctgtgcatagttggtagaaggcactggaagttgttattgtggaatgcatatagcatggtgaataagccctaggatgtagagcaagacattgctgagcttgattccctgatcttgctacttaatagctctgtggcctgcagaggttaataatactcacttcatagggtttttaggcttaaataaaataacagagagaaccatttcagttaggctccctaagtgagcaaaggctcatttaaacttactcaaaagtggtggttggtgggggattaattccagccacctcctggtgtctctcaaggatgtcttcttttttgtatttatgttttgttctcttcacactcatgctgtacccagacttgcctttgcttgttgcatcttttttctacacctagttgtagtttgtgttccttcagtaaaatttgtgcatggcccatcatggtctcttctctgtcaaattctcttctctagttcaaattcctgagagggtgggatctgactggcccagctcatctttttttcctc

SEQ ID NO: 131769 - DNA, 1052 bp, Homo sapiens
cactactctaacccaactatttttagttattattttttagtttttgttgcttgtatacattgttttaaccgttaccatcttcaaatacatgccatgttgaattttgcgtttttttctttaaaatagtacaaatattgctctatagttacacagttgtgtgtgtgtgtgtgtgtgtgtgtgtgtgtgtgtgtgtgtgtgttttaagacgggatcttactctgtcacccaggctggagtataatggcatgatcccagctcactacaaacttctgcctcctgggctcaagtgattctcccacctcagtctcccaagtagctgggactacaggtgcacactatcacacctggctaattttttaatatttttgtagaggcaaagtcttgctgtgtttcccaggctggtctcgagctcctgggctcaagtgctctacctgcctcagtctccctaagtgctgggattacaggcatgagctaccgtgccaggcctatacagtcttattttgagggccacataataatatcatcatatagagatgttccttaatttactaaatcatttctgtgttactggatctgcagagattgtgtctgtattttggctgataccatcagatctgtaatcaactttgagttattagccacttttctcctagtgaccaatttccttggggtgtatggaagtgagatgcttggacagagggaatggagcaccacctttatggaacttgtgctgccatgttgctttgtgtaacaccactagccacaaagaaggttcatggttttaggaaagactactttttcagctgctcctaccagttctgggctggacacttcctgagtttctctctagagagagggcctcacccaacatccccttgtatagactacttacgggaagattttctcaaggagaaaatatatcagtcacaactaagttccctactcttgtgaaggaaaatattctacccaatgggcaaaggatattccaccctgaccacaatgcttttataagcatagggtagaggagttccttcaacacgtaatttatttat

SEQ ID NO: 131770 - DNA, 1039 bp, Homo sapiens
ttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaacagtggactaaaatctgtaactcttttctaaggactgttttttcccagcagcttctacctgttggacagaattaccttctttaggtacctctgtttaggatagattttgtttgttttttattaaactcaaatattagaaccaaattgccttcttgcaaagaaacatacaggatgaagatttagcctagttggtttagtttttgtgttcttatgcatgttttagttgaaagacagtttctatgaacatagagcaaaatatgagcaaaatgaaaagctttgaatttataagttacttgtctctacactggttatccaattaaccttttaaatgagggaagttatttctttatacttttacatacagagctgattccttgagatcacacagatcagacagaaagaatgttagaattaggaatcatcagaattataagggtctgcagaagtattcaaactgcaggtcacaatgtatgttaatgggtaatgaagtgaatttagtgtgatctttaccaaaagaaaaagtttcatcttattggagggggaaacatgggcccaaagtgacttagcttggtactttattgtaaatgtttgataactttttatttgatttggtttgattttttattttttgagacaagattctcgctctgtcacgcaggctggagtgcagtggcacgatctcagctcactacagcatctgcctcccaagttcaagcgattcttgtgcctcggcctccagaatagctgggattacaggtgtgggccaccacgcctggctaatttttctatttttagtagagatgaggtttcgccatgttagccaggctggtcttgaactcctgacctca

SEQ ID NO: 131771 - DNA, 2226 bp, Homo sapiens
tagaagaaaagcctaaattttgaattcatagttaagagttacagtccttgttagcacttgtttacagtgtgatctggggtaaatcatttatcctttataaaatggagactaatgtagcttttgtcacagtagcagaatgtatatggaatcactttgtgaacttagaggaaatggaagagattgttacagctggagcggcccagtgccccccagccttcttttttaaacaaatgaggaacgaagctctaggagtttgctgtgcccaggaacatcataatttattagcagcaatgccagacctagaggtcaggcccgcagggttctttttgtgacatcttttgtcagggcaaagcatccattcatggaactgggctgaatctttctcatactcttcccttaaagaggcttgcctttttgaaacttggttctttccttgatcactctgtcatagaatctgttcttggagccgctgatgaagtccggtcattatcagtacctttacttctgcaaaaaaatgtgactggtattatcttctacttggttgtaacggtttacgttctcctccagttctgttgttctccgtgaggaatgtagttttttacatgccttttccattggagagttacaacaaaaaagcaaaataaatctatcttttctctgatatggcctccttatttgttttaaaagcatttttatgtttatttggataatatttagaaaatataatagatttaaacataattttaaaagcatcaaaatgcttacgtttctctaattgtgcaagaatctttatatacatagtttttttttttaactgaagttgcatcctgccagtaaaatttgaacgaattgctttataagttgataaggcccctttaaaacccttttcacttcttagctcctgtgtgtacctctgtttagaaggtgttttctccttcctaggctagccaggaggagagcttttgtgtgcaggcgctgggacgcctcaggggactggtaattgagagaggggtattgacctgggtcatccatctgaaagtacgtaagtgctgctgcccaaagccattattactgccttccaggaatctttgataagtgaattagtggctttctttagctctctttgacctgtggaaagcccaattacaggcttctttgttcacccatttgtaacttctttctgttagggccaggaatataacttcatctgaagacttctcccagttgtgggtttcaaagcatttggaagaagaaaaggagctaccatttgttgagtgccttcggagtgctcagagctttgtatatgctctcatttcattcttgtctaagatctagagatggttaggattattcattcctgtttcacagatgaagactctaaaaaagttggagaagtagctcaaggtcatccagctacaaaataacacagctaggagttgaatatggagctacagtctcaagagtctatgcttattatgtctcactaaatggtttctgttccaagttaagggtagtggactatgaggaaaagcgaagagaggtttatcctccatttccacccacaggtatacagaaataagaactacagtaggtgtagctaagagccaatccaatcctgtactggtggtattcaggaaggctttatgtggatcaagattctatgccagagaacacagattccttcagttcacttcagcatacatctgctctgtgcctggtactctgctaaggaaaagaagtccgtgcttccaaggaagtgaacttctgttgatcactcggacttgaatgaaatattatgtcatccagtattaattctcaaagatacatcctcaacaatgaatgcgatagtgagaagagaggcagaggttgctatgtcaagttgatattgtgtggcggggttaagtatccccttacctgttttccatttaggatttaaggtagatcgagtggtctggtgcaagggttcagaccataaaccacagctgtttgattcttcagcctggttctttaccagctattatctcctctctaccaaagaacatagtaacctccccatttctgcacctcctccaaaacaaaacttccccgtaatggtaagtgaaaacttggacttactgaaaaatgccagcaaggcccagttgaacctccatctttcatgccttattgatatgcatgccacttcttccatcttcatagtatcagtcatttgtcatcctctaataattt

SEQ ID NO: 131772 - DNA, 2274 bp, Homo sapiens
cccaggagttgtgctgatttgtgaggactagttgtcaaaagattccataaccattatcacaagtagactttatccacaaaatgcccagtttcttgggacatataatcacaattgaatatatcacacaccacttttaaaaacttgtattctaggccagaggtcagctaccattttatcctgctagattctcctgaaatccatactccatatgagaagtaaaggtagaaaagggacagcgaggaatatgagcaagcactggtctggtaaaatcatctttgttcagttccagctgggctacttactggccttgtgatgtgttttaaaggccccttgatccctctgaaccatggtttccttgtcagcaaaatagtcaagaacactacctctgcctatctctttttgatgaccaaataaaataaggaacatgtaagtgccagtttgaggtattcttaaacagtacaaagttgctgaatgagacacagactcaggtttctaacctggcacatagttgatgtttataaaagttagttcccatctcctctttttagttgtaggttttatattgattattggttcaagagaggcaaaaggttgtaaatagctcagggtcgctttagttatggacgcccctaactattttagtggaccggtttcctgcttaacgctctatgttctttcctccctgccttcacttctcttttttctccttctctgtcaactactacattgctaactctttctcatctgtagtatagaaattatacaatatttttacaatagagaaagatctagaaattatctagtcaagtctatttgttttatagatgaaggaactaaagctgaaagaggttagtttcttgtttgagatcacacagctgataagcacccaagctggaatttgaaccctgcgcttgtttcaaaagcaaatttattttcactgcactatgctgcttttatgatttgcattccccccactccatttaaaaatatgcttaactatctctgcagaagtggatttctaacatctgccattaacatccactgcggtttgtgagccagtcctcacattccctcgttgccatattcaagactccatgtgggacagccatggatctggcagagaagcagatttcagcagaaggtgtgggtgacttcagaacccctagtgctgggtgtatgattcagaccttacatgaggaaagagtaatttcctgtgcctcccccgtgtacttttaggctatagcaaccacaaagttcagaggaaggtgtaggattcgtgtacttctgttcattttttttcccctctctgtctcattgtgaatcaagggcttgattttggagattttgcttttacctgccaagcagagggaccaggatttgttctgtcccgtggtagacatggctttcgataccttattagggtatcactttcaataacactttctacttcagcttcctcatctgtgaaatgggtttgagggttcctgccttgcttgtctgtaaggattgttttgaatgaactaatggatgaggaagggctttgtaaacatgcctaacactctctaattgtgagggcctttatgaaaagacttaaaagtaagaggtaaaagccatggatttgaattctggttctgcccccagagtggttactgggtacggtgagtagatgttgggtggcccagaaacaacagctccccctctcttctgtttcacccatgcgtatttatatttagaaaggatatttaatgcatatggataaaatatcccaggaattaattagagtttttttcgtccaatgtctctcgactgttttatcgtatgtcccagtccaatatttgcactcttagctgcaaaacttgatgatgcatcaaggaaaaaaagagaaaggcttatttgcatggaagacttttgcaaagaatgttttcttattggcatatattgtcttcatgtgtttctaatgaaacagaagccagtgagtctctgggtaatttctttgtttccaccctgacgctgttgatgtcaacaaaaagtgcagttcatttttaggtagggtcatattttctttttcttttttttttcatttagcacaggagtggtggacttaacctgccacacccttttaatttaataaaatatgtctagattatgggatgtgactacagctttctgtggttggtcgtgtccatcctaaagatctggactcaataccttgaaatgctcatgttactacaatgaaaagcgtgtgtaacacagcagtaagtgtttacattgctc

SEQ ID NO: 131773 - DNA, 1050 bp, Homo sapiens
tggctgctagaattggccttttgttgactttactggagttaaaataattctctgttttcattagccaagagaaagacttgtgactcttgatgcttttcccactgcaggagcaaagcagtaaccccagtaagggagaagagaacttagatttgtgtaagtccactgtgtgttggacacttaaacatactttagatgtattatctcattcatctttctgactgcatgaaggtgctattgctgtccccattgtgtaggtgcagagagagttaaaggtcactgtgcagctggacatgtagtcgatctgggattcaaacccaggtctgtccagctcatgttatttctactgtatcacacttctcacctgtatatgttgaatggccagagtgaaggctgggctttatgggatacagaggaggtgactgtacaccaggggaaatcagtgtcacctttctgacgctccgtggcattaccctcattcagaactcattaccaaatacttcatgtaagtaacctcgaaagtcttatgagtacatcgagaactagttccaagtcacagaactgttcttgtggtgaaagtggttgaaaggctatagttcattttggttattggatggaaatgccctctctctctggttgattaacggagaagacttagtataccagccattgtttcttcgtatggaacgttgcttgttttgtcccattttctcatctgcaaaatgtgggtataatacctattacgtaagattattgtgagaattgagaagtgtgataatgtaggtaaaacattagcagagtatttggctcttacatagaggctcaaattgcattagtggcaggaggaaagtctgttttattcattgttgctccctcagcagccaggccattgcaaggcacatggtgcacattcagtaaatgttggtgagtcattgatttcttttctccctttgtacttattttttacagatatttgagcacctagccttgtgctggacaataggggacatggggtccttcacacaagaaacatttgtagcctcatgagataga

SEQ ID NO: 131774 - DNA, 1299 bp, Homo sapiens
ggaggtaataaagcagaaaaagatgttttatttttagaaattaatgtgcagctttctgatctcccaatccagttcaggttctttcaacttcattatctgttgagaactattagcctaagaaatgatgtgactgtggttctctaccttggctgtgtgttagaatcatgctagaaactcttaaaaatctaggccacatcctagacaattaaatcagaaactctgggggaggggtctaggcagcagtgttttaaagctgccaggtgattccagtgtgctgctagaactgagaacttccacaatatggttataccagctacacaaggcagagagtttttaccttgaaaaaattaaaaaacagcagtagtgtaaaaatattatcctcttattaaaagaagaaacatgtgacagagtgaattcatttagatgtcttgtttggtttgattttaaattaccacacttaaggttgaaagccttatctgttgttccccattctcatggcctgatcactgtgaaattctgggaccttagaagccttttgtattgactgctcgctcgctcgctctctctctctctctctctctctctctctctctgtgtgtgtgtgtgtgtgtgtgtgtgtgtgtgtgtgtgtgtatttttcttttacttcttgtttggccaagaaactgtatgtgttaatagcttgtttgtttttcgtcttttgttttggctaaattgcttttcaagaaactgcctgactccttgtttaattaacttccatatcctgcatatgtggctcatttcacagtccctccatcccttagtggttttccagtccaccacgaagatttgtatgaagaaaatagccacctcatctatttatactattttatcttgatgtttttcattgtttctctgaagcacattatttctgatcttgaaatgtaatgttttaaaatatatttttataggaatttatttttctcctctgaattgcctttgttgttattcctttggattttgaactcacttaactctgtgctggaaagtttctgctgatttttgtcttcttgatctctctgtttctttaaattctaaattattttgcatttttccttactgttgaattgcaacacttagtctctctatcttgtcacaatttatggagaatgatagcagaatccatctcaatagtatagcaactaaacatgtatatcatcgtttcctagctgacagcctgcatggagatgcatcctttaaaaaggggatgaggatgagaaaggtactgtgccatatagtgttgggcatacaaccaagacg

SEQ ID NO: 131775 - DNA, 1088 bp, Homo sapiens
caaagaaggagaagacacgatctttccacaggaagaagaactttccatctgattgtcttctggagttcttatttcttcatagttttctccccttagaagtgattgcaccagaagataaaggtacattggtacatgtcctctggtgattcagctcctcctagccccagaaccaaaagcctcttttctccagagaaccgtttgtttaatgaagctaatgaaacttgagatgtccccacgtgcccctccccctcagctggtgtctctccagggcttggctgccacctttggccttctttctatggccattaatctagtgctcccagcagatggcagctgatctggataaagaacttggttgttcttttcagtgcccattagaggcctgccctctctatctgttcttcctgtttgccatgaagaacagctggccgtgttggtttaaaagccagaatttttatttgtttggagttttgcctcttcatttttagcatttctctctcatctctttctgcctttgagatagctgttcacagtgccacattttctgtgtctgtgaaaaaacgagccccttaacctccagtacacaccatagacatactcacccccttctaaaatatttattcttttagcagccctggctggtttccattgtgtttatttaatctttcaagaattttcttataaaagactggacaatcaatgcctttttactgattaaggtgaaaagttgtacatggtttttcaaatatttgtgcaaatgagagaatgtatgagtctttgcatgcatgcagatattatacctaatgttagactatagctgtaggcagattatctatttacctgtctttctctccttttggaatgctaactcttaaagcacagagaatattagtagttgagtacttaccaagtagcaggctctgggctctagattttggggacacccctgccatcgtggaggttacagtcttctcattacaactctgacccagtcattctacttctttgaagattatcctgtatgcaagctttacttagaattgcagaaagaatgagacatccttagtggtaaacattaatgaaatcta

SEQ ID NO: 131776 - DNA, 1390 bp, Homo sapiens
tgggaggccgagggaggaggatcacctgagatcaggagttctgaccagaacctgaccagcctggccaacatggtgaaacaccccctctactaaaaatacaaaaattagccagacatggtggtgggcgcctgtaatcccagctacttaggaggctgaggcaagagaatcgcttgaacccgggaggcggaggttgtggtgagctgaagcttgcggtgagccgagatcgcaccactggactccagcctgggcaacagagcaagagtccgttccaaaaacagtgaacgaatctttcattaattgagtacctacaatgtggcaggaattgtctaagcactatggatagaacaatgagaaagagactaagaagtatgtgcattgaatttgttttttagtggggacaggcagtcaagaaataaacagtatgttaggtgtcagtaggtgctatgaagacaaaaagagaggagatacaagagagaatgattgttgggcagtgtggtagcaggaggggagacttcatgagcaaacttaagttgtgatggagtttagctgtgggggtccgacagcacgaaggtcctcaggtaggttcatgcctgacacattcacgaaacaacaaaaggaggtcatgtggccaaggtgtagagcgtgtgaggaagaagaggttggaaaggtggcaggagccagattatgcatggcctgctgactgctgtcaagactttggcttttactctaaataatagggagtctttggagttttgttgttttgggttttccatttgtttgttttgttttgtaattttgagaaagacaagcagcactgaattaccatatttacacttaaaacggatccctctggctgctctggaaaatagattgtgagagtatgaggtggaaagagggtgcccagttaagaggctgttgaagtaagtagtttaggtgagatcatcatttagttggtgatgtacttcctgtgtaaaattgaaaacatcacacatttgaacaaggttgaaattaaacatgagattgtcacatacaaccactgtcactggggtgggcagatgcatagaagactattggttgtgtaaacgtaaattggacagcgtgtttcagggagtgcagatgcgtgaaggttggctttgagcctctgctagacttgaccaggttcataggttaaaactgtttttatctttattctttcaatatattagtattacaatagaagacttagagaacaattgaggggggaaatgatgttcctttttttagggtgaatgtgtcagactttcaaagatgactctttggatattaggtgttcatatctacttagaactggaacagaaacataaaatatacaaggcgttcttttccgggcagtataaaaaaataatatata

SEQ ID NO: 131777 - DNA, 1049 bp, Homo sapiens
aaattttctgtcaagtttgggcagaatttaaagactatttcctttggtgggcatgaagtagtactgtttaacatgcttgctcaataaagttttcagactttttttttttttaactagagaatatgtgatttggtgattgactctataaatagtgtgacccatttttaactagattgctgatatgtttttcagcaggactttgtggtttagttaatgaaatcttttcagggatgatcctctgagccttctgtctagttactatcactgctgttgcttttatgacttaattgcctttgtggtttaattcacttcatgacacatctatcaccatgaagtttagactcttcacccctatctttccgagtatttgcttgatgactcctggggtcaaggagaggttgataggtggttttatgctgttaaaaataagtggtcttggctaacttatcacttagttaaaacagtccttttaattttaattaatgcattgaagctacttcttcctcataattttctacttcataattctgttgtctgagcccataacaatggttatttctattatttgtagagaattataaagctctttcatatttgttctaccatttaatccctctatctttatctcctcccctcccctcacccccctcccccccccaaaaaaaactgtattagccccattttgtagatgaggaagctgagacaaagaaatcataggcaagtatgccaggtcggtatggttaatgtatggtagaactgggaatttctactatagaaactggacgattgggatattacgatttagaaaagagcctctgtttttttattgtctgctattactgaaattaccatagtgttaacatcataaaaatatgtctaaagactcatgctgagttctggattttgacagattttcaactaaacctaggaaatttgcttggtcagtctttgatttttgtggacatggttgggagttcacctggcagtacagcttgtgattaaaagtccagttttagaggaaccaaaatctgttcttcctttagagccaa

SEQ ID NO: 131778 - DNA, 1029 bp, Homo sapiens
tgatttgatgattgactcagagggtttgggttagttggtttctaacagagctggcagggaaggagaggggtggcccaatacattttgagcccctggaggaatagggtgataactgagggagtagtattgttaggaagccctggcagctctgggagccatggggcaagaaaggacaattgctcctgcatctgcatctttttgtttctgggtatttatttacagataagtggttttttttaatgcctggtaatctattaggcagtaggataaaaagatgccctcaaggatgtctctcaaggctagaggggagatgcttattgtttatcaaagatctgctgagtgcctagcattgtgttatgggccttacatacatagtatgcctaattttaatatagtatgataaattctttgcaagtgatgtctgcaaaggactatgggaccatagaggagtggaggctgcattctggctggaaatgggaattagggggaacagacagtagagggaggtaggaggagtcaaaacggtttttcacatgagatagaactttcagctcttctgcagatggcactggaaatgtggtcactttcttatccaacatgacaggggactggcaggtggaaatctgtgccttgaaattacttatatttgtctgatagagctaggtcagtttaatgctgcctttcccttgtctgatagtgttggttacagttttaaaggcttatttgttcttttcagaaaagtggctaaagaaagtatgttccctcttgtttctttacactagtgtttaaaaacatcaagagtttctgtccctccttctcacatccctaaatgagtgtccagtccgtaatgttcaggcttgaatagaacggcatagcagtccatttgcctcagcattaggaatcttgtcctccccaggaacatggtgatgatccagaacggagtcttaatactaccatgccatcaacaggagcagttgcttttgtttaggaacaacagtttccttccatttctgtgcagtagttgtctgt

SEQ ID NO: 131779 - DNA, 1142 bp, Homo sapiens
aaaagtagtataaaggttgtcacctgcactttcactgcttttaagactattgactactgtattatttgtcacagtggttaagagcatagtctttggtctcttggccctggttttgaaactctgttgtggcactacatactaattatgtgaacttgctcaagcctttttttttgtccaccagtcgtggtcatttcctcatttagtaccagtttcacagaattgttatgatgataggcgagaaatgcatgtagaatacttacgacactggccaccagagttcaagtgctcagtaaatgttagacagctgcagtagtggtgctagaagtagaagataataaaactcagtgtgtatatatatatttttcttttgcaaaagtgggatcctgttaaatcacctgtcttaaaaactgccatttccttttatattgagcatttctccatgtcattagtctaccaaaccatcatttaaaaaatagctttattggtgcttaattcacgtagcatacttcatccatttgaagtatacaatgcagtgttttttaactatattcagagttgcacagtcaattttagaacatttttatcatgcaaaaggaagtcctgtaactgtcagagtcactcctcattttcctccaaatcctttactaagctactttctgtttctgtggatttgcttattctggacatttccaagccatgctttttaatggctgcacaatattctgttatgtggatataccttactttagcagctattccactgctgttggaaatttaatttattttcatgattataggaaatatttatattaatcttctttacccgtctcagtagagtcacctgagagtcttaatgaagattcttccatgttacttaattaagaagtaacataaaatcttcacctgtggtcttacatgcctgtgctgtgagatgttcctgaagagcttcaggctcctagagctgctatcacaccataacaaggtccctaacactggagccaagctttggtaacaccctacactgaggtccagttggagctgttcagggaataacagcagcagcttgcccaacaattttggtacaacagtttggtgggagaggatgagtgacttatttgagcggagccattggaagacagaca

SEQ ID NO: 131780 - DNA, 1803 bp, Homo sapiens
aggatggatctaagagcaagatgacattgtgatgtcaactaaccttccagagaatggtctaaggggtaatagggccctactcgctctttccactcgaaatagccatgccccctttccttaactttggagcccacaacacttaagattagctgacatttaatatgtgtgcctgctaggttccaggctctttttatatcctatctattctttatgtccatctgcttgggaagtaatcttattccctttttgcagctgggggaactgagcattggaaaggctggtctggccaatggacagctaaggtctttctgatgccaaagcccatttttggtacaccatatcatctgctactgagaaaaaaaggctagaagtggaaggaggtttgtttgtactttcaggagcatcccagagaatcgtagaattgggttcagtatattcttcatggcttcacctaaaattttcagctcggggcatttttataggtttaagaatgattatatgtaaaaacaggcaaaatttccagaaggcaacaaaagataaatgatagaaccctgtcttctgtccctttccccatagagatacctacacacatttaaactgggaaaggaaacaatgatccatcgtaaagcttacccgtaagacaaattgcctttggcaatataaaccttaaatgctcatgaaggcctcacatgagttaagtacagtttaacatgattctgccatttgagcacctactatgtgcctggtttttggtagatgactgagggaagggtaacagaatgaattagacatgctttctgtcccaaaggtgttcacaggtgaatggggtggtggttgtggggtgccaggttagctgcaatatagcatagaccggtcagagctgtgataattcagattgctctgagagcacacatgaggtcatgacaggttccaactggagaaatcttacagggtcctttcggacctggacctgaggaatagatgggtagaacatttcaggcagaggacaccttttgagcaaagacccagggtgagaaaatgcaaagtggaatggagactcccattagatgggtagtacggtttcatgcttactcagtttggtttgatgaagcaatctctctctctgtctttgtgggtttgtgtacagtacatgtgtgtctttctctgttaaatgccttttatgttttgttggggacgtgtgtgggagtgattcatttccagctgggtccagctgtaatgaaaatgtcctgtttgacaaattgaggaattagattacaactgtctctccctgaaagctgtgacactagctgtaacatcaaacatccctccctttgtggggcaggacaggagggaaatggtgattcagggctgctggatgtgttgactagaaaattatttgagtaaataagactgtgttgctccagttaattgataaacatggcttctcactgagccatgtggttttcctccaaggagaacttagaatggtgccatctgaggctgccctagtagagaagtgcaacacgtcataagtggtcaaaacatttttattggaagtaatgcatctgtgtgattttctgtttagtccctatttcagagctctttgttttttcttaaaatgtaaaatactctcaactttagcttgagaatacctgaagtgtttagttggacatttattatgagccagtaacatatttgcacaggagctctggaggagagcagtatcacttgtggaactctgagcgagttgtatagccacccacccatgccactttctacgtctgtaggactatagatttggac

SEQ ID NO: 131781 - DNA, 1038 bp, Homo sapiens
tcagtcattgacatattaatggcttcttccaggttggaaaattaataaagattatccttttacttgaagaaagtgataagagaagtagaaagaaaatcaggctgagattaactaaggaagcagcctttttattctactttcagccattcagaagagggaaaaaatccagagtttctaataagaaaacgaaaagttgttttgcattctggaatatttccaaaagcattgctattgatgttgaattccactttggggttggagattaggaaatttttggaagtgttgaagtaaaattagatgttctttgtattattttttatttgacagtgtacaaataatgaaactgtaaactaaagtacaatgacataatcacagaaatgatcataaaaatggttatttaacttgaagtgggattgaatattcaaaaagtgcaggtggtgtggatgggcttctgggtgaaattaggttttctctttcagcaggaaaaaagacagagttttcattatactccctgccattggtgatatggtgtagacctgtaatgataacaagcactcaacatcttcattgaaaagcaccagaaagatgcagagcagaagctgtaaacttcacaagtgccatcaaatcagactgtttcttcaaagttgaatggaaaatttcagatgttggtcatgaaatgtttactctgtgacccaaaaccaagttaacaggcctccaagagaggtgcttgctcttggatttgaaatagtagccatagtgataacttctcttctctgtgtaagccctgtaattttgtgtattccatcattctctctggatttagtggttctgagaaagcaaacctagaccttgggccgagacttcacacagaaatatttggggatctgctctatggttctctgggtttgggcctcagtttccccatttttcagcttttgtggattctgatcattctccccacttgatgtgcattgtgtgtttgcatgtgtgtgtgtatgtgtttctagatatgtctgtgaattttggggtgtatttttt

SEQ ID NO: 131782 - DNA, 1054 bp, Homo sapiens
gtctgatatgtatttggataatctaaagggagggtttatttatgacaaaggtactttgttagtgggatgatgatttttagtcacattgctgttttgtattattaaatggagagctgttggtatttgagagagatgcccagtttttccagagtctgaaaagagatttttgttgatgttgtagtataaaaagtactctgtgacatggcacatggctgccaaaagtgtgaaagaaacaggaaatcactacacacttgaaatataatagaccttttcattcatcttgtgtttttttccctctgaattgttaaataaaagtatattctgttacatgctacagctagaagcaagctttaagctatcagaatggttgtgaagaactgtagaataatatgaagataactgtatttgtttcatggcataaagttcttttcaaatttggttactcatcctgtggtttaaaagttaaaaagagaccatatatattgtctctgaactctagctgaatctatgtgaaacacaagtagaacttttgggaggctgtgaggtttgtagaagactttaatagaaatgaatgaagagctggcattttgtaataatatttcatcatgtgcttttctttttccgttacccaaggaacatatttgatgtgcttgatatttttgttgttgttgttacctgaaaatcaaagagtacctctttatatgtgtgcctcagcaactttttgtggtttataggataatgtccactctccttaacagctgcacctagagtcctctgccttctgctgctgccagaaggagcagaagcaaactggaagcctcttgcattttcacgtctccttgcctcctcctgtaccagatgaacacctactcatctttctggactgagctcagatgtcaccttctgaagagacccttcctaactactgcttttccctgttccccagtccccattagaagttggcagcccagtccttgcagctccagctgctctgtgcacactgtggcccaacacccatgaggcttcacggggttccctgatggctgtgagtctc

SEQ ID NO: 131783 - DNA, 1056 bp, Homo sapiens
cttcattttacagatgagaaaactgagggaaggagtgacttgacgaggatgtgcagtcaggggaagctggagtttgtgtctctgaggtctgtggtcttacatgatgagtgccacccttgccaatttgccttcttcatcctcctcaccccctaagacttcttgattgcccttggggtctcaggacattctcttttccacctcaccgtgaatgccctggctcaggaccgacactttcctttccaaagtctgctttcagctaactcttggaaggaaatctctcccatgtttcactcaaaggtataaatgcctgatgaggcattacagcaacttatgctgaagttagttttaggtgttgggcatggagatcctgtcacaccttacagggtagctggctgtctcttcccatctctcggtccagtgaacccttagaaaacaatgccaagagtctcctagtttgactctcgtttcttgctgctcttttacctcttatttgttaataaataattatataaataaatgcttttcctgtttctctttttggtgccaggacttccctaaagcctgttcgtgaaccattggtgactgaaccttggtcacttggtacgtgtccttcactgggctgggcagtcaagttgaagacacggaattatttaatctttgcaccagcctcatcaggtgatgctctggttcccattttatagattgtggaaacagagactacttaagaggtgccaggctgttgacacatattttatcctttgatcctcataacaaatctgtaatgttagtaatattttaattttcaagtaagggtcctgaggcttggcagtcagcagttttctgtcccaggttttactgccgaagggaaagaaccgaggtttatacaaagatctgtctgaccctcaagtctccaagtctctgccattaactgctctgcttgcagttcttacccaagatcccacaactgatgcttggttaagtcaactcaagcgcttagacactgtgggtgcttcatggagcttactgaaaacaaagtgagtcatggataggagtttg

SEQ ID NO: 131784 - DNA, 1021 bp, Homo sapiens
aggtaaagcccaaaagacgactgcattttggcaccaactattatagaaagcagagttggctaagtcaatctaggccacccctttccctgccagatgcgttttgggtggaggaaaatgtaagctcttcttagctctattattaaaatagcctggataccttgcatttctgtagcattgtacccaaaggctagggtcagaatggccttgtctccagtgcctggtatagcacccagcacgcagtgggctgtaagtatagtgaggactatgttattatgacgcacattctgtagaactggaaaaggcctcagagaccatctagtccaactcctctttttatggatgaggaagctgaggcctagaaaccccaagtgtgttaggctgttttattgtaagaggtcccttccccttccccagcaaaatgaaatacattggttaaagcaaaatggggacttattggaaggattcatgggagatattttatggaacatgaggggcaagaatgagggtcttctcttttgggcaaatggtagatgaaggcagctcgcaccaaattattcccagctccagtgccctacaccacattggtgtctgcctgattctgaggcgaggatatctgggaaggaggattggattggctccacttgggtcaggagaccacccttgctccagtcagctttggccaggatgagggggttatgtgatgggtggggctaagtcttcgtcttcagcctgggggtgatggtggtcctcagaggagagtaggaggatagggaagcacaccgtttatacccagatcacacagcaaagctgggactagattcagttcttctggcctcatcttcatttttcattgacatgacagttaaatgtaaatgatggtacttcacagctgttgggagaatcagtaggaatataagggaggcagatgcctggcactcagtgacgcttggaagatgttagtttctctgcccttccctctgcaagtgtcacctccccttgatcctttctgctctgtactcat

SEQ ID NO: 131785 - DNA, 1064 bp, Homo sapiens
ggtcgtacagccagtaagtattctgcccaggtcatacaaccagtatcagatttgtgattaatcgcattactgtcaagtcctcatgcaggccagtcagacttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagctccccttgctcaagaatgcaagtgcattacctcttaaattttaaaagctggtaaacttaataggaagtgcttctttatattgcaggtgctaaacttaaggagcccattaattacccccaaggagattgtagtcttaaaaaaaaaaaaaaaaaacccttaggaaggatttagctaaaatcaagatttatacttttgcttaatgtagagaaagtatgtttgggtctgtctctgacctcttgaagataatacaacaaaaggcaaacaaaccttcccataatgtttctctcccacacacaagtcaaggctctgtgcccaggcttttgacccagtctggaggtacttaggatgaggttttgtctggatgaaaccagcaaaggtcagtgagtgaatatatctgtctgtagaatcaaagggagaaggaaattgtatatgttggaactcatgctctttctaaaacaaggcacaagcctgttagccagatattccatgctaatgcttttggtcctgatatggtttggatttttgtcccctccaaatctcaagttgaaacatagtccccagtgtcggaggtggggcttggtgggatgtgattggatcgtgggggcggatgcctcatgaatggtttagcatcatcatccccttggtgataagtgagttcttgctcaattagttctcttgagatccagtgttttaaaagtttgggtctccacttttctctctctctcgcccctgctttcgccatgtgatgtgcctgctcccacttctcctcctgcca

SEQ ID NO: 131786 - DNA, 1022 bp, Homo sapiens
cctggctaatttttgtatttctaatagagacgcagtttcatcatgttggccaggctggtctcaaactcccgacctcaagtgatctgcctgccttagccttccaaagtgctgggattacaggcatgagccaccacgcctggcccagagtttagaaatcttaaaacagttgagacataaaataggtattctaaatgtctacaaaaacatatttcagtggctttatagggaacataggagactttgctgtcattgcaccttcaagttttggtctgattaaaaaaggtgcctaagttccttggaggcttagtgtttcttcatgtttatatttcagagttcttaatagtgatacttaaatatactattttttccctgtactttcgaagatttggatatgagttttcagatttaaatgtgggaactcatttgagtataatccgtgaacagcatttgttcaacacatttttggggaggccctgctatatacaagtcattttccaagtcctactgaggtattggggttatccagattgtattatggagaagctagtggtctttaagaaataaagaaataaggctaaaactctttaacagggtagaaaggggcagttcataggggagggaaatagtatagaacattcatcctaggaatacaagtgaaatcactcaaattaccatgtagtcaatatacagattgttcagtgcctcctatgtgcccagcagtgtgctaggcccagggatacaatgaagaagaaccctgccctcaaaaaatgcagcctaaaagttttcttatggaaactggaaatcaagtttgggtctggcattagaggcttttcttaatgtattcacctggtgtgttcagttatttctgaagatatagaaatgtttgatgaaatgaatgaagatacagaatgtagattcagtatcaagctctatctcataacagtaacattcctactacatgcaaaccctatacatactattatttaataccttttttcaccctactatcatcaatggctcca

SEQ ID NO: 131787 - DNA, 1048 bp, Homo sapiens
agccccccaccccaaggacggacctctgtaatatggggaagcttgggcttctgtgggccgactcatcttgaaatgagctttgatactcatgtttccacacacgtagaactgggattcagaagtagagggatcccaaattttaggaggagagagacttctgttagtgctgggtcccatctggcctgcttggtgctatgactgaatgtgtcattccggcatacttccagagttctctctggagtcagtattgggtgatgggactgaattgtgaagtgaatggagaaataccacctaactaggtttgtttgaaaaccagaggtaaatggattttttcttttcttttttctttttttttgtctttgtgaactgccagtctgttatactcgtctgggattaaacagaattgccaggcattgaaccccatcatgggtctgtctttcacttaattgtaataaattgaaacatgttgatacaggagcattttgcatcccctttctgtactaattgtatatacttctaaggatgtgacattgattagactgagtggttattttccttctagataagtttttcagtgcctcctaatagagctgccagttattttaacgttctcttcctgcacatttagatagtgttgctgtattctgtttgtgaagggtgtgataagattaagtattcggtgatgctgtttgtagaggtatgcgagcatattttccagcaaccctgtagtagagggttaatgttaaattacatgcagttgctgttgatgttagtttaaggttaataaatttaaaagcaaatatttttttttatgagaaatactgttgtaagattaggtagaaaaatagagttaactataatgcaagtgtagtcacttaggaacttggaaccaggctagaagttcagtgtcatgttagagtacattgatgatacccatgttctcaaaaatatagcaatgtttcaggatggcacaataattttacaatttttattctgaacttgaggaaggtattggccaggaaaacattgtctccggtcggcatatttt

SEQ ID NO: 131788 - DNA, 1003 bp, Homo sapiens
tgcgctcagtcagtcaggcccgcgccgccgcctgtcagcgcgtctgaggaggcagcgccgggcgccccagccgcccagcccgcgcacgccccagcggccggccggagcccagacccccgcgaagaccccgcgcgcagccgcgtcccctcccccgccgctgaggagctgccgccgccggcatgagcagagggaggcgggtcccggagagccccctgcctcgcgcgcggcttggagtttgaagggccccgcgccgagccccgccagcgccgccgccgcctgccttcgcccgcctccttccctccctctcgccgctgccggggacgggagccgcgcgccaggccgggcggcgggtggcgggctgcgcgccggggttcatgagcctccgggcggcccgcggccccgggagcctgcgccgtgactcaccccccgcccccgcttgtgtctcgtccctcccggcaggatgccggaccagatctctgtctcggagttcatcgccgagaccaccgaggactacaactcgcccaccacgtccagcttcaccacgcggctgcacaactgcaggaacaccgtcacgctgctggaggaggtaggtcgggccgggacccccgccgtccacgctcgccgctgccgccgcgcagctggaggatctcctctccgagctgggaggaaggggacgcgggggccgggggcgccacaccccctcagggagccgccgggtgaataagggacttcggacgggcggcgccttccccatctcctcgccctttctgggtcttgcgggttgaaaggcctggggactggaggtgggagaggactgagcgagctgtggacactccagggaggacagaagatggaagtcctgtccctggcatgcactgttcggcgcttccacatcttcgtgaccctcctgtaaccctcgaggtaggtggcgtcaggccaccgagggcccagaggcgaagtagtgcagccaaggtcaccagcaagggactaggagatgggcagt

SEQ ID NO: 131789 - DNA, 1047 bp, Homo sapiens
actttgaaaataagcgaggtctctgaagactgtttattcccaaatctgagatcccagacttcgggaattactgtgcagccttccccgctccctcttttttcctcctcctagtgactaatttagagatatctgagtcgtggaatgaaagcagatgtatttatagtcatctttcacagaaaaggggagttcaaagggaattcacattggttgattattcactatgcatcagcctacttatccatattttctcattttatttcacacaataatctgaaacatagtttagaaaagaaggtgaataaacaagaaagtagagttttaagctcaggtccatgtaataaaaagtgtgttcccttcccactttagccattgtcgtcattccatgagggcatcgggagcctgtgatgaatgctgtcgctggctaacactgtggatcaaagctccttgtggtttcttgggcccacagagcacctctgactccccacccacactcccccacctctggtttctggtcagtcatcttgcaaatgcatccccccttggttataagacagatggatgagagtgaggtctgcaactggaaatgtaactgagagccaattccctgatggcaagtgggtcgttagcgccattgctgttcagaagaataagccaccactgttcctgctgcctttttttcaaggcgacaaagtgcatcctgccataatcatggtgttagaaacctcagtcagcagtgctcagagtaagaggcaggcatgaggaggacaagagtgctgaacagtcttattataatggcgacaacagagatgatgcttgctttatataaagccaggtgcacacaaatatgtgtgtgcgcacatttttcctggctttggggaggatggtgtatatttcggggcagctccacacaaagaaatccagcatttacgttttgcccatgtcagtctctatttgctttcagatatccaggaatgattttcagagtatttgagaaaatgagaggtgcagatggttttcactgaggcatggtttcaaatttaaagagga

SEQ ID NO: 131790 - DNA, 1048 bp, Homo sapiens
attttatttttgcccagtgccaagggaacaggaccttcccagtcaggatagtataggaacagtatggagagtaattgtgtgggctgcaggctctgtgtccggttggaatatggccttttttctactcatgttaccttgagtaactcgctcaactttcctgagcctcagtttccatttatgaaatggatgttaattccaccctcataggtttgatctggaagctgaatgtttagacagggactggcacattggaaacgcccaaataaatgatagccatgcttgtccttattattaccattaaaagacatcagagaaaggaggattttaatttgtgggatgtatattgtgcatatctatgtctactttcaaagtcagagacagtagtctttctttagaacttaatttccctcctaatcattgggtgattgtttttctttgcagcatttcagaaacggctctctgcagaggaaatggttagtggctgtggcagacccccttctggtgaaatccgaaacagaaaacctcacaaaatttgggattttgctcctaatctgagagtctgggtgtagtggggagtgggggttgttaaacagtctggagcggatttacaaagtttgggaaaaccaaaatcaatctctgactgggcagagaggtcgggcagccaatgagtgattcattgtggtttcccacggaaatgccacatttcgggggtgtctacctggaggatgcagcttggtggttttgctgtaagtgtttcagattcctttgaaacccaatcagactttgaagagggaacaacatgctcatgagcgaaaacagaagcctgaaatgaacctgctgggaactgaaagttgggtaccagctcgtttactccaagtaaggaacagataccagttttagacccagcattgttccttttctgcaattctctctccgtggccagaagcagtaggacagctctgagctgggcaccaggagtcccagggtcctgctccaggcccactgtagctgccgtcccctctgcctggaagaacccttgtatggctgt

SEQ ID NO: 131791 - DNA, 1153 bp, Homo sapiens
ttttaactcctcatacatgtgtgggtactgtggattttgttttcttcacacactactgtgtgtccttaactcacgttcttggacttcgcatccagtaaatatgtccagtttaaatttctgttttattccttttggctggaggaatatcatttacaatcatcttcattgttattgccagtttagtacttctaaattcatgttcacgttattcagtgaatatctgagactagcactatgctaatcttttattttctgagaaaccaaaggggaggaggtaagcacctattgaaagttgaggcttcaagtagaatttattggtaacatgccagaattatcctgtgaaataaaatttttagttatgttctagggttatctagcttcacagagtggatatagtaaactcgtttcttttcaaatgttgagttcattctgcaaaatgattttaggatgggccatggtggagtttacatagttaagaatgcagatttcacaccctgactggaagacaagtgaaatgtttgttttatctgtcattgttaatatttgtcatggtacattttttatgactgaataaaaatgtgctgtggattgattgggggtaccagtgtgaggtgaatagtgttcatatttgccttttctctcctttggcagtcacagctgccgaaattgctgggatagtgcagtggacaacaatatttctttgaaattctgtttgtagaatatatatccaacacagagatggcaaaattgttattctctgtaggaatttaggaggaagttcacagctcttaggaggaaaactgtgctcagataagctaagtgtttttgtttgattggttgttttaatgttaaatggttgagaggcttagtgataagcccaagccagttaatccgtacgagttttaattaaaatcaaagggttggaggtgatcactgtggtctctcagactctacaattccgagagcaacccttgctgtaagtcatagaattattctactcttgctattttgttgcttatttggaatattggtactcattgaaactgttgttaataactagaatccagtgaagcatgcagtaaccccactggttaagcaatgatatatctcatgaatattaacagccacttcactagaattattttggagatcc

SEQ ID NO: 131792 - DNA, 1040 bp, Homo sapiens
aaatgctgctttgaactggtttttctttagcctgtagaaaagaactttgagttactggtcaagtagttttgaccatactggcttaggaaaacagcgcatcagctgtctgattgctatcatgtaaaaatctgtgaacgactttgagaagtcattggtggattatgttgttcaggaataggaatggagctttcttcctatcacttgtatttttttttttttttttttgaaaggaggaggaggaggaaataatttctgccttattaagtggtggtttaaatcatgaaaacctgaaaggttgagatgagtcatgatgtgggggttcagtttattgggaactgacaggtttttatttttctgttttttttttttttttgaatgatcttgtgttgtagagttgaatacagttctagggaagtatgatcacaaaatgaatgttggcagttcctcctatgattaatatgtcagacatgtcaaaattctctcatcatgtgtatttgccgggtttattcagttcttgaaatgaggcagctctcaagtatattctaaagcaaacaggaactactatttttcttctttccatgtatggtatcatattatcccttttgcatatgtatttcttgctctctgactttaggtgttattagatagtgtgattctaatttttatggaggaaggaaacactagtcaggtttttttttttaattttacttctgaatcaagagttttctgtattcttaaattaggcattaagccatttgctttacagtctttaagaggaattctgtccttctaaatgctatttttgtttttattcttagttggtgagttattcagctgtacctttttattgttattacctgaactccagggtatttctgctgcagtagttttctggataatgctaagtgttcttcacatccctgttgtttaattggtgtttttgaacagctgtcttggcaattagctaccaagttcccttgatgtggttacagttaactgtaaacgaatttcactcctgatgagccgagtgaagtgtaagg

SEQ ID NO: 131793 - DNA, 2025 bp, Homo sapiens
gccttcctatttcatattcttctagtgtatcataatcagagttctgaattccacatgctgtaggaggagaatagtggatagttttctcttttatgtgctggaattaatttatttttactgataatagtatttattgaatatttcctaggtgacaaacaccgcaaaggcactagacatacaattggggaaaagaactacaatatagaattaaatttaaaggaagaatttatattgcttagacttgccagttgttggagactttctgtgatatgctcatccccctcttttttttttttttttctttcttttgggaaagaggaagttgggaagaggtcaaaaatatattagttttgggacccaagtgagtttgttggaagggatcagaagctaggataaggaggaactaaaggaatgctttaaggaaagggggtgtaagtaggcttgctttcttatttaacctgtatgaaaaacctacttttattaagctagcaatataagtactttaatagtatcttatttaagctagttggctttgcttgcagaacttgatatggatattatcaagttcttgatagctttatatttgatgtcaatgacaagttaggtaagttacagtacttctgtgccctctgctaattaattagaagtaaagtgaactaggcacttgctgaacagtaggtaaaaggatctagagtcagaaagatcgactagaaaatagtctgatacaacatgaaggactatgttcaggtacctgcagctgaactcgaaaagccttatgaatttacttcaacaagggagtcacctacatttctatacttgagtaggtccaatgattttattttacttgttctgatatttataagtagaatattcatatttatttaaaagtctatatagtaatttcttttgtgattattattgccagttatttcaaccttacattgtctttgatataattttataaaaacctgaaattgtaaatgaaaaattttaacctatatgccttctttatagtgggtagttttttatttttagtaagtggtcaaaaaggtatttttgttttgtgttgggccttcctgagaaactcactgtgatcatttatttccctatatggcaatgcatccctcatctgttaggcacacacatttctgcaattatgttcattggtcatgatttatagaaagctaaaatatttaaagtaatttagaaatttgctggtacttgagtttagtgtggcagttactctttgaagtcatcaggtctgggttggaattgcagttcctcagatcctccccagctgggtgttactggacaaaattggcctctctaagctggtttcctcatttatccaatggagatgatcataaccctcagagagttacgataggagtgagtgaataatgttgtaacatccttagtacagtgctgtacacgtcatcttcagaaaatggtaattgtccctcctgctattgatatagttatggttgtgaaccatatgtaaaatttattgtgatttttaaattatgggcttacaacaaagatttttatgctattgggaatcctatcttaagggtccttgatcatcatctgcttaccctgattgtaatactcctcttactgcattactaataatagctaccattgtattgagtgcttgcttaataagagctttatatacaattttatttaattcttattattatgaagaaggcattattacatctatttttactgatggggaaacttgtgtgtagtaagacaaagtaacgcacccagcccagctggacggagggagactgattcacttcagatctgtctgttccaaagcccatgttctttaacccatggctgtccactagacacttcaccatttgcttatctgtctctcctggtaaacctaagcttcccaaaagtgggaactggacattgtttgcattccaaggttacatttatatttcaagctcttttaaactaaaagcagtgtatagtgtataacatcagaaatgttaatgtaagtgaaactta

SEQ ID NO: 131794 - DNA, 1042 bp, Homo sapiens
agttctatgtatccatcatggtgaatgttagcactaaggaggttatgtgcagaagggttctacataaatatcgtttaatccccaatccagaaagggaaattgtaaagcaggcaacacttaaaaatataataagcatgaaaatatagataatctatttatcttgttattgtttttaggatggccttgtgaaaactgatatggagaaattgacattttatgcagtatctgctccagagaaactggatcgaattggttcttacctggcagaaaggttgagcagggatgttgtcagacatcgttctgggtaaggaaactaatggctgctaaaatagtatctttggaaaattctttctagacttttaaatcattctatagattattttgccatttagtgagacaaagataatatatagaggataaaacattgtaatattatacaaagaaatatataatactccaatagatgctgtggcttttattactttcctggtggtcaggttttgtgagtagactatgttagttaactgagttactttttgcttgtgtctattgatttttgagtcttttctaatgggaaatagtagaaattgactcacttagtctatcagtgcaatactgtaatttaaaaatcagtctctaaattgaaaacaaacagaaagatcctgttaaccagatcattttttttcacacagcttcagttttacctctcggaggagtaataagagagaaccgtgttaggcttagatatcaaggcccaggaaattcaagcatgctgatttggaactgtgctagctatactcttactgataaatagaagtctaccatcctactgtattctctgtgctcaaacaataataactttgcaatttggattataaatactttttcattctgtcattttatgatccaagtttattggagtattctattctccaagtgatatattagctttctgtacctttgcgttgttaccacttagaacattttagtaagtgatggcacacatagctttatggttgattgttgaaggaaaagtatccaa

SEQ ID NO: 131795 - DNA, 1004 bp, Homo sapiens
tatgaaattaaatgtatttggttcacacttctgaagaaggtgaagtatattatattatttgtgttttttagtttgtcaaatttgcaaatattgaagaagacacaccatcctatcacagacgttatgacttttttgtgtctcgattcagtgccatgtgccattcctgtcatagtgatccagaaatacgaacagagtatgtattattttactttatgatctatagtaagtaatttagagattaatattgtgttcatatgttacataatgattaccagaggaaacaataatatgcctgaaatacggctttccattgctgttagaagctataattgctgactgaagtagcaaaatgagaatggttttccagctcactaaaatgcggtctttactgtagcctagaatgtctcttcatgccctgcttactctgtcagatcctgtccttctatcatttcttcctaccttcactctaatcctgccatgtggatctccttgccatttcttgaatactttagtcacacctctcctcaggccctttggacacattggtctttgtgcacagaacaattccctggatgcccacatggctcgttacctaactttgttcagatttctgctcaaatgacaccttatcacaagaaccctccccagccaccctttattaaatgtcacctctctcattctacccctagctatctttatcttcttatcatgtatctccttgtttcttgctcctctatggaatataaattccaggagcgtgaggactttggtttgaggactgcagtatcgcgaatactttgaatagtgcctggtacatagtaggctctcagttagtactttttgagtgaataagtagataaattgaatgaatgtatattactgaatcactatccatctgaggttgtcatgacaactgtcttggacatttttaaacatttcttctggatatatcctactaaaaatctggaatcaaatattttataaactcaactataggttgatag

SEQ ID NO: 131796 - DNA, 1009 bp, Homo sapiens
attaccaccaccaccaccaccaccaccatcattgtcatcatcctcgtcgtggttagcaacaaacaggaacagctaacactgagtgctttctgtgtgccagttattgtttaaccactttacatgaattaactcatttaaattgttcaacatttctatgctgtagatgtgacagttgttctattttactgatgggaaactgtagaattcgttttggggggtcatggctagaatgtactgattagtctagatgttagatctgaattggatgaagctgtgtagctatagtagctattggtagttaccaccaacactgccctttaaccttgagcaagggcaccgctatctgctgctgcaccatttaggctgctgtctcacaaggcatgataaaagtttcatcttgtttgttaatgtgctccatgccaccttgtgcttggccttctcatcacccaaggtgtagcagcaggtatgtaaagcaggcaccttgtgtaggaatgttaggcttgcccactgtgatagctgcacgagaatctctcaagactctttatgttttaaaaagcagcatgtatagacacggctttgaaataggcaaaatttgcctttgtgtcttccaattcatttttctcacctgttcagtatcatattactgccacctcccattgtccatctgctactcctgaatgcctgcattattttgccatggagatgtaaagcaatgtcacctccctccccatatcttctattctttaaacctatttacagtttttagaagacaatgctaggtaaactgaataaacaactaattggtgagtattttagatagcagaaagaaaggaagtaaatagccatcatatttgaccagaaggaaaatgttttgagactcattgggccaccaagttagctctgcttgagactttgttcttttgcagtttttagaaactgttttctagtcacttttcttctcattcttgaacctatagatttttattttcttttgcttttttaaagaagt

SEQ ID NO: 131797 - DNA, 2513 bp, Homo sapiens
aaatgatagtcagaattcgatcttgggcgagtttggctccagggcttatgtacttcaccaccactgtattatgttgcgtcttaaagcgattcatctgttaacattgccttaaacttcagtgtaagggcaaattttaccataggtaaatgaaacctcagtacacatgacttcaacatactgtattacgtcttctcactttccttcctttcactccatattcttttgtttaatacatgatatcattcttgagttgttctttataagtagaaagaacacatgctctggtttgcttagtatagtcgtactttataattattgataatacctccttcactctctgcagtgtccccatttggacagtaaatcaaatggctaccttacctataaaggcagactaataattgcacaaggttcacacatcagaagcatgcagcttcctggacaagaagttcagtttcaggttttgtgtgtgtcttcctgcctaacattcatctattttaacataactttaaatgaaacaaagtaaagatgaaaacacaaacttagtttttaccttgggtgattttaaaagtagatgtgtattatgacaaaaatttgagaaatacctagagatgaaatctgttacttgatagagaaggaggggaactttttgcttttgagcagagtaaccattatgcatagggcactcctgcttcttatcaaaccacacattccaaaggaaagaaaggtaaccagcctgaaaacagggcagaggggacctgtctgaagacaaatacagacagggagattgagagccacaggtgctttttacagcttggtggatgatagtagaccgatcgtgactcatgggtgtaagtgtaggttttaaaaaaacaaaactttgctgttcttcaaaaaaaaaaaaaaaacctattcactggagttaagaataaacatttttttggctatcctttttttgatttaggccccaatatcattcactatggttgatcaattttatttatatgtgataaagttgcctttgttaattgcacatcttttgagatctccttgatttaaattttgtcaggtacacatggataatattttcattttgacactagctcttgattagatgagtgttttgactctttagcattgttaggtgtccatgttaaatagtatttatctagtttggctatgggaaaatactgtgaatgtcataatttatgttttttacaaaattttgtcctattataaaagtttataaatgcactttgaaattacagagaaatataaagataatgaagttttctcataaatccctttctcagaggtggccagtgttaatctttttatatataattttaatttactttttaaaaactagattgaattttattaaacatagaattgtgcagtatgctttttttcactcagagtgtcataaatattttccagcatctctgtttattctttaaaagaatggctttgtattgtggctatttattgtctcataacatgaccaccagtcactaattggtcatttacgtgtcaggtgttttttttattcttaggaattctgccaaggtacatgtactttttatacatctttgtactgttttgtctccttcaggctcagtattctcaccatgtgatccaggagattctaggacaccttgatgctcgtaaaaaagatgctccccgggttcgagcaggtattattcaggttctgttagaggctgttgccattgctgctaaaggttccataggtgagtgccaataaataaaataaaatagtgcgttgatctggttcaaagtgtcctttcagtatgcatagcagtgtatgaagaactctttaagaatatttctacacatttttcggtgtacaataattttttttgaaatttgggttcatgcaattattttcaggcttctttagcacacagttaagtattttccttcacatcaattcctcctccctttccttcttctaataaaggtttttgagtattgattatatactgaacattgagagaatgcagatataagaaactgatggtgtacttgtgattagacagctccacctaatactgtaatatgtggcaagctttgatcacatatcatttaaaaagccagggtttacagaagggagggaaaatggattaggattagcacaagcaaaattttatgtggcccattttgggtagaatgtatggtgttagtttagaagtcagagaagtggctttaaaattaagttgtagccaaattgtggacatagttcttcagctgattaatagtccttaaagatttactgtaatcttcatgagaaatgtgctataggataatttttctggcagcaaaatgtagggcacattagaaataacaagtcagtgtcattgttatatccatgtggaaaagaacttgcccttgcatggaagcagtaggaatgacaatgtcaagttgataggatttgataatgggttaatgagaaaaagggatagttcaaaaattacgatattttacttacatgt

SEQ ID NO: 131798 - DNA, 1021 bp, Homo sapiens
tggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcaggtaatgtgccattttgaaatggatctaatgataatgtttttaaattgctaaattagtgtatttaagtattgtgatttttaaaaatctagcatgttcaggttttattaatccataattttatttaattggtattgagataatttaatcaatatgttttaagataacaaatttttggagggcacgtatgtactcttcagaagcaattcagtagtatcattacatacaggcttatcaaactcctaagtataaatacaattttccatataagatgtgatattgtaaataagtgtgctattcattaaaaatgatatattgatcgtctctagaataataccggatgtagctgacctaaagataaaaagagaaaaaatttgcagacaagacacaagtttcatgaaaaaggtaagacatcttctaaaaaaataaatgtgtagtgtaaattacagccgtttgaattgttaggtggttttatattgatctgtgcccttgaaattaagccatagaattttgaatttgaaagacctcaagacgccatcttcagcctccctcaagtgtaacattcctgtcggtgtctcctccagcctgtatttgagcattctattgttgggctgctgtagtagttctaaatttcttctctgagtaaaatgtcttcctataattcttgccctggcagtcctctcccactaaaaacacacgtactgattcctcttttagcagctcttttatatagacagcttcaagtttctgaaaatagctatcaccatcaaataaattaactatggtgagtttttgctgtcttattagacattgttttctacactatttgggatataaagatgagttgggcaggatctct

SEQ ID NO: 131799 - DNA, 1034 bp, Homo sapiens
aacctgcagatgctcttctctgtacggctaacccacagcacagggattgttccccagtcaagagagcctcagtacatttcctctcagtacaataatctttatcattgctgaggctgtattgccaaagtgtctcaggattctgccatccatttcactttttttctcaagtcaatccataatttgcttttgttttttcaaattactattaaaaaacattttcattgttagcacaggaactattttttactggttatttttatttaaggtttgtcttcaactttaacattagtttgtagttgtatattagcatgttgtttgatatttataattgaaatttgactatctgatcaacttaaatttcatttccatgttaagctatataataacatagctacactgtaaaagtatatgcatgtgaaatctgccttttctacattttaagcaaaattacctttgtcctctgtcttttctcctcagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggtatgctttcataaccgttcactgcagaaaacattttttataaagcagacaacatctttgaaatgttgccgttatccaaggacatgaattttaaaagggaggtatctagttgtaaatctaaaatactcaagactatgactacattcttcatttattccttttacatatgttgcatgagcatcaactggtgtgctaaatatccttcaaggccatagggatatagtgtgatgaagcagacaaacatagtccctgtatccacacttcctacactgggggggatagtcattaaataagaatgacatacatgcagttgtttaattagagttgcgtaagtgttatgtaatagaaggacagtatgcaatggccatatatgcatgtccgtgtgtgtgtgtata

SEQ ID NO: 131800 - DNA, 1096 bp, Homo sapiens
taactcttacatggttatttgcatgacttaataaacatttcaatgcccccaagttacctagcagaaaaagtccacttttaaagacatctgtaagagagaactttatttttcttaaattggaagcacatcatttagtccttgctaaaatgtagacttgtagtgtactctaagaaacaaaactcatccattcattaatcagacatttgagtgaatatttgatgcccaccactagagaagtaaatactacaaaagcagagtacctctttgctcacagttcattggaggagccagtccacacaagtgcctggagaccttgtacacaggctgcaaaaggtaatgcagcaggtggaggatggtgatttgtaaagcgatttccaaaatagtgcatttgagaaaatagatattcttgctttattataataggcttaatcaaatgtaatgtgtcatcattttttgctttatatattattttattgtcacagttttatctgttaaattttaaaaataatagatgtgaaaacaaaacaaactttacatttgggctgtaaacttagcttaaattcaaaaacaaagtgatgttatttcttataaatgtttaaagttgtttttttttaagctgttttctgaatttttatagcaaggtactgaggggtagggtttttgatttttgttctgtttttgaatattttttaggttattgaaattcgaactatggaagccccttattttctaccagagcatatcttcagagataagtgcatgtatgttaattctttacattttaaggatggggtactgacttgataaacccatcagtaataattataaaggagtaaatattgttacaataattcctggtgctttatactaatcatcattttgtgtctgtcatttaattcatttaattatttcccttgttataaaagggcctgcacattatggatgttgacttatgcacaacatggagtcaatcttgaaaaaattttttaagaataagacttggccaggcgcagtggttcacgcctgtaatcctaacacttcgggacgctgaggcgggtgaatcacctgaggtcaggagttttagaccagcttggcc

SEQ ID NO: 131801 - DNA, 1949 bp, Homo sapiens
taaatggcttttttttaataacatggatccaaaatatatacatttagtacagtaatagttgttcataacagtctgagatgttaatgagtgcttttgcattttcttttaaattttatgctttaaaagattgtgttcctcaggaactccttgaggaaataaaagtgctaagaacaaaagattattagagctttataatttaaaatattaaaaaaacatttaaaatattttactcttataatttgaatttagctctctttccttcaagcaaaaaacctcttaaacccaggcacaagcacaaaggtaaatccagttgtcagtttggcctgccttttcccttacctgtcctctaggaaaatagcttaataaaatgtgccttttagaaaatggggccagtggcctgcatattttctataattagtttaattattattttcctttatcttccttatagccctagtttatttttacccctgttatttctttttaccctgttcctttaactcttaacaatttttaatgaaagctctggtactttcaaaatttttaacaaatggtctgcacttccctgattcctcccatccctaaaaaagatgtattctctcataatgcatctctaccaatgactagaagaattctgaatattttagtgtctacttaattgtataactgcactactagaaatcctactagatttttctgatttgtgaagactgatagtttagaacctatctgtggcattagtatcctaccttaatgcagaaacagaataaacagtgatattttatgggatactgaatctgtaattaaatttccttttgctgtgtaaccatcagatattcatttaaaaaattcaagggatttaagaacaatgtattaaaataaaaagcagaacatatttagtttgttgtgtgtcatgtagtacccatcatcatcacaatagtagctaccatttattatgcactgtgtgctaggcactgtgataagtgcttagtattcattttcttatgtaattctcataatggtttggtgaggaagatagcattatctttgtttacaaatgagtatagtgaggctaaaattgaattaaatgattaggtgacaccactaacagcctctccagttagttgcttaataaattatttgatttcactatttttcagggactcaaatattgttcaggcatccagaaagatccagattgatttttatcatttctttctctaatttctactgagtgcctacaatgtaatatatatcaagcactgttataactttcaaagggtagaaaggtgttaagatgcaattcttatcctcaaggaatacaatctagtgggaaaagcagatgaatgaatgaaacacagtgataactagatctagagaaagaatgatgatctacctaaagtttattgaactattgatgcctggcatcatcataatgtggttgataaatgttagctgattattgtattttacttatctcttatcaacctagaattcgaatgaatagtgtatgtttaggcctgtgccaagtactgctttgtgaggggaaaacagtagtgtcccccatctgaatcgttcagaggtaccagtggcttcagtcaactcatacagttatttaagtattaagcgagcacctccagtgtgccagctgctgtgcaagcaaaagccagaatgaacaagacgggtaggtccctactttcacaaagctcacagtctctcttaaatgtattgttcacttgaaccacaaaacacagcagctgatttggtattattctaggtgcataggaaataagttaatttcattatataatttttctctaagaagataaataaccaggcaattgtaatatgactattcagctattattagggacatttagggtcctccaatagcacatacaaatatttaatccaggtttggctggccagggatatcttccagaggaaaa

SEQ ID NO: 131802 - DNA, 1052 bp, Homo sapiens
cagagaagagacactgtctcaggaagaaaaaaaaaaaagagagagaaagatgaagtgttgccacatgatacagtaactctgctgttacactgattctagacctgagcttccctactgttttgggggaacattataggtgtgtctgggtactgttctccttagctcttcaggtagctggagagggcctggggcagtctgagcctgcaatatgagcaggcccttccatttatctctgtgtaccatgcatgcattataatttaatgtgtgcagtgaggtagaaaaccttgggaactctgcattaagcagtgggctgcatttgtttaacaattataattaggactgaaaatgatctgttttagaaaactctattggtagtatagaagggagaaacatactagaagacccacttgaaagctatactaagagtttaggtaagaaaagatgaagattttgaacgatgacactcttgaaaataaataggacaatgtggagataaagatggcttatttagagatgcggaattggatttagaacatgtcaaatagaattgattaataagaaactggaaatgttgaactcagaaaaggaggtgccggaatcctgctcagtcacacaagtatttatggagtacttactaggtgccagctgcaaccctaatagtacctgggaactctttgagagagttagaagtcctgggatgtgacctgggtgagtacattctttttaggactgggagtagaacagtagccagcttggcatcattgtcaccctttctgaattctcttctgtatcataaaggaaaaattggaactatgttttttcagaatcagagactgacaatgaaaagcactcagaaaaatttgcaagtagaagaggaaaaactattatctttgaaagacagtgtagcattcaaatgggtggagatcagactagaagcttccagagcttcttgagaattaccatctccatgctgcagactgagactatccgatggctagcctaacttttactcactcagctttccaagggttgaatcagcctctaattctata

SEQ ID NO: 131803 - DNA, 1041 bp, Homo sapiens
agctttcactgtttcgtgaaaatattagagatataagggcaatattgtcagttttcatttaggctaaatgtattaagtttagattatgtacttccttcatttgctgttacattgacttgctttttttaattaaactatttggtagtggttgttgatgttgctgtcctaaatgcccctttttgaaaaataaaaatccgataaccttatttcagttcacctcatcaattttactttttaatctgcttcacgaaatgtaaaagtccgagaacacgctgcttttatgtatttagaaggaacaaaaaagacaaactgtctgaattttttgacagtttttgaaatctgaaataagtagagtttataaatgaaaaccaacataacatttctagcaaataatgggaagaaaacaattttattttagatgaagatcgactttctagaagaaaaagcattgtggacaccgtatccattcaggtggatattttatccaacaatgttccttctgatgatgtggtaagttactgaaagtttatggtagagtactgtcttggtagacatcatttaaaagaattttttgccttccacactttcgaacaggaggaaatacaactctaaattatcctcaaatcaactaaattattagtagaaattaatctgatttagctttgaatttatttataatttattttactgaactcatttcagctgtctgtaaagatatataaacctaacattatatgttatgatgtcagatttcacattataatttagtgtaataaaaggaactgtaaagtataagatttttttgctaagaaactttatacaaagcctgtcattaaattagtgggccctctaggtcctacttatttttaaaaatttaggaaatgcaaattacagaaataaatagaactatacatcctcatgtgaagccaaatgctgactacctttgaaaagttttaaaactgcatctataagggaaaatgttttaattattttggatagtaaggatgttgtttaagctgtgtcagtgaactatgtactctg

SEQ ID NO: 131804 - DNA, 1065 bp, Homo sapiens
tttttagtagagacggggtttcaccatgtttgccaggatggtctcgatctcctgacctcatgatccacccgcctccgcctcccaaagtgctgggattacaggcgtgagccactgtgcctggccgacttgggggttcttgatgctaggaagctgcatcataattatctgaattaaggcaaacagggacaaaaagtgaagagttagtagggtaaggtattttagctctttacttacctgagattgacaggtgataagtaaaaattatatgtatcaagaatgctggccttctaacttctcccatgttctttttcctctactgtagttgtgtctcaaaagtcagaagctcctagccagttctaagaacaaaagcaatttctttttttcactgaagtactagaatgcttataagtacaaataattgaccagccagagcctaatcttacatgtctgctccgaatatctagaacaaaacaacagaagattcccaagtttaatctgacttcaactagaactatgaagctcagtagcaaaactgagggagtggaactcttgctgcttgatttccagctaaagcctttgtattgcagagaagctaaggtgcagagaatgacgtcttttgctttcattagtcttgctgccttagacttagcaaaagaagctcatgagctaaaattagggatgaccagattcccaggcaagtactcatgtatcgtttcttaatttttattcagagatactataggaactggatatattatttatcctaagaatgtgctgatgccataaaatgtattactgacttttatcataaagcggttgatttcatacctttttatgtatctcaaagcaagagagacttgaaagacataagttaaaaggatagtttcagagattataaattggtggttaactttagagaaatacttcccaaagtagtggttctaacttttaaatcatttaaaatcttagttttccttttgatttgtaaactgtgtgtggtaccaaaatcatagaggctgtaaagtacttagttgttttttatcacatggctaaaaatgtatttat

SEQ ID NO: 131805 - DNA, 2036 bp, Homo sapiens
aaaagataatatctgtatacatgaaataattttttactaatgaaacaaagctcacaagaatgggtagagtataatcgcatttaaaattgtatatacatattttccaaggaaaatgtctgctttagacttaaaaacagtttgacactactgcagtctgtttcccatgcagccttgtagctggccagtaactacaatggcattgatcactgcaattaaggagtctgactttgatattcgcagatagtagatagaatactcggtgaaatgaacagcttgtaagtacacctgctgacaatgtatttttgttcttttatagtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggcc

SEQ ID NO: 131806 - DNA, 1296 bp, Homo sapiens
gtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaatgaattgcttcttttgagcccaatagttcaaggctgcagtgagctaggatcatgccactatactccagtctgggtgacaaagcatgaccccatctcaaaaacaaaaactgaagagctttagtaaaaatcagtatgccaagtgaattcgttcccatgtacattggaagtatcagaatgataactgctagtcatgacaatgacaagacgtagtaaggtaaagt

SEQ ID NO: 131807 - DNA, 1865 bp, Homo sapiens
gaccatgccacagtattattgtatcactcttctcacacacctaggcactggttgtggatagttgccatggtgacaatcaagataatccagatgacctaaacaaatgtctgtatgcagctgacactgctattctccctcacagtcttgtcaagagccacagtagctatggcagacatttggttgatggtttcatcatttcctaatacgagagtctggcactatgttggagagaggaatcacttcctcagagataggttcctttcaactcacatgtcaacagttactgtacaaaaagctcagaatacagtaatgattagagcttgacccctgactttaggaacttagaaccaaagcccaaagtcccaggccaagggcagacattgtgagcagcagaagggtgttttttatggagagccccataaatggatgggtgtagaccttgaagtctgagatgggaaatataccagaatgctcaatgcatcagacatgaagccccacgggcttccatttgacatgctggcaatctgaaggacaaagggcatgggttatttgggccttttccccactccttcaatatggctgaaagtgccagtggggattacaacctaagaaaccctatgccccttcctgagggcttgattattgaatcctgatcttcctggaatctttcacttgagatgatcacctgcctaacatccaacatgttactatgctcttctttatgtacatgagttactggaaaccaacaataaaggagagtgagtcatactctccacatatgcgccaattaattttttaacttacttattagtattcttgaagaacttactatcttaagtattttaccaatagatgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcccatttaagaaaacaaaaaggaaaagagaaaaatgatcttctggaataactctgctttgatattctccttttgttccccaaaaaatatattccagaaaggcaaaccaaacctgctcaagttgcctatgcacagacaatctcaacaatatggctcacagtgagcaagcagaaattcagggtctggaattgaatgtgagttatgggaagaaacagtgtgtgctttcacaaagatccttttgtcagacaagggaacagcatgataatccaatggaactggttaacatgacccaagatgacatgaccacagatatactagtcgttctgaaacttgcccaagaaattgcaatcgtttcagcagaactccatgaaatattgacaaattaattccatcatcaaactaggagtgatattatcaggtaaaactatgatctcatgtatgtatttggtctttctgggtcacaatgtgacatgaaaaattttaaaggtcatattttagcaagatcaaaatgaattagataaatcaacttcacaaatgttaagcgaaacatgatcctattgagctgagaaagaagtacttgagatcgtttgagttttgactatcaaatgtcagcacaaaagcaaatatcaaaagcttaagaaaaaaattatttcaggaaaagaaaaacacatcaaattgagaaagtgttgttgaat

SEQ ID NO: 131808 - DNA, 1079 bp, Homo sapiens
ccttgttactacacgcaataattttattctatagcctagatgcaaacccgcagagaagcctcattcccaagcagggtgttggcctcagcatccagggtttgcgcaggtgaaggctgaaaacatggagatgcacagtgtgggcagaaaattcaaagtcctctgtcacagactgtctctgctgttgctcctccttgtcctctcagtcacgtctgctcctgccagcttggtccccactgagcttgccacccacacattctgccacctgcctctttcctgcagccagccgagggaagactgcatattgcctttctattccaagcttcaaaacattccccaccattgtgggaagctccccagagctgaggatgaggaagtgagccagtcagagaacaaaagatgcatgagagactcaggccacattggcacagtgagaatgggacagctgagtggaatcctgcaagctcatttagcagtgcagagccccactgggtgaggcacgcagccttgactggggtagagaggcaggcacatatgaaggcagctgcaccaggaagcatgacaatgaaaaaacaaaaagaaggcaactcagtcttcatagaggaaaccaatacatccaaacagatcctggtttcaggatatcccacccaatgccctacttttctcaatgccagatagagagctgaattgcctgcatattcttagtcccagtttcttttctttctctggcctcctaagtagggacttaaatactagggctgttgagcatagtgaattggtatggggtttctttctggagtgatgaaaatgctttgaaaatacatagtggtaatggttgctcaactttgtgaaccactgtattttacactttaaaagagggaattttattttatatgaattatatctcaataataaaagaatgagtaagaggatgaaatgtgattggatggatggatggatgatggttggatgcacagatggatggatggatgtttggatggatggttggatggaagtttggatggactgaggattggatggactaataattaaatggatggataatggatggatggatggat

SEQ ID NO: 131809 - DNA, 1037 bp, Homo sapiens
tgtgattcaccacgagagtagcagatgcttcaagaatgaagaggtgagcagtcccagcagtccttacactatgttcagtgttacagcagggttggattgaagcgctgtgtgctgtggattcagtgtacttggacagaggcatcagcttgcaggaaagctcacaatgcccaatacgttagccctgaagaagtggccctatgctttctttgacatgcctgtaaaaacaaaaaccacatgtgtaagaaaatgtgtttatagtgcagtaggtgatgggggagaatacaagccatatctcatgatgaagaactacacataatctatgcccaatttattcagtgatgtttagatgtttatgactatacatacttcagaactattgaaacacatttattgtaaaatattataaatttgaaactgtagtccagcacttacagactcaaatgcctacagggattagcaagtatttcaaatgaaaggcatgactagggcaagacaataggaagtagtgaggcttgcaggaaactggtggcaaactctagtttctctaaagagagcaactactgcttctgctagctgacgctgagtagggatgataatttatcagatcttatttttcacaagagggagaatctggattttttctgttaactttctccatttctatcataccttgtcaacccaacaaaacacatccataggccaaattttgcccgtgggctgcctgttggccacctttaccttacttattgccctttctactctggcaccgcacctgagaaggcgagaattggggaaatttgatggtggtttgggtaatgagaatggggatgacgcgccttaaaaaaaaagaaaaaagaaaaaagaaatcaatggatggggacagagttggatttcagggggagggggaggtgaagacatggtgccttttaaaggagatatggtgaaagaaagagagagggtcatggtttgggtttgagctagaggcaatcaaatgagtttagggagtgttagagagatggtaagagatcatcatcctc

SEQ ID NO: 131810 - DNA, 1053 bp, Homo sapiens
gcgtgaatccgcccacacaagacaatggagggtgatggcaaaactaccagcatcttcacctagaaggagttccattcaacgccgtcgaaacaacatcagggccctggactgctgccctccactttagcctagtctatactatattctccctccctagtgtctccagaagctttgccagcttcccttcccacaaaacagccgttttgtatttggggcagctctaccatcagcaagtcctctgaggagtgcacactagagggaacagctgtgaggtgagacctcctcttctcccctcccagactctgtcctgcaggttaaacaagtctggtaggagaccctgtggctttggggtaccagtttaccttccagcctgggactcctgggagatttgtccaggcaaacatgaaggagtttgctcagagtttccagagttgaagcattagttgcagctcaaatatagtaagcatctatattccctcattagacttgcagaagagggcaaagaaatggcaaggcaagcttttagctgtgatggagagtggtggagagggttctagtatttccttgttctgacagcatcacctccctatcaccagaggcttttcagaggactgctgagtcatcccgacctttggaaatgctcccgcctccgcctctctaggctccagctcacctcaaagaggctggcattttctcagagtgaagtggcacttgcatgagcagaggcagaagaaatgtagccagagaaaaccagtgtggaaatgccaatctgccttttttggaacctgacagcccaagcagggtacccatatgtggcttaaagttccagacccacttgtagattagctcatatgagccctctgggaagagaagaaagggaaaagtgatggtcatgccctgacatagcatcactgccatcagcatcctcaatcaccatgattgtcaccataccattattatcaccatcatcatcatcgtcatcttgtcaccaccattatgaccattccatcatcaccatcaccatcatgaccttttcatcatcatcaccatcat

SEQ ID NO: 131811 - DNA, 1183 bp, Homo sapiens
taccagactgaaactcaccttctgattgttttgggctcttcctcttaaactctcatcaatttccaggaaagggtcctgattggcagactcagggttacatgtcaatccctggaccaatcactgtgacagagagtgaactattctgattggctcagcttgggtcaggggcctctccctggacagataacggagggacagcttctcttggactggaggactccttcagtcatcagggtggctgtgatggtgctggagtggaggggaggcacagaggccctggacagcatcttagggcatcttaggccctactagatatgtgatccttgctcaccactgattaacaaatagccttgaggtgtttttataccagtaatttatgcacattgagcctacagctctgcattaaggtaaaggaaagcatcctaaatcctgacctcaatctggtctagaggtgctttgtgacattttcataaatagataagctcttagtcaactagcataaagaacaaggaacatttctctctttccctagaggttttttgctgatatgaggactgttatagaactggtcctgttgctgactgctttctggggctatatccttagggcagtcgcagagacaatgccagggtgatgatctaggaaggctgctgggatgttgaacccatgtccctcaaacccatccccagaaccagtggctgtatactgaggactgtaaagagcagaggctaccagggattattgggggtgccccactgactccacaagcccagcagtacaggaaatgagactggccaggaattcagcctccagaggaggagatccaagatctatatggcagaatggctctcagtccagagcaagaccaagctgtcatctcacggaaggtaggaacatcttagaggcaataacttgcccatcagaagtagcattggctcaccatggaagtatggatatggggagtctgagaagcaggtgggaagtgtcctctgagcattgttcaggggagagggtgtgctgaccccagaatacgacctgcctggtcttagtggctctgtatccttgaaatggagatgaaaatgtcaggctggctagaagttcagggccatgaaacactcagataatataactaatgccccctgttttgattcctttcttaccaagccaatttctaattacaggt

SEQ ID NO: 131812 - DNA, 1051 bp, Homo sapiens
tccatccacccatccatccatccaaccagccacccatccattcatcgtccatccatccatccatccatccatccgtccgtccgtccgtccgtccgtccatccatttactaaacccatttgttaaatactgtataaaattgcctactatatgttaggaactgtcctaggtcctgagcctataattgtgagccagacacacctgtatcttgccttctggaatgtacaaaaaagcagcagtgacactccctccagcctaggctctcaccattttatttcctgaaccttgagatgataaacagaagtgacctcccgtggcatgatggggaacattttctcagtgaaaggcagattcaatggaaaaggcttaggcaattccacataatgtgggatcatcagcccagagcagtaagctatttgttatatagatgtattgccaacacttggagccctagattggggtggtctccactccctacccccactgaaagtaattcacagtttaaatgtttcaaattatatcttctccagtgttgcctttcacaatgctaaccacatcctgtgtcctaatttgtattctatctgccctgaaatattttaattcaatttttgccttatgttcgatgtgatgaattagagccagagaatcattgactaagtgtcaaggaagatggattgaggagttgaaactaatggcatttggggacaatattttcctgcaaatatcagggtcacaaatgaagaggtaaattatgctgctgctagccaagaacagaacacaaacttcaatggtacacatgaactttttaaaaaaagacagataattgcatctgagtttagatttgttgagagattgtagttttaaatacagggtcagttagggataaactagaacagcctggcttaaaattcaccagttcctgtcacaaagctgacactcagaaagtatgaaagagagaaagaaagtaagacaagcagaagaagcaggagctgtgggatgcaggagttccaatggaacttggttcataaaaacaagagtgaatgacgtgagcac

SEQ ID NO: 131813 - DNA, 1039 bp, Homo sapiens
ttgtgcctttaatgtaatgtctccttcttttatcctccagcctcctcccctggctaattcttgctcattttttaagatgtgcagctcagatcgaaaaataagaaaaacttccaaagttttttttatgaagcaattataatattgatcccaaaactcaatgaagaggtccccaaaatagaaaattacagtccaatctcacttatgaaattaagcaaacattctaaataaaatattagcaaagagagtccagcaatacattaaaagaatattccatgatcaaatggaatttgttctggtatgtaacattaggagatctataacatttttcacctcagtaaattgatataaagagaacaagcatatgatcatcttgatagatgctgaaaaggcatttggcaaaattcaatatagatttcttgaagattttcttagttaaattataattgatacttaattttacttggtaaaatatatttaccttaattcaaaagccagcatcatgcttactgagaaaacaatggaagaactcagagtaaaaaggaggggaattcaagtaaaaaaggaggttgaaaggtaagagcatctaccatcaacactattatttaaaattgaactagaggtactagccaatgttattatgcaagagaaaggaattggaagcaagaagattaggaaagaagaggtaaaattattgctgttttcagataacataattaatgcctggaaaacttaaatcaagtaaaatgtactactaagagagactcaataagggggcaaggcaaaaaagtcatatatagaaatcgatatacaatttaccatagtaatggtaaaactgtttaccaagtaatagaaaatataaaatacctaaggataaacttaactaaaaatgtgcaagagctatatgaagagaacttaaaaatactctgaaggtaaacaacaagagccctaaataaatgggagagactaacgggctcttcagaagcctcagcaagataaaggtgtcaattctgtctgtatttctctatatagtttatctcaa

SEQ ID NO: 131814 - DNA, 1051 bp, Homo sapiens
gactcctgggcccttgcagttttctccggtgacaagtggcctccttgacaggagggagtttgaggctctggtccatgagagctgcctggggctttcgtcctcccctctggctgccctgtggggtggtctctgatggcacccgggagaacatgcaccctgggggtgggggtagactcagacgctggtacccacctcggggagggtggtggatgctgatctggcaacatgactctccactgagggggttgccgtggcctgcaggggctctggaaaaagtgtgcaggagtgatgagcttatccttgggtggaaccaacctggggagctgggcagggaggactcatcttcagggcagctgtctccttgtagtcgttcggcagagctcactgggcacctgtatctgtcaggtgctaagctttgtccagtgggagagaagagcaaagacctgttaatttctttcaatgcagtcagcaagcaggggcagaattgacattgggtcttgggggctctggactttcactttgttcttacgctggttagctaggtgacctggggcattgacttaatccctctgtgcctcagtttcctctgagtcaaatggagatagtatatgcaagtagttaaatgtaggtaggtgagaattagacaaagaagtacatgtcaagctcttagatcttgtcctggcagagaaaaagcacttgataaacgtcattcccagcatcttattatatgattcttagtatgtcatattaatatctggtagcgttttaaggcccatctcctcatgtaattttcacagtgggtctgcgtgttaggtgttttattattgcccaatgatattaataaatatatggagtcccagagaggttaagtgacttaccccaggtgtaggtctccagggctctctctctggtctccctctctgtgtgttcagaccgcaggtggctgacttttcaatgcccatgtctgacgctggaggccctgagtgctagtatgacttgccttaagaggagccccctggtgaaaaaggcctgcatggggctgggaaagcgc

SEQ ID NO: 131815 - DNA, 1049 bp, Homo sapiens
gttccttgcagttgtaggaccgaggccttgttatcttgctggctgtcatccagggttggctcccagctcctagctgcctagtgccctttgctactatacagcccttgtggttacatggcaacatgctccccaacgttttgactctctgacctcttttatggctcactagatttggtcaggcccacccaggataatctccttgattaactcaaagttgactgggaacttaactacatttgcaaaatccttttggccacataaggtaaaaatagttgctggaatttcatcccatcatattcacaagtcttgctcactttcatgggagggcgctgtacagggtatgcacaccaggggaggagatcttacaagtctgcctagcgtagcagggcccatgtttaattcatccctgtatccccagggcacagcatcaggtagagagtcgaacaccagctggattgaaggtcagggggatgcctagaagaccagagcgtgcacagaagggactccagtacacccagaagctcactccatgtagtagaggcagaagcttcaaactctccacagcagtacttggcaaatagacttaagacattgctggattcttgaaagtatctccatggaatatatgccaaagctttccagggagaattttgggaaaacgattccatgttgtacatatagtccacaatgatttttttaaaaaaacgatgttacccgacatttatattctgcacaatactttttacagtcattggatacgtagcataattaattaggtggtgggtgggtgggtggctgactgaatgagtcagtaataaactagtaataaactagattaatttatgcactcactcatttcctgagctacccacccagcgacttacctttgccagtcagccagcatctacttattgaagcctccaccccatcatgtaatggatgaacgagacagagtccctgccctcttcgttagctcggagttccccaggatgtggtctgggggctgcttgagcatcagtgacctggagagcatgtgaaagatacagtct

SEQ ID NO: 131816 - DNA, 1082 bp, Homo sapiens
ataaatttctgttgtttataagctactcactctctggtactttgttataacagcccaaactgactgagacagtacccatgtattccaacgtgggagtgctgttcgttttatcctttaagagatgacatgttgacatgtttggaagaatgcaggttttccggtaagacagtactgggctcaattacaggacttatcagttgttgttactgatgctgaatatctgtgttgccttggaaagtcacttcgggatttttgagcctcagttttctcatctctaaaatgggctaataatattgaccatcaaagatttgttttgaggtacaacacctagaatagcacctgtatctactggctacatagaaaacagttctcatttttctgatctacagagagcactctctgagggcacaggcagcttcagtggtggagatgggtgtggctgtccattgtcttttctctggcccccatgatggttttcttggaaagcattttaaggctaagaaaggctctgtctggtctcaggaatcaggactcaggcactggatgttttttgtgtgaattttccatcagtgtattaacaatggtaagacagagggagataatgctcttaaaagcagtattaaatgaaaaatgttgcatttattattgcattttactagggtggctctatcttcaatgatgcccgtgacctgcaaatccagaaatccagacaaatggtctaatagttttcaaagtttttacagctgaaaattgagaggatgaaaggtgctgtggttaagccaaggtgagagaacactgttgttcagcagggagcctggcagtggaaggaatttctgccttcttcaaagagtgctgccatgccttagttcccgaagtattaggcttttggactggaaggcattgtattgacctttttagatggatctcttctcagtgatgttgcctcgcttttctcatgcttctcccatgtgctggagatcacttacatctttgtgtatcttatggtaggtgctgtaatgcccattttacagatgagaaaactgaggcttagaaattgacttgctttacgtcacatggctttt

SEQ ID NO: 131817 - DNA, 1054 bp, Homo sapiens
gtggaatgggcgacagaggcagaacagctgtgtgtctgcgcccctcagaggcagcagctgattctgtccctagttcactttgctgtgcttggagaaagccagctatgtggcggggggaggggtgtgggctgccattcggaaccagttcattccagtcagccacagcgatgtgacatggtggggaagaagagtatcaagcttttcatttgagatcattcagctgcaagttatgggagaaacatttaagatagtcctgcagcttttgtttttttttaaatcccagaaataatttttttgacctagttttggttgtgctcaggatgtggttatacttaactaagctgaagtacaatacgctttactcagtgtcctggaaccaccttcagagctgcttgtgtgctggggtctccatactgtatggtggggccatccgggtgaggctccacctgaaagctgagcaggtcgctgtggctcaaaggtcaggagcgtggggctctgggatgggactgcactggttctgccacttacagctgtgtgacctcggctgaattactcacctctctgaactccagtttacccaactgcacagtggggataaatgtgccttcctttgttagtgatttgctcatcggatcttcacaacagccctgtgagatagaagctgttagtgacctcatgctacagacgaagacttggccccatggggaggttaagtaactgttttgtggccatctcttatggccatagagtggccaaaccaggagtctggcttgagtctatgctcttaaccattgccccttcctgccttttcagatgatggatgttcaggagtaagtattgccattttgtggaggaagctcaattctgcccactctggaggtccagaaggaagagaggttgctagaatgtggacccaactcaatgggattgggttaaagtcctggaacaccaatgcctgtttggtgggcaactttattgtcgtttctcagaaatggttccctttggtccttactggcaatagtgacctgtcttggaagctgctgtgtcctccaga

SEQ ID NO: 131818 - DNA, 1070 bp, Homo sapiens
cttggagaaggttctggagcctagtgcaatcaaagatggaagatgaggagctgctcttagacacaaagccaggggattaccaggagattgccattgtccagcgtattcttgggagaagggaaaattggaaggagtgagtgaacccccaggttggcagccagagaaggatatggacgcttgaggaacagcaatgctgagcgactctattgagcccccttttactgacgtcccaaggagacatcagggacaaacatgttggaaggtgttgaggaaggacaaacggaaccaccactgagatgtgttcatttattagcttttgagagtttaaatggaaatatcttcccgtttctgtcctgtagggagaggtacactgcgctgagcaaacactttctgtttccgaaatagactcattgtctgtctgcatggggaggaactcctggtgatgaccggtttcctcactgctgcagaagttcatcttcaggaaaggagtggtttaaaaatggatcagaacttgcacagactcatggtctaggacagtcgggaaggccccgctgatggatccattagctcaacacttgatttcacacaggagaaaatggagcccagtggaaggaaatgacctgctcaacatcatgtagcaggttggtgggacacccagggctggcacagggacctttggctcctgactcagtgacctttctctaccacattattgagacatgacagaaatgcttggtttggtcacttctgaagggcctgcttgtgagaattgcttgggcccttttaaaatttctaatgccccatttttatcttttcttcaccttagagattattatttacttggtcttggatgggaacgaggctagtctttgttaaactaacttcacctgatgcttatacaggaagatctgggtggaaatctaaatctaaagcacacactaaacataatttctgtgaagagacagctcatgaaagaaccaagaggcctctctggttgagatggttttggaatgacagtcagctgctcagggaaagggcaacccctaggcctctctgcccagttcttggcc

SEQ ID NO: 131819 - DNA, 1053 bp, Homo sapiens
tagcattcagagttgtaataaatcctctggaaattacctggagttaactatgagttggttaagtgccagtaattagcattgcctgggaatttttgctgacacatagactcatcctggttgccttgcttggctttaattgtatcccggagctctagaattttggacctggaagaggtcttcccagtctagctctgcttttcagcttaaaggacgaagaacctgaacccagggaaggagggagtttgcttaaggacacacagattcccagcagccaaggagagcagagtccgggtctcccaagctcatgttttcagcccctttgatctgttcatttccaggcagggtgctctcaggtcaagctaatgtgtggcatgatgcagtttgccaagctgttttgcacagtctttccaaaattagttattaattgggtgctaatcttgttggccaccacgaaggcattgtctttagagtagcttaaggttggtggatccaggctgaggcatgttgtggaagccactgcagggccgttagcaataaacatgtaccaggaggtcatctggttctttttctgcttggagaggcaaacagtaacccagcttatcccttctgggctcccatctgataaagacctcagcctttgaatagacacagatgattaaatacagttcagctctgcaaatgcccatggagcacactactctgtgcccagcattgtgcaaggtatcccgggcatatgggcatgtaagatggacttcttgcttggaaaattataaagtgtttaataggcagacagatagggatgtagagaaacagctgagttctagcctcagaaacagagacttgagatgaaaccaagggtttactaaccgtatgacctagcccagttctgtaaccttggtgagtcttgattttctcatctgtgaaatggggtagttgtgagacttgaataggattctgtatgggaaatgcctgacacatagtaagagctcagtaaatgatattaataataatgattttttgtgtgtttttttggggtgggtgggtggggctaat

SEQ ID NO: 131820 - DNA, 1249 bp, Homo sapiens
aatctagctatattacaaataaatgaaacaacctcattgaaggtgatggagggagaaggtgctgacctaagcaactttggcaatgaatggagtttctaagactaaaaacaaaaggcctagtacgtaagtgctgttgtttcccatggggtgtgggtcaatgattctcatactgttatacttgtgtactggagtttaacggttaagcaaaatatggcagtggtgggagctaggtttctcaccactgaagtgagagtttacagaaaagtaaatggagtctagagtatccatgtagtatggatttgagttggaaatatgcatgtaaactcatgtttaacttaatacaaacatagatggttatgaatagaaatatttataaatatgtgtatatgcatgggctatatacacacatatatatccttgcgctgtcagctcattgagcctagaaagtcaaatcctgattgcagtgagcacacctggcatccagaccttggtttctaaaaccattctgcacaaaaaggatacagggatccctgaataaatggctgattctaggatggggcaggaaatatatacaaggtgagccaagggcatcttatagtgccagaaagtaaaaaggtgttttaaaaaatcccatattgatgggagtatgtcaaaggggcacataagccaactgaaagagcaccccctggccaatgtgggacaatttgagacaaaaaataaagtaatactggagtataacaaaagtataaaataaatatccacaagcccatactgatatataacaaataaatgagtgaataaatatgagaagaagagagaaatctcctgtaagaataattccaactaatttatgtagatattctaccctcaaggagagggagcctagtgagggctgcataagtgacttccttccaaagggtatgaaaagggaattaaaaaaaaaaaaaaacaagaaaaagaaaactttataatggaggaacctgtaaaacacgacctcaagccaggtgttatagtttggatatttgtaccctcaaactacatgttgaaatttgatgcccagtgttgaaagtaggggcctaatgggaagtgtttgggtcatggggttagatccctcatgaataattaatcccctccctgtgtgctggggcataagtgagttctcattcttattagttcccgtgagagctggttgttaaaaagagcctgacacctttcctctgccttgcttcctctcttatcctgtgatctc

SEQ ID NO: 131821 - DNA, 1086 bp, Homo sapiens
ctcaaaaaataaaataaataaataaataaataaataaatacataaataaatgtacaattcagtggttttagtatatttacaaggtcctgtaataactcgttgatttttatggtttacacttgctagtgttagtcaagactaaaatggtgctataaaaagctgtcattttgatcctcgatttttctcatctgcaaaagagtagttgtgaaagtttaatgggtaaaagacatggttaagacaatgaaaagacaagccactgacttggagaaatatttgccacacacctatctgataaagagcttgtagcaaacatacaaagaactctcaaaattcaacaataaggaaaacaattcaattaaaaatagacaaaatatttggacagacatctcattaaagaagatatatagatggcagataagcagatgaaatgatgctgaatataatttcgttagggaattgtaaattaaaacaacaatgagatatcactacacacctatttgaatgggggtggctaaaatccaaagcgaggacaatgtcaaatgttgacaaggatgtagggcaacaggaactgtgattcattgctgatgggaatggaaaaatggtacaggcaccctggaaggcagtgggtgccttttcttttcttttcttttttttgagacggagtcctgctcttgtcgcccaggctggagtgcaatggcacaatcttggctcactgcaaccttcacctcctgggttcaagcaattctcctgcctcagcctcctgagtagctaggattacaggtgcccaccaccacgcccggctagtttttgtattttttagtggagacggggtttcaccacgttggccaggccggtctcgaactcctgacctcatgtgatctacccgcctcggcctcccaaagtgctgggattacaggtgtgagccactggttacaaacctaaatatagtgttaccaatagtgtccagcagttgtgctcttatttacccaactcatttgaaatcttatatccacacaaaaaccttcatggaaatgtttctaatagctttactcataattgccaagaacaatgcaaccaagatgaatg

SEQ ID NO: 131822 - DNA, 1050 bp, Homo sapiens
taagactttgtgagaagaaagtcagttacctagctaggaactatatatgcaaatgcatatatatgcaaatatgcaaatgtactaattttatttaatcctcacacagtactattagatggaaattattatctccgttatataaagatatgaaaacctcaagagagaaaatcacttgtccgcgatcacacagctaaggttcctggagctcgcatttgaatgcagtgggttcactctgtttctgagccaagattccagttctgatgctcttccaacaattgtgggaccctgggtattttgctgagcgtcactgggtgcccctttccccattgttaatgcagggccatgagtaattccttggcctccccttgctagctctcagatggcaaattgctagaaatgagagtttagaatcaagttgggggctggtcagaactcaggaagccacagtgttaggaaaattgaggatgaactggggtggtggtgggattgcggattctgataaattgggagctacacaggaaaacctgtgttgaattcccattgagctcctaatattgaagcatacttacttagtacatgcatagtacattctccctgcagcttaggagacagtccagtcaagtgaacataattgaacctttccttgatgattcaggattttgcattgaaatttatgttttcaagcatccattatcttgttctgggctgtggctaatggcacaatgggcccaggaaattgggcttaccataggcctacaatctagtggatgctttttttttttttttaaattaaaatgaaccaggtccatgatgagattattttttttctccttcctaaaggtagaatacaggaaatatggaaatcaatcaaacccttaccttgtttcttttgcctcaaatgctgtattagtctgttttcacagtgctataaagaaatacctgagactgggtaatatataaaggaaagaagtttaattgtttcacagttctgcgtggctggcggaggtgggaaggggtggtctcaggaaacttacaatcatggaagaaggc

SEQ ID NO: 131823 - DNA, 1048 bp, Homo sapiens
ggggacaatggaaccacatggaaagagaagttaattgagtgaatttgggaaaattatttagcatctctctgtgattagcgtccctatttgtataacaaggctgataagacctgtcttataagactggtttaaggatgagatgagacaagtaatctaaagcagctcctgatcaatcacttctcatcatcctgttgaggtctgtgcaagcaacttctcactatctgagcttttcctagtttgtttatttgtttgtttgtttgtttacttgcttattatctgaactcaccaaactagaatataagatatatagagtctattattcaggctatagtataaaaaatgaactcgtctctgtctagaaagcccttcccttcagatattttgtggccaactctttcaccctttacaaaaaagcactaaatacgctgcctagtcattcttcttaaaattgcatcctagaaccccctctataatcgctggcttcccattctgttctatttttctttttcaaacagcacttaaaacctctaacatactctacataagctttagacttatttgtttatcctcttgccctgctagaatgtaaattgcattagggcagggatctttgtttttttcactgatgcatcacaggtgcctgtaaccatacccttttcataatggaacaaatgaatccactgggaaggggtaggacattgagtcagaagggtggcaggagtcctttgtaagccaggataaacagtttggatttttttttttccaaaataagataaacagtgtagacttttatgagaaggtatgacatgaactaaatgacatttttacgtcattctggctgctgtagagagaatggaatagaagaagtcaagattggacaggacatgagttaggagagagggtgatggcttggaccaaggtgatggtcctggagacaaagagaaatttgcagctttcagatgtgtttttacatggaaggaagaactgaccagacatgctgatgggctgaacaagagggtgagtgagaaggaaatcgaggctaactcat

SEQ ID NO: 131824 - DNA, 1169 bp, Homo sapiens
tatgtttgttgttctattttgtctattatgaattgtgacaaaaccattataaaagatgacaagtgtgtgtgtttctttttttctttttaaactgtagggaacatagtcattagtgatctcaaataccgaaagacattttacggatctctcctcgcccctgataacaatcaatttacattcttaattatgagttatgttttgattaggttatctcaaaatgtattcatattcctcacatacccattagtgaaaaagaggccacctcaagtgtgctcggtggccactgtggcccaaaatatagtactttgcatgtgaatgacctagggatacataggtactcctttgcagtttttgttctagcattacaaccacttttattatcaatgtggacactgtctaaattgaaatatagtagaaatactcagttaacaaaagcatgttattattgcttgttgaatgtaaagtataagaaagcagtctcttttgtaatactgtatgttaaattaaaattattgaattatgtgctaccaaggtgggagatcatgggtaatgaaaaatcctaatcccaagaggaattagtggtatcttcactggcagaggagtgtgcctactgtttcctccatctttgtgtgctgtagggccttatctagtgttttgtattatgaggcactcaacaaatatttgttgaaattaaaaattgattttgttctcaagaatttcagtagtcctattccagaacactcagctgtcttaatttttcaaaggcaggaaagcattttcagctctccccgtggagaattttcttgggtatctggaagctcaaatgtaaagcatttttagctattaacaatttttaacagtccatttactcattctttttagatagttttctttgttctttttcttaaatcattatcaagattgcctgcagattgcacagaactttatatagagatgttggtaatactccttcaaatttcttaacaatttggcaagtatttcatattctcatgtattgttttagaaattctgtttaattttaatttgacctgttcccttatactctacttcctatgcattttctgcattggaatctaacttttttctttctcttgaggtagtgaaaagagaatactgaagaataggatctcaagatgagtaaaaagccc

SEQ ID NO: 131825 - DNA, 1047 bp, Homo sapiens
atgcaacagaaaatgccagttgaggcagcacttgtctatcttggttctcatttgaccaagagaagctttttactccaaaggcatactactgaatgtctgtgtgatacaagggtataagaaataatacttgttacttctttgatattactcttaagtgatttatttattttttaagttactgactttgtgacttatttaattcatattaatatattaggcttcccaactgacggtgttgcagttgagctagcttccagttttggagaaacacatagttgattagttctgtcagtaattttcagggatattaatataactttgatattagtgagaaattttctttcagtagtaaaatgttttctaacttaggagctgttaaatttatgatccagtagttcaaaagactacaaaaaagaacttttaaaaccatgcttgaatgtacttttagagtattctgtgtttttagaatacttggaatttcagagaacaaatgaaagttgtatcttcttgccacaaaattcatatgtgcttatttgagcggtgtcatgcaaatgtactcactgatgaagtttagatttaattttaatgaccctggtaataatagttctctttaatggaaataagcattagccaggataatcacatattatcactgaaacttgttatcagttttatttttataagctgatttatataaagattttggcactctgtttcaggtggctccttatttaaaaaaggattaagaatattgtatatatgtattctaggtaatttacaaaaataattttcttatggtaattttgcttattaatgtcagtagtttcaagaactagttaggcttaggtgccccttaaatttagtattaggtggtgtgctcttggaccaactatttaattactaagatgtattgaattttatatgggacacaaaagttctgagattagtgctcttaacattttatttataaataggataataaacttaattcttcatattattccatttgtaaatgaccattttacatttcatggaaattctgtaaat

SEQ ID NO: 131826 - DNA, 1035 bp, Homo sapiens
cagagtttaatagaacagtataaatttgaattggcaaatgctgttttcacacatttgaagttttttgaactgtatggaacatttgcaaatgtgagtttttaagatgttcgtgcagaattttaatagtataggagaattaaggaaatttacattgtagcaagtacaaatacttgttaatttaaataaaattatacattttctgaataaaaagttactttttttctaattagatttaactattcaaaggaaaatgctactagagataagttgtgtcatctatatttagagtaggagaatggtcctaaagtgtaacatgtagatcaaatatagcattgtaggaacaccaggtgaatacttcaaaaatagaggttcttttgctaatattaatatgcatgcagtttttgtcttttcataatttgggattctttcagtttgtctatacatagaaagtaatgattattattttgagtcattacctttgaaaaccaatgccagctgtagacttagaaaaaatatacagttgtatgtatacatcaaaataaatgaattacatactatggtcataagttcatagaaaacgtatacatgacctctaggttaaggacccttcttgcagacaattcatttgaaatctgtaagttttgtttaaaaattctgagataatttacatttagatagtcacaaattttgaatcttaaggtcaaagtgaatcatccagtttaattatcaagcagatttgtaccagtgcacaaacattttacttctttaacttttaaaatttccacaaaagaaagccccgtaaattcctttgaacaatgctaaatataagaaagcttccctctacccctccaaaaatgtgaaaagcatgatttagggacagagaagacttatttatttgaaaacacacctggtttcgggttgttcttgctctagtgttcttcctttttttatgttaattcgttttttatagaactctttctggtttataagctttttctgcttatcctagtttttttgaaaaacaaaagtattgga

SEQ ID NO: 131827 - DNA, 1051 bp, Homo sapiens
atacttttagatgggtaaataacacaaacttgaggcagaggtaagatagacaaaaagtcataggtagttcaaaactgctggctactagaggagaaaatgagaaaaatgtagaaaactgaatataatttggaaaaaatatagaggtttgagctatttggaatataactatattgggcatgaaaccttttggctcccaatatagtgatctctccactataacccattgtcttgcatagatttcctaaagctttgcgcctcagttaactaaatgggctcagtgttcacgggccaccgtagtttctgaccaattgtagttgtgagtatatgtctggcatctagaagggccctgaaagtctggcaagcctatgccactctttttcattggaattagagagcttgagcaaggtaggtaaatttcaagtttatccatcctagagagctttcctcctaaatttacttcataatcaaacctccaagctgatgatttcttagcctccttcatcaatttataatgagggtaaagtccaggaatctcaggcttactgtgctgtgctttatgtgtgtgtgatcgtatagtggcaagggttggaacaagagaaaagaccgttttatttgcttatctgacatttggttgaagtccagccatcacgtatcacacacatccagctccctatttgttacatcattcctgccgaatgttattatgtattatgagatttcacactgtcacatcacattagataatggtttattttttagttgggggttgatgaaagccactagctgggaaacagtttatctgttgtggtagttaactctactaaaaagaatgttttgcaattctagttttgctgagtagacagaaatggcatctgcagatgcttctgtttttaattttggttttaagtgatttcttttaagctgagggagaaaatactagttttaattttaagttttgaatatcagtagtacaatttttaaaagaaattaacggaatattgaaaagacagcttagttctgctgttcttcattaaggtcccagttttttagt

SEQ ID NO: 131828 - DNA, 1029 bp, Homo sapiens
ttgttgaataaatgaaatgaatgaggactgtcaatttctaaatttacatgaattagacatcctattggcttatccatataaacaagaaagtgattatttaaaatacataatttgaataacttattgaggcagtttataaaattatgttgccattttgattgatatggtgcttattcaaataattagttaaatcctaaatcttttcgtgaattctcatggtctttagggcatttggcagcatattctggccctgcttggtggattgcaacctgtcattgaggtagttatcaactctatcttaagtgcaggagattctaggttatatcagttaatttcccttgtcattttctcatggttgactttttttttttatcaatacagatagaaatctgggtatatattttaaattagaagataaatcagaatgaattccttaaatgcaaatgatgtttaattgtattaatgttcctatgttgaatgcaaagaaatttttaaaattaatccatcagattatatttctggcatagctgcatgcccaccattgcttccctcttttatcctaggataatgaagcgctgacagtttgagttaataaatcatcttgtctttcaaaagtttttggttttgtgaatgtggaccactttgaaaatctgattaaacttgggaattctcacctcaaaagaatacccatatacatctacaccaagcacatagcattttgcatgcagcctcagggaattcagtctcctgatctagtgggtgagtccagacctgcccatgtaaagcagttaataatgtgagccagaataagaattcactggtaataattcccattttagatttctgtaaaatatgtaaaaataaattttaagcaaaacatatttatgttttgataacacttaagagttgatacaacagggaactgataatgtatgtttactgtatagctaacctctttggtcagtttctgttcttatgagattatggtgttagtccagaatctgtagatactgccactctctgaagagt

SEQ ID NO: 131829 - DNA, 1275 bp, Homo sapiens
taatatttaaagggtaagagagctctatgtagaattttggcactgagaaatcctacttttagtgaagttgccttctctccatctctttctgttgaacccttgagagatgtcagctatggttattttcttttctctttatctctaatcattgttatcggcatcttatctctgactcttcaaaatctgaaacttcagtcttccacttcttgaatatttttccaaattactcataaatgtctgggattgtgcctaatcactattctttaatttaacagcttcctatgattcaacctttaaaaaatgacaaaacaacaacattaacactacagcttccaaattcaatcagaaaaatcttatgtttaattcacagtcaattagaataaaacataaatagtgcatcaaaatcatattgttgtagttcagtatacagaggcatttgtgaatacatttgtgttcagcagcgttttttcttcactgtatgtatcaaaacattactatgagccatctgctagaaataacttcactgtgcaaagctatatgttaaattaccatttaatgcatttcacgggtattgcaaagatctcgatattacgatttttttcctctcgcagtgtaactggtaaccaaattaagtaccaactttaagtcactccctgttttctgtagaataaaggattgtttcattagtttgctatttcaaagcccttcaagtttcaaccaggctaacaagtcccatctgatgtcttactagtctcctttacctgctttactacttaccatgtagtctagccaaaaggactgttactctttcctttaagtgctcctccaatctctgaacatgaggtctttgaggacaaataaccatatcctacttatcttgaaatcctccatggctgcttgcctaactcagagtcatgtgatggttttaagtaagtgaacattgagtaaatgagttatgctctgtgtatacactttgtgctgattaggtctatattctatatgtcccctagcaagtctaacttaagtaacatctcccgagaaccttcagtaaattcccagattttctatggactattaaagcatcttatatacagtttttgtatacacttaccagttttactatgtatgaaataatcacttagatgggccttatcccatttctccttttggcatagattacagacttttgtgccacttagtcttggtttttaatactggctgcaccatgtgtattcttagacaggtcttcatctgttaaatgtacactatgttttc

SEQ ID NO: 131830 - DNA, 1082 bp, Homo sapiens
cccagtgcaatggtgcgatctcggctcactgcaacctctgcctcccgggttcaagcgattctcctgcctcagcctcccgagtagccgggattacaggcatgtgccaccatggccggcaaattttgttattttactagagaccgggtttctccatgttggtcatgctggtctcaaactcccgacctcaggtgatccacccacctcggcctcccaaagtgctgggattacaggcatgagccaccgtggctggccgagttgtttcgtttcctttttatgtaccaatagtgcctagcaagtgccttagtcttcttggatgttcaaataaatgtttaatgaatgaacagaaatttggacatttttgataatggtaatatttttaacacctttaagattcaaaatttgattagtgaacatgataaaaattaaaatagagaagaatcttgggtatctgtgttacttaattcttggccttcatcccaactgtacataccaatttctagatatttatgtagagagtacagcatgctatgacttaccctaaagaggatccccaaaacataattttcattttggttgatgcgtcaggcatctcagccagaataatttaaaatattttagaaaaaccgtaagtcgctttaaaatgcaatccagatttaaattatttgaactcacttagatactgattctttactgaattaagtcatgttgtgaaaataaagatgtgtttaactctgttactgtggactattctcactttgagaaatgtttcaaatatatagagttgtatagatttagaatatgagggaacctaaagaataaactccttatttttttattcaaaatgtaaatgataggacaaattaagcacatgaaattagaggctttatgttttgagggaaacttaccaatttttacaattgatagaatatctttttatagtacttcagtggctagcgaatgttgaaaaataaggaacaaccttgttctaggtttttcttaatactattgacaatttttatgttttaaaaaccagggcaacaaaaacaaaaccagagcaacactgcaaaagacaagtattacag

SEQ ID NO: 131831 - DNA, 1406 bp, Homo sapiens
gtaaattctttgtaaacaccacattcagtgactacataatatttcattcagtggatatatcattgtttgtgtagctgtagacagtcttcagtttttccaaccatatatttagatggtttccactttatttgttattataaataatgttttctgtatataattccagaattggaattgttgggtcagaaagtaggaatatgtttaaggttcttgatgtatgttaccacattacttcacaaaacagtgcagtcatttatatttctactgggagtgtatcaaggagtttattcagatcttgaggacgatcatttataaagacaataaagcagagttttttggttagttttaaaatatggacgtatttattgttttcttcatggttttaatggtaagcaacattcagctaaatctatgtataatgctttgtataaacaaatataaggattttctctttatatgaagcattttgatttttgaggtatccatcacgaattgaaaaaattgactatgaggagggcaagatgttggtccattttgagcgctggagtcatcgttatgatgagtggatttactgggatagcaatagattgcgaccccttgagagaccagcactaagaaaagaagggctaaaagatgaggaagatttctttgtaagtagcaagttttttctgtttgctagttttgccagctatgtaatgacatattttaaaaggattctgttaaattatacaaaagcctgtttttgttaagaaatgcttatttaatatacatggaattgatcttaaaagttgtttaaaataggattttaaagctggagaagaagttctggctcgttggacagactgtcgctattaccctgccaagattgaagcaattaacaaagaaggtatgtgtttgaaatgatctgagacttaaaattagattaatagtaaaatttcactgtattttaaattttaattagtgtgtgttatgtaatcattacgtataacttttatattttctgtaagtattctttttcgggagcatttgatttgttatgtgttatcgagaataaaatgctatatggtttgctacctaagtagtgtttaaattagtagacaaaaatagttggttaaaatttttcaactttcaattcacaggcttatatcatatacattttatttctacttctctgtttctagtttgtggctaacttatatttatgaacatctacccaagagtgtgaggaaaggttaaagatttaggggaattcaaatcagttcaattcacaagtgaaatacataggatattttctgaggaaagagtatggaatttttaccagttcgaggatttcccttattgtgtctctccctgctgtcctgtcattaatttctacagataattgagttaattttctagtatctttt

SEQ ID NO: 131832 - DNA, 1050 bp, Homo sapiens
tgttattactaaagaaacaaacattgagtgacagcttcttggcaagaagggcatttaatctaagtaaggggacatttcctttaaactgagtcttgaaagacaactaagttagctaaagtagtgatcaaagtgcttttctggtagaagaaatatgtggaaaataacaagtgggagaggcatgccatgtcattttaaggaactgcaggttgcttagaatgaaagattcgtttataggtgatagaatagctagagtacaggttggagagaaaggcaaagattggtatatgaagtgtcatgtaatcttgctaaagaattagaattttatatggaggtgatgggagccatggaagagtttttaggctgaggatttaatctaacaacaaacttgagagaaaataggaggtaagagaagatagaagaggaaaacagagatatattaaggaattttaggtgtgaaaaaataaatcatagtagtctagctagaaatcatgatataactttataaagaccttaatccaatgtattgtcttaatgaattgaaatcatgaatatggctatggttttcttaccactggttacccctacagaaagagttgagagacatctcagttgttaggtgtgcaggctgtttcttcttttctagtgggccctgtatttccctgtacacttacacttctgtggagctgtgttatggagcttacattcccaagtcttattcacattggcttccgagtgtctagtccagagcctagcacatagtagacagtcagtaacaatttgtggaagtaaaggaagaagtaaaatctcttctgttgggtaataagatgtacccaaaacaaagtgaaattaaacagtcattgccctctacattaattcataacagtttcttttaagagctttggggccttcgttacatgcttaaagttccctgtgtgtgtgcagatgcaggtacacacatagcgcacacactcagaacaaaaccaccctcattctttattctatccctttcatctacaggcatttaatacagaaaattcagcttaccttagt

SEQ ID NO: 131833 - DNA, 1045 bp, Homo sapiens
ttgcttctttggtttagacctgctaaagttataggtcactagtttctgttccaggtgaaatcccagcatccactaagctggtgttgtcctatcgacccagctggatcgtgtaaccagtctatgggaagtgaggtaagagccttttttttaaaaattttgttttgtttttcctggtatataatgtcatttagaaagttaaaaatttttaatataaaaatttacattgagttcttatcttcttctttccttctacaaatcatagtcattcatcttcctttaaaaggcgcttacctgacactctgtaggctgtttcagatagggctctctgagtcatgtgatggaagcagtgtattgtatgctttgtcactgctcaaagcaagaatggatggtaagcattggaaggagaatcttgggtggaggtaaaaaccacaattccatttgttggctatgttttctgaaatactggaaagaaaggtgccattagaaatttaaaatattttcttttctattctgctgttatttgggattttcagcacctggacctacaattaattttaagaaattgaaagtagtgtgtaaaaatgtctaatatggaaatatgctacgtatttgttccataccatgcggtgaaaactgtcattctgaaatgtattgaaattacctggtcagcttcagtcaagtgtaaacatttagtgctctagaaatgtatatctaccacattaaaaaaattattcatgaagaaataagtgtgattgttttaaattgcctggttttcaaaaatttagttatgaaatgattagcaagcagatttcttctaattaatatgtaaatgcaatttaaaatgaaaatgcttttgatcaggaagtggctttgtgtcttcccacatgtatgtataaataaagtgttcttttaagcattcagtggtgtgatttcttggttactacatagattgattaaaaggttgggaacattgtatatacctgcttaagcaaaagtctcaatttttttttttttttttgctttaaaacaattattttgttattct

SEQ ID NO: 131834 - DNA, 2175 bp, Homo sapiens
atttgagccctaaaatactaaggtagaatgtcatgtagtattccatatctgccataggtttcctctgctattttagattttattcctgtgaaaatatatccatggaatacctgttattgaatatgcttcctattttatgagaggttatgcaatctaactcatttgattattaaatttgataacctaccatgttcagctatcatgtaaatattgttatctctatatttatgtttatgtagttacctgtgaaagtagctttgaaaatgtgacacatatttttattagtgtaattacattttaattaatttttaatacttcacatgttttgtgtttttcctttggaggattggatagctttagtcaaagcagctgctgcagctgcagccaagaacaaaacagggagtaaacctcgaaccagcgctaacagcaataaagataaggataaagatgagagaaagtggtttaaagtaccttcaaagaaggaggaaacttcaacttgtatagccacaccagacgtagagaagaaggaagatctgcctacatctagtgaaacatttggtacaaaatacattcttacgttaattccttatgacactggtaaactcatgtagtaaagtcaaatcccttggcttcctttgattttgaatgtataattaaatttgtaggcttttgaccctagcataatatgatggctaacttttttagcatcttacagttagacctgaaacttaatagtctagtgtgggttacttgatattggatgccctcagtattcttgaatagaaataggttgagattttgatttataacttcttgatagcaggtttttgtttgagattttttcttttgttttgtgttttttcttcaaccttttaaatgcttctgtgtatgcttcaatatataatatggaaaaagcagtaagttattttcttcctgcttttctttaagaataactgctttagtagtcttttatttctaatatattagtctggagggatttgtgtttttcaaaggtctgtatcaagtagtagattaaaaaaactaatgtgcaaagcatttttactattttgctgttaaaaaatcatgtgttttaatttggattctagataaactctcatatatgtgttctgttgaaagtaggacttcatgtagagaacgttccaaagatggtctttccacagccagagagcacattatcaaacaagaggaaaaataatcaaggcaactcgtttcaggcaaagagagctcgacttaacaagattactggtaaactacaatgattttttttttgagggggggaaatggaaggtttaattttagagtaatttatttttaatgaagtaaaatggttttgatttagtgtcatggacctgttaataacaaagacaattactttgtggttcttcaaggtcaatgtctttcaacaccgtcagctttttctgttgtaaaatgtgaaaaataccacatatcttctacctacctcacagggatgttgtgagggttgataaggacaaatgctacaaagctcagtgatttttaaattacatttgtggtagtagtagtttctagaagaattattttgtcaacttacggtgacacagtttctcagattttaaatttttttatacattcttctacttgaccagtcttacttaaggatggtgccatatatattggaaagatgactgtctgacttacatttacttcctgaatctgttaatttctgaatttctgatgtgaaagtatttctataagttttttttgttttttaatttttactcttcaggttggtcacaagaatctgggcttatttatttccatatgatttcttatagtttagtttaggaaatagcagtgttaggctgttagaaaacactgaaaattctagcctggttcgtgttcatggaagaggggattgaaggattagaattggggccagtcatactacatcctgccatttccacagtctattcagcctagtgattctagtcttcaaaagaaattgtgaacatatttaccttttctgagtatatgttgaaaggggagtttaaatactttcatgatttagtcatatgttcttattaaaaggacagaatctttttttagtgcctttggcctaataaagctgtaaaaacctttgtttgttggcttcaacttgaagaagcttgatttcat

SEQ ID NO: 131835 - DNA, 1900 bp, Homo sapiens
agaccaagaatgtaaccactttgctctttctttgttcccctttcccattccagggagctctgggctctgttctacttattcgtattggcaggaagagaccagctgtgtattttatagctaatatagaatactggaaggttgtaactttattggtgggtggaactgatgactatttgatattcttcttttacctaagtttaaataatttcttgaagcagtgtaatgcattcttattgggcaattttatcccataggggtattcttctagaagagggcctgttagtaatacataggtaattaataggtacttgcttataatttcctttcagttaattcttctcattttctatggatagtgcattttttcctggaatattagcaggtcaagataacagattttggactgcctcttaaggcagaagtagtcagagttatttcttcaagtacctattttgttatttgttccattttattgtttatatttaataacttttgtaagttgatgtgaatgtaaagcatgaaaaaactttattaatcatatttgggcttttaaattctctagataaccaagtatgcattttaaaatctaattttaagtagtttttcttaagtctcattactttttatgaacacattgcaatgctttatttttccttctcaaaccattaatggaaagggattttaataaactgggtctgtaatatcctaatgtaaatccatatgttatgggtgaattattttgtttcttttactacttgtggtaccttattttcagctttttagtttgtgatctatttcatctattgagtattaaaaagtatttctaccacctgtgtgaaaggaaacaaagtaaaagatataattatataatatattgaatagcaagatttgtcctgtttgaatagtccttagaaatataactctactcagtttcctgcaaaagaagaacttgattttctaattatttttatttcaatagttcattgggccttaagaatgttagctggagaataaaaacctaatgaatgtagctttaaatgttaaatattcagtactgtatctttttcagtaatgtaaaaatatgttcagaatataattaggattgaagctgtttttgtaaaattgtttatatacagttgatgtggtatgagactgtaacaaactatttagttttttggtttttgcttttttttttttttttaaatctcaaactgggacaaacaccagggttttgttgttgttttttacttattttttaatatagagatggggtcttgctatattgcccaagctggtctcaaactcctgggctcaagcaactcacccagctcggcctcccaaagtgttacaagcatgagccaccgtgcctaaccttaaataccagttttaatactaatcataaatgtatcaaaatcattgtcttacactcggccttttttattttaaagtacattctgagtactaggtaccttttgcttaatttagaatttgtttgagtactactttaagaagataatttttttaatttatttatctatttagttatttatttagagatggaatctcactctgttccccaggatggagtgcagcggtgccatctcggctcactgcaacctttgcctcccaggttcaagcgattctcgtgcctcagcctcccaagtaactgggattacaggtgtgtacgtccacacccagctaatttttgtatttttagtagagatggtgtttcaccgtgttggccaggctggtctcgaactcctgacctcaggtgattctcccatctcagcctcccaaagtgctgggattacaggcatgagccactgtgctgggcccaagaatataattttaatatgtgaattcctacctagatcacttaacttctttagggtagctgtct

SEQ ID NO: 131836 - DNA, 1062 bp, Homo sapiens
ctaaatgaacttaagaattggtagcttttttagttactaaaacaacagaaaatctttttttatgttctggatgtttggaaggatttcttctgtcttattctgtttttatagctgtatagacaaaacctgtattataagtattagcaacctgagcaaccttaatgtagacattaagacagaattttaactttttacagaataaatgtgtgtgtgcaagtgtgtgttttcagtgatttaattgagtaatattaaacaacagacacacaactgtataagcaactctcaagttctgattcagtcccttggcttattattaagcatatttgtatttttgaaaagaaaacatttgagattacttcctacgtattaaaaagtataggaaatttcaactgctaagatttttgcaaagttaattagggtgtaaatcagtattttttctaataagcaatttctgtacaatttttctcaaggtttgttggcatccaaagctgttggggttgatggtgctgaaaaaaaggaagactacaatgaaacagctccaatgctggagcaggtatgaaatggtagcatttgatttttttcaaggttcccactggaatgatcacggagctctagtatctacgtaattgaaattccccttttgatcagatatgggaataggaagctaattaattgatgatatatttttaactctgccttctccaaggtatacagataactacagacttcattagtgtttgatttcatagactggcattaaagcctttgtctccaaaatttgaaggcctggagacaggcatcccagggtataagcttccagctggatcacctttaactagcttacaaaaagacccttacacaaatactttccatttgtgagttaaaacagggttttttgacatcgaataaagcttcttttgtaagaagtttcttttatattgtaacaattggtgttgttagactgactatgtgttttatgaattgatcaatgagccatacatttttgctaggatgtatattttaataactacaaaaaaagagagtttaaaaaactattaaggg

SEQ ID NO: 131837 - DNA, 1013 bp, Homo sapiens
taaagctcttaattacatctcaattggtatcagcaatagacctaaaggagaggtattgattgttactaacctctgtttcctaatgagttaaagtaatgtcactcatgacatagattgataacaggcctgtagtcaaaacttactgtgctaatggacttatttatattttttaaaaattcaaactgtggtcttgaaccccaattctcagcttattaattatagattatttaattgtattagggatatgtcatgttatatttacttttggataaaacttgcattagatgcataataactcagtaagttttaaaaacaatgttaatttttccttgtttagaagttaagcaccttatcaagatattaagttttaaaatcttgttttataactttgtaacttgagagtaatggatgctgtagtgatgtctttcacatatgtgaagatgaacaataaaattgtttatttacaagtaatggctctaattacttttctggcaacaccttttataataaggttaggaatactatccatttatgaagtaccttttcaaataattaatctgcacttatacacatttataatgagtaaattcaataatagaaatgatgacaactgaatgaatgggacacttgacaccaggccttttatgtggtatgtccaacatgctgtctatagagcattgaaggtgccctacttaataccaaatatgcacttttcttccccagcaaaatttgacttgtatctcagtgggaacagaattatttatttatttagtccccagaaaatgatcgttcatattccagagaactgcagacagcagacctgatagttattctccacaagatatggaagtaaaaagatttcttggggacaagcatgttgtttatagtgctagcagtctgattctttataaaggcctatggtagaatagattttcaaaaaatgcatattatatattttgctctcagataagtatatcagaaagagatagaagtattgcagaaccatagattgc

SEQ ID NO: 131838 - DNA, 2447 bp, Homo sapiens
gcatttggatgtgtattttaccaagctgatattttaaatctaataatatctattcatgtttcccttatgtgggtgcattgttttatttagaagtttttaagaattataacctgatctagaatacacataaaataaaaaggccaatactagttacaaatgcacttctggtaaattactgttggaactagatgtttgaaggaagtctgaatttagtttgttgtgagttggagaaaaacataaggcagtttgttgattcgttaccaagggtgttggtgatcattgtgtttacaggcgtcttccctgaaaccattttatccattttttggatgaagcataaaatgaaacttattcttttctggtgatggcatgtattgaaataaaatgattgaagtaacataagagacatatacttatttttattaatttttatctttatataaaggttgaagttactttgtacatgataattctttatcatgtttaaaaaaataaaacaatacccaaatgtgaatatttgtagattttgaaacatttcctgtagtttctcaaatcagatctattgtcttttgactcttggtctttccttaagataattaatttttcttttccacttttccacaagatttccaaattgtcattgacccattgagatacttttttgataaaggtcttattcggttctttaacgatctggaatttgttaccgtactgaatatatgaaaaatatgttaaagttataaggttgtatatacattgggaaaattattttcaaatgtacatgtgaaaatatttacatttttctttaaaagtattctaatatttgtaacaatattgaaatataggccaatataagtaactgtgtaataactaagagtcttacattaacagattatatatcataaaatatcaatgtagtgattgtgcatggaagtccttgacttcgatgattttgcttctaaccagattattaacttcctcttttcagaatttctagcatatttgtggcaatgtggctgactaccttagaggaaggcacacgaatattctttccctttttaaatattagcagtaactattggaaaagtaaaataagtaagatcgttttctgggaaagtaaaaggtagagaggagtttagctataatttgaatttgtggaagagtaaggattatctggatatgatgagcttaatagtacagtagctgtcaactttaattgattatagcaaggaaatgcatagttttaattgttaattactgaagatttattagagggttgaacacagtatttgaatagagggaggtgaaattctcatttgtttctgtgacctcttaatttttagtttttgaggaaagtagtgcaatttaggtcatgttctgactgaacaccttttgattacaaccttgtgtgcctgtcccacgtgcattgaaattctcggtggtctctatgcttttctccttaacctttttgttattcaccctctcttgactattttgcagtatttgttatgcttctgtctgttccccaagtccttttacatctagagccaaagtgccaggtttttatgtttttatttctctgatacatatgtacatatatgcacatactcatacacacatgtatgttttgttggtgtccatattataaaagtaaattttcttactgttgaattttaaaactgataattgaaaacattctttacagttcgtcagagacattttctgagttatttttgtcaaattgaaactcttggggagtttagaatgatgagggtgttagttgctaactgtgaaattgttcaacatggttaggtttttacttttgggggagcaagataaattcacactgttgagtttagcatttgatgctgaaggattgatgagatttgcagatagtccaattattatatacaacttttcttaattgttttccaatagagataatgaacttgcaataatctctcgtatgttcttctgctggggtggatgcccacatgtctagccactgttaagaatgctattgctgcctacattaccaaacaagtaattggtatctttgtaaaaattgatgcctttgtttttattttactatcaggatgctttgtcacagagccagccaattttagataaggatacagcctcagaaaatcttaattctgttagtatctgggaggatagagtaaatcaagttttttgaaaaggggtcttttgaaaaatactcttggttcaggttctcacaggcaccttgggccaacagttatctattgccccttgtcaacacaattctctttaggtgggaagcacagtgtgaacagatgtggaatctgccttctggaaacttagagtctagaagggacacaaagctaataactgaaatacaaatatttaaagcaagattaagtgcctgaataggtgtaaagtactcttgggtgtaaaggaacaaaagattg

SEQ ID NO: 131839 - DNA, 1253 bp, Homo sapiens
aggcatttgatagagtctatgtttattccaaaaaaagattatgatgtaggattatttttgcttaaaaacgtcaattaagatagccttagagatgataacttattgtttgtaaccactgtgaagacaaaattggcattagtaggttgtatgcatataattttgagccattttaaaaagttattcttgtattaaaagaaatacctttagtaacccatcttcattttttttttattttttagcaaattagtaaataagtttcaaggagcattttcctgttttattgcagcatgtcttagttagcatggataggaatgttggcttgacgtggccatgcagagtgtacctttatgtaacgtcaggatgtccatgagcaggtcccctgagttttcgggtagcattcgatgaaatgcatcaggctttgcttcagtgtcattcaaagtcatcttagtttttgaatgaaatgtagatgcaagtaaatgtatttacttattacatagatacttacatagatactatgatactatcatagatgagatagttggactcttcttagtgaatattctgtagagtgttcatgaattatattatcgattggttaatataatccattttatcaccagtgaaaaacagaagtaggtcatggggttggtctaagtatggcaaaaaagcatcttgtcagttctacctcatctgcctgtggtgggttttgaaatggccttcatttttattccaacatctcacatcaactttacatttactatttaaaagtctttttgttttaaattgtttttcagtttattttccagattcgttcaaaacaaaactacagctggagactctgttgcctccaccctcataccaaatgttcatggcttctacagagcctggggtttctatggagagtctcagggattgcctctctttttagtcagaagaatctgtaatgtttagcataccagaagaggcttgagaaatcactctacattactagttttttgagttgtgtgcaggcaggcatggttcagagatctgcctctctgactctaactagagtagctccatttgtgttttggtttttgttgttgcgttttgtattcagctgccagataatttttttttaatgttctgttgctaaaatttagtttaaaaattactattctacaaactaatgttctggtactttggtcaccaaattctagcacgtggtaaaataaggacgagatcgtgaacttcttgtaaaactaaacttattt

SEQ ID NO: 131840 - DNA, 1468 bp, Homo sapiens
atgactgcatctcttctgctgtgttaacttccgtgtttctggtgcagtcgttcataactgttttatttgtcttccaagtacctaaggggtgcacacattccattcagtaaaagtagcctagtaaggcagttcctttaatctgactccctgtccccactccaggagattctaaacatcattgttccaccttttccctagagatccagtgctccagagatgtaagaacctaagaggcaatgatcactgttagcaatatatctgaatgtatctgtactaccactgaggatttggaaagcacatgcctcatggtttgcattgtaaatgctttattgttttcaaggaaattgcatcaaatttataaagttctaatagtgcagcaagtagtaaacagaagggatgcatttcttcaacagtcttgctaataagaaaatttaattgtatttctctttgctgtgatatccctttcattttttctgtcataacaaatggagattattggtattcttatttaggtttaaacttacttgctagagccttattggcacttgatttgagtggtatttttatatttttattatatttaaatgatagaaaatatttgaagtaagatgaatgaaatttcagattttttgatactgttgtagaatgatcttaaaaaattaaactggtaaatggtgacattaaagcataatttaatagactaaaattgtattttaaatgtactgtagtatttttcttagatgaacactagccacaaatagatattagcattgggaatggttgaatatgaattgattaaatgtacctgtgtcagctgcacagtaattaaaggtgcaatattggtttaaaaatgaattttggactattaataatacctatgttttattggaatatttattgagattgaatattttaatgtataagtatgtctttgtattttacatttatatatagaacaaaagtggtttgcagaacagttttattttggctattatcattacctaacagtgcattcatgatggagttcaaaggtacaagtttgttttaggcacaagagcttaaatgttagttttaaaaatgtgtacagattgttgaaaaccagtatgctttaatatggagtttaatatttcatttggataatccagatagcattcatgtcataactgtcacagaagtagaaatggtacctggaactactactcagatgaatttcagtatcttttggattgccgaaggctgtggtgctagagtagacctttactgatggcctagtacagttaactttttctttatggttagacccatatttatgctatttctggaaatagtgtagtgtcaaattattaccctaccacaaaggagaaaatgaaaaaaattacgtatttaccagtctttggactagacatcttccacattttgactcacataatccttataactgcatgaggtatacagacttattcctgtt

SEQ ID NO: 131841 - DNA, 2069 bp, Homo sapiens
taagtggtggaaccagatgttgaacctgagtagtttgaataacaaaaatcacatttaatttattgttttggttgttttttaaggtaagaaatctcaccgctttgttaccagttcaggcagtaaaacatgtagaccgttaggagaaaaagagtcttacatagagttttatgagcaattgtaatgtaaaatattgtcccatacttttaagtttttctgattaaacttacatatttttcccctaacccacaggaatatcgaaaacagaaaaaaaagtgaaattggaagacaaaagctcaacagcatttggtatgaacagaaagtaatctttaagcaaaagactataaagcttgacagagagggaggacatagtctgccccttactctttaccagttaatgctaccttaggtgtaagtgatcatctgttttagttcctactagtgttagtcagctccagatacatgatttattaaacacatatcttgttttatatgtaacttttttgtcaagagagtctcttgctttctccaaaggaacttttgtgtttatgatcatccctagtcaaaattatggctattcaaaaatagacctcgatttaatattgttgagactttagagaatggatgctagattaaaatagtaattttttcacactttcttcttcattatagtttataaaaatgttattgagttttctgctatactattttctgtgctgtaatgactaaaagtcacaaaataatggatgatagtcttaaatatactgtagattagttaactggagcttgaatcactgaaagttggtcaaatatgttggataaattataggctaaaccattgtgagttggagcaatagctagtaggatatgtgtgatgatttaatttgaaatgtaggatactgctctaatatttatttttttaagtacatatgattggggaaaagaatgctttacaattttggaaaaattagtttaatgaaatatatttttttttcctcgtgttcttagccttcattgttaaacacacaaagaatgtaaataaagactggaggagttgtttatgaattgatttaattatttttaaagcttatccaaagcaaaaagtccatcaggttttttttttttaaatctcctaatttattctctcattaaattacatatggaaatgctgagtctcttcattcaggtcctttgtaaattatggagtttaacttcttaccacatcaggaaattgagaatattactcattgaaggttttaactactgtctgtgttaactttaaggtatcaggagttgggatttctcagcactgctaatgaagatcccctcttatagtccaataagcttatcaggacttccagagtcatgacatgaacagtttaattgaacccatccactctgggcaggtgactggaatagctgattaaaacataaatgctgcttttaggttaaccacaaaggaacaactcaggatcagtcgtgattgctaaagtattcacttttatcttttaggtaagagaaaagaaaaagataaggaaagaagagagaagagagacaaagatcactacagaccaaaacagaagaagaagaaaaaaaagaaaaagaaatctaagcaacatggtaagtacactgagatgattattccctctttttttaaaatttgaagtttcctttgattccccttttcttttacaaaatggagtcatgacacgatccccgtgtcccgtgttgagaactgaaaggtttctgtagctttcctttgacatgaaatttcaaaaatatactactctgtttcactctggcctataattgttgcactctggcctttaattgttgcaactgattagacatttttccttccagcattatggtagactcgatgccctgaccaagcaccctttagcatgctcaagtaattattctcagtctagaattgtagagttccttaagttagctttcaagaatgagagtgaaatagatatttttagaagaatttgagaaaccaacagaatttggtatcagcaaaggccatgtgaagatggagcagaaatcagagggatgcagccccaagc

SEQ ID NO: 131842 - DNA, 1009 bp, Homo sapiens
caggtaaatgtgtgccatggtggtttgctgcacagatcaacccatcacctaggtgttaagcccagcacgcattagctgttcttgctgatgctctcccccacttcccacaggccccagtgtgtgttgttcttccccatgtgtccatgtgttgtcatcttgcatattttactgcagacatagttgtgattataatggagagaaaatgtgaaataatcctttttcacctctatagtacttcacaaaagtttacaggtaccagttagaacctggtgccccctactatgtatatattgtctggggtatatttgtttcccaagtgttcttgctaaacccagttcatcagatccatatgtagcttttcatggatgagaagcgaaagtggtagcatgattatttggtgtatcctgaaacatgactttcgttatttttatagtgaccttaattatctgacactttattaatatttctttctgtatcttatgttgcagactattcagactatgaagacagttccctcgaatttttggaaaggtgctcttctccactaactcgatcttctgggagttctctggcttcacgaagcatgtttacggagaaaactacaacctatcagtacccaagggcaattctatccgttgatcttagtggtgaaagtatgtgtaaccatgtgatggttaaaacaagacttacaattcctaaatgtgtaactgagaataaaacgtactctgttaagagcatgcgatttaaaaacttgttagctaaactaatatgaaagtcttgatgtgagaaatttgagctactttttaatttatataaagttaaattggctttatacttattggtggaagagagtcataaggaaaatattactagtgtatatacttctgtaggtttttgcacatatatttttatattcttcactatcaactgacagagtaggtattattcacatttgatatataaacaagccgaaacttacagggtaagtagcttttcggcttagctagtg

SEQ ID NO: 131843 - DNA, 1094 bp, Homo sapiens
tttttttttttaagtgatttttcaaaaagcactttattaatccaaaaaagaaagaagaaaaagaatgaagaatcagtggtgtgctagagccagcttgtgctggctaatgggggcttactacacacacctgtccccaggtccacggacagtggtgtcacactgatactatgaaatcacaaggggacaacacagggtttttatgagggtcagaagggataatgtttgtgaaagtgtatggaaactgtgcaaatttattgacatcagccttagccataaattctgtaagcatgaagtctaaaagacactttgagttacttataatagtgtatactataagatataaagcagtcataattacctaagcttcaaaaatcttttgtttccatgtccagagacaagtacagtacagtattcttatttgtttgctccccctttttaaaatgtttaatagcttatgttcacttctcatagctcctttctttatgaaaaataacatgaaaatagaaaagttgttctaagtatactttttgtatatattctagacttatcagatgtagacttcctagatgattcttcaacggagagtttgcttctgagtggggatgaatacaatcaggactttgattcaaccaattttgaggaatctcaggatgaggatgatgctcttaatgaaattgtgcgatgtatttgtgagatggatgaggagaatggcttcatgatccaggtaattggttaacctctcttccctataatgagttagttgtttcaggtgctcagcaaatgcatcacggtgttttatttctttactgactgtactactgaagatagtggtttctaacttactgtgtggaaaatacccatagtaatgattaggagatttcctcattaagtaaagtagacaatgttcttattttagcatctctcttccttttctagggtatgtagttcagtgccttcaaactgaaactctttagagtgattagggtggtaaaccctcacacgaaagggcaggctacagcaacctttctcttcctcatctgcattcatgtgaattattataataataatttatagtcacccttcacttgtcagtg

SEQ ID NO: 131844 - DNA, 1016 bp, Homo sapiens
ttctgtgaaatcacagacatgggggaagggttcctattcactcagctagaactctatggttcatccagttcaaaacaaaggttagtgagagaaataacccctgtctagtttttatccagccctttgagcctttttagaggacagatgatgactacaaaacattgaaagcagtacactcaaggttccctttgcaagtgtcatctgccactgaccatgtccttaatggtgtttcttctcctgggtgggcaggaacgctgaaggtgtggaggagctcttcctgcaccagttcctcagaacgctgtcttactctttttgaatctgctcctagtgctagagcttgccttgcttaatgagcaacgttagtaggttagcagttgatgaaaaatccgagtaagtgcagtcctctgtgatttaatatcaacttcatctgcaggtcagaggtggagtgcaaaatatcgttatgataaggagtggttgaataatgggagaatgtgcgggttatcatttttcaaagaaaattattctcatctcaatgccaaaaagatagtttctacacatcacctgcttgctgatgtctatggtgttacagaagtgctacacgggctacagctgaagattggaatactaaagtaagtgaagggcagcaaagggagggtcacacttcagtggacgttttaattcaaaccaacactgttggccttttgatggtccagagtaacagtttggaggagagaacaggtatttgaataaagtttcatttttaaaaataaggaaagattaacaaccttttggatgcgttggtgcttcctgtctattctagaatgtgtaagtgtggttaaaggtagatacggcatctagtatttcaacacattttagctcctgtcccactgttttgtatgcttaccgtatgtgcaaaattaagtgcagttgctgtggtgaaccctatacgttgtgtcctccttcaggaatgctatcaaatgaaatagattctaagcagggtgagtatttttttttat

SEQ ID NO: 131845 - DNA, 1038 bp, Homo sapiens
tcatgggatcctttaaaatagggcttgtgtcctattcatcattttgtctctaattgatagtgtagggtaagtactcagtaactatttgttgaataaaatttgcttcagttttttatcataagcctgaatatgaatttgttttttaaaaggccatgtaagtgctaagacttaagggagggaataatttattaggtctttttttaaaaccttatttccttcttggtatcagtatgagtttctctgcattcataattttgccaaggattttaattggccctttctgtttcatatacttataggccctctttatgttaatattttaaatcataatatctgttagtatgtacgatttattgaaagtcctacacgtcatgtgctttcatgtgatatttcatttaatccttatcataagctacctcatttcattgttgggtagtgaaagagattttgtaacttgttcaggcttctctatggcacagcagaattcaaccccttggactattggactgcagtgccagcttttcttctactatgccttttactgattgagtgttttagtattttctgaatattaaactactagggattcaaatgataaaatttataatttcagaaacaatacttgagtattattggaagagaactaatttgactcagtatgtatctaatttggaaattattaatatgcaaacattattgagccttttgaaaggtttatatctcccgaatgccctttcacttcagctctgatgattggattcctgttttacttactgcagaattaactgtacaatatcatgcttacatgttcagtgaggatgaagtaaatgggcattatcaaagattgttgatggggttgtaattagtataatcccttttgaggtcacttgggtagtacctatcaaaataaatgtgcatgttatccagcaatcccatatctagaaatttatctgactgaaatattctgacttgtgtgcaaagacacacacaggtacacaaacatataatggtagggaattggttggctcgactggtaca

SEQ ID NO: 131846 - DNA, 1114 bp, Homo sapiens
catcaggagttatcactttttgactgaataaaagtttttaaaatatgctcacattaaagtttttcaaattttacaatgaaaatgacaatgacaaatcagtagaaaaagaaatgcatgtatcaaatgatgatgtgaactatcaacacaattaaatttgttattgcttttctgagtattatttctttaattgagaagattcaaattttggatgaaatcatggagggagttaatttaaagattacctttgcttttgtcttgagtcctagatgtcctcctaacctaattctgaaatagatcattgtattcagcttgttaatagatttttttttttttctgaactgctgtttttccaactttgttttaaggaataaacatcatcctgaccttcatctctgggcttgttccgggaagcgaaaagaccaagatcaaataatagctggggtggagaaaaaaatagctcaagacacagttaatcgagaagaaaagaaatatgtacagaaccataaagaaccacctcgtttgcccctaaaaatggaaggaacttatataacaagtgagcatagctatcaaaagccacaaagttttggtcaggactgtaaatctctcgcagaccctgggagctcagatgatgatgatgttagtagtttggaagaagaacaagaattccacatgagaagtaaaaacagtttacagtactcagcaaaagaacatggaatgcctgaaaaggtaaaactagttcatttttctttgcttggaaactatgagagaagaacaaaggaaaattttataaaataaggcatactgaattcccagattttagttgtatttccaagttccccagtaccttgttaaagtaaggagatttttttgttttctctacaggaaaacactggccatttgaacatttgattatctcctaattcagaattgtagtaattcaataaactgttactctaacaaaagtttcaattgtataagtacatttcgatgcttctaaaaaatgaaccacattgtattcaaaacgaaaatgtcagtgtgtaagaatgtgaaagtacatatgggtgtaatgatttgtcttcctctttatgtgagttagataaaaggtggcactcta

SEQ ID NO: 131847 - DNA, 1031 bp, Homo sapiens
ttccactcttatgtccacttatatcaccagctgagattaattgaggaagaggccagtctaaattaatcaggaattctaattacacaatagaattagtgacttcatttatttagcgcattttattgaagccttcttgcctgtgtagcaccatgcgaggcatagtggagggaggtggtgggtgcatcagctcttaagaaccaccagctggaatttggttatgtagcagtacttctttaaagatacccctggagtcagattggatctcactaactgttaccagtgatgaggtgtttcctgtatccttaactcaatgactgcatttcatcccgttctttgtgtttattttccaatggtcctttggagaagaatccagctgaagggaatacagtatttgtttataatgataaaaagggcaccgaagacccaggagactcacatcttcagtggcagctcaatctccttacacacatagaaaatgtgcagaacgaagttaccagcaggatggacctaatagaaaaagaagtcgatggtaatttaagaaagaactaaaatacagttactatagtgaatttattgttactatgaagaagttacttaaaattcttaaattatgggatgaaaactgcagatactctccataccgatggggctttattactccctttgtattgtatttaacacatttgggatcttttacgcttaaaacaatgtgaccgggtatgaccttaggttgtttttacttttttaaggtggatatttattaaatactgtctatttgccaggctccagatagatcacttatggaataaattgattagtttcattgaactaagctttctttggaagtcaacataaggaatttaagcatgtttgaaatgtgaaaacattttgaatattttttactttggttagcacttgttaaattaacaaaaacttctacaaagttaagtaggtaaaccttaagtggttttcttttatattttaaaattgtgtcatcacacaggaggcctgaaaagtgggcaagaaagata

SEQ ID NO: 131848 - DNA, 1872 bp, Homo sapiens
agtccatgtttgaagaaaagaaaatgcatcttgatactatttcatattattagggtagatttccaaaggaaacattaataaaaactatagaatataatcaattgcattctgcctacaattttaatacgcttgcatgtcttttaaaaagtagtgttaaaatagtggaactgaaaagaacactgagaaattgctacttccttttctttgttaagaagagcttctggattaaaaaatatgattaggtatgttttatgtagagatgacgagtctaaattaatagaaagcttgagcaaacatagggaactgttgttatcttattccagaagtgagtaaaaggagaccttcaaaatgaagttagtgtgtgtatatgtttatgtgtgtgtgtatatgtattttcccccttatatataaaaatacataattcctatatatataaaggggaaaattatcttaaatgacagataaaaattgccaagagggactagaactctgtggggtgggatgacaggacgctaacctctcggaaatgtcttgagtatgttggccttctaaagatggggaagtgaacccttaactccatcacagctccaactttctgattgtttcattttctgactgttcttccagttgcagtttaaatttgtttatcttcttctctcttttagttctggaaagctggcttgatttcacaggggagttggagccaccagatcctcttgcaagattgccccaacttaaacgccacataaaacagctcctaattgacatgggcaaagtacagcagatagcaactctttgctctgtatgacaacagtgaacacttaatgaaagaatgtggctttcttcagtcaaagcatttttattatccacgtgatggctaagtggataatttaaaagcttagtaatgtctggtcattcactgatttgtgatgtcaataggatggcaccttggaaagaaaaatgaagaacaactttatcaaggaagctagtatttaaaaacaaattcatgagcaagctgcaaatgagaatgtgttatatgccaaggaacaatgaagtagaatataatgtatactaagggatttcaagttctcagaatttttgagtagttgcttacgtgaagctcaagatacctgtagaaagaaatatggtatatttgtatagtttttaatagaaagatctatgtttataaaccagcacttggccaaaaacaaaattgtaaaggaaatttaaattctggagaattctacagggttgctctaagaactgtcttctcagcagttgatccagctgtacggaaatttagggtatttaaacttttaaaggatcatgagctgtttcttgggcgatgaatgttctcaatcagaaaactgacagtagaaatctcacttctggggaaaacagttgtggaattcttacttcattatgaatgtatttaaaaaacaaacaccaaataattggaatatattgcaggcattaagctcattaaaaacaaactggcttgcagaagggtccgatgtgccaagtgatcatgattctgctggaaagaggattttaaatattgtgggagttctcccaccctaagtcttacataatgccaccagtccatccaaaacctatatatcacctatactatatatatcatatatatagttgaatggcagtattcaggctcaacgtacagtttgatcctgagtatgcttggtgtttgccttcagaaaaaaaaaaatacattgtaaataacctcagctgggatgaggagtgacagaatatcaaaataatttgtggctgtggatttttttaactgctagtagtggaatactggaaaagcttcatttctgaagatgaattttatttttaaaaaatacatgcaca

SEQ ID NO: 131849 - DNA, 1023 bp, Homo sapiens
gacttccttaggcttcagcagtgaggagactcatccaggccacatgaaaggaggaggcacgcctcacctcccatgctcctcctcgtttgaaaattatgtgtgtcctggaccagtaccccagatgggagggtatagtggacccagatggaaagagaggatcaggagggcaaagccatctcatgccagggccatcctgaccctggctgactggaggagctacaggagccagcctgggaaccccttccagcaccaactgcaagactcatctgccagctaccactcccttgccccatgaaacttactcttgctttttatcagcagaggaaagtgggcatggggacaaaaccaaaaaacaaaaaacgccaacatctgtgttcttctaagttcacttcctacttctgaataggaatgaaacaaaatgaatgtgctttgccaccgagacacctaatttttttctcatcttacttttttctcttctctccctcactgctgttcttcagacaaaacctgctacaaccccctcttcaactacgaggacatgcaggagatcacccagcactttgccgtctgccacgtggacgcccctggccagcaggacggcgcagcctccttccccgcagggtgagaggcctcttgccctatgagctctacagggtggaaactgggtgtcggggaggggttcaggtgctttgctcttttaaatactttttaactgtggtaaaatataaaacgtatcatcttaagcactttttaaattgtgggaaaagatacataacataaaagttagcactttcactatttttaagtatatagttcagtggcattaaggacatgcagacattgttgtgcagccgtcaccaccatccatctccaggactttttcatcttcccaaactgaaacaacatacttatcagatactatctccccattcccccagccttcctgcaaggctggcgttacgataggtgtgctcagcctggacaggacttcagtggaggaggacttgacaccaccaaatagtg

SEQ ID NO: 131850 - DNA, 1027 bp, Homo sapiens
gaattctgtgtagccccaagccagcagatgttagtcacaggtacagtaacctgtggggccagtggggcctgagggcaaggaagcaaggaagcgcaggcttgatggcctgttttccagatggagcaaacagtccggggcagagatggtggcgggcaagccctttccccagcatttggtgcatttaacagcgcagtctgagccaggcctctgtcccctgcctcctgggagtcccctcctagccctggtccttggagtggcttctggccagagagagctgctgcccgaagccggggctcttatggccagatgagaagagagcttcctcaaaacacagttggaaacaggctggctgtcttcagccacgcggatgccatgaaccccacatgaccagcccactgtctgctgtgtctcctcaggagcaggacatcgagactttacatggctctgttcacgtcacgctgtgtgggactcccaagggaaaccggcctgtcatcctcacctaccatgacatcggcatgaaccgtaagttctgaggagctctgattccctgtcagccggttcccaagagagtggcggaaaaaggcagccgagaagggctgatggccgggagctggtggtttctttttgcctgggacttcctggggctgttctgggaagaactcttgccacagcctggaaaagccagaaatgcgctgcatgtgggcacggagttgtctgtgtgcccggaggcgctgggaacacaggaagctgtttgctatctgtggcagtgacttctatattaatgcacgcatatggttttcagtcttttcacagaattgtgcaacgatcagcacaattttggaacattttcatccttccaaaaaatcctgtaccttttatctgtcaccccaccctcagatgactgacccttcattgactttccttttctgtgaatttgcctgttctggaattttgtatacattgaatcaaataatatgtgatttttttttggtaactggcttctttcttagtgctttcaaggtttatc

SEQ ID NO: 131851 - DNA, 1063 bp, Homo sapiens
ctcctacctcagcctccctagtagttgggactataggcgtgagccaccatgcctggctaattttattttttgtagaaaggaggtctcattatgttgcagatgctggtctcaaactcaaagttacaggtgtgagccatcacacctagcctatgtttgttacttaatggaatggatcattaagatgaatggcactgctgtgtctccacctcctcctccatgggcataggcgatgaaccaggaaaatatagggggaggagtgtatcattttatgaaaagatggtggggagggggcaggcccctgacattctctcttgagcctctgttcccatgatttgcctttcttgctgccatgggccttgactttatgctgatgagccatagtcagcttcctggacagctgttccagagggcaccgtaactgctctggccatgcttggaccccacttgctagactgagggagggtcaccaagcccaccaactgacttagatcctgggtatgcggtgatcctcttagagcctagaacggtcggcatctgcccagggcctgctgggaaggaggggattaccaggggcagcggggagacagtcacagctggcctccagagcccctccggatcatccagagagttgacttaagccagtggggctggccctgggagcttcacactaatcatctctggagcggttgtccataacaactgacatggagggaaatgctgcagcttgcaaaacacattcaggtctgtaccatggttttagtcttgggagcatcttaatggagcaggaggccttgtcattgacctcagcttacaactgatggcagggattgtcagagaaggctgataacttggccaagggcacgtggtggttatatcattaggataagtattgctcaaaaaacagtgctgtgccaaggaaatgtttgctattctcaccaacctagaaagctaacaccccagctatgaatgtcacccagcccagctggagttagtccttacagcttcctactgtcacctgagcatgcggctttggtcctcagattggtaggatagccaccgaacc

SEQ ID NO: 131852 - DNA, 1083 bp, Homo sapiens
ccttcaaataaggactcaaaaactggtatccatgagaagtcaaggctcccacaggtcaagggtctaagccaggttagcttccagagcaggagctgacagggcccatgggaaacaaccagaaatggtggctgggcctgccttgggctggggaccactcatcttccagctgctgtggccagacacagagctgggcgtccaggtcttgatgtagccaagaagccagggactaccagcagccctgaacccctcttctgtaagcagccgcccaggctttcttaagctgtagatttccaggacctggcactttcctgccatcttctttggcatgtctgcaggctctgcagaccctgcagaccccgcatgttcaaatgggtctcctccccaactggccaactggcttcccgtcatgttcttttccttggcctgcctctggaccagccgtctcccccatcctgccttctccccatgtttctggcccacctgtctgtgcctcatctcctgtcacttttcttctccctcccttggctgacatggctggcgatggcctctcctgctgctgacccgtcctctgcagggccctgctaatggcagcttggagcactcccacccctgctccaagaccttctgtgactttttctgacacacagctggaaaaaacccagcaaaccaggaggaggaagtagtttacctcccaaaacactcagcatgaattaatcccccagcccaggaaacccaaaactcaccctcgaaattccccttccttcctgacagtccctctctctcctccccaggtcttcgtcacactcggaatctctccaatatacctcatcaccacttttctgctaaatggctatttgtgtacctattgatttaactccactcgactgtagcttaaagactttttcttatccaactacataaacatgataagtatcagggccaatactcagaatattaagccccctgcaggagcatcctgactgaagagaaggcctagctgttggattaacagaagtaaaagagataaagaagaatcagatggagattttagaatgaaaaactataaaaacttacataaaaacc

SEQ ID NO: 131853 - DNA, 1053 bp, Homo sapiens
gcgccgatgcagaaaggagcagggaaacaggctccaaaggaaacggacttcccaagtcatgctcatggagaccgggccactctctagactcccacagggtgtcctgtgcacccctctccagtccagccacgatgtgccagttgcaatcactactgtctgctgctcacaagccagccgggctcccctttgccttcagtccccaagtccacgttcctcaggacttccacgatccagctccacccacagcagcccctctgaagggcgccctgttttctgtaacataccagcgtctccatcatcaccaccatgtgcttttttgggcacaggcctggtttaccctccccctctgccctcctccatcagtgctatgccccctgtctccatggccacctgccttacacagccttccctctccctttggttgtcattcacctgccacttgtggatcactaaggcccttggcatcatgtcttgggaggcactggttcctcctgagcagatttatgcgtgtgaactgccctgggctagatcctggagccggcctagtgtgcggcttcgctatctagcagtgaagatacgcatgccgccagctgtgttcttgaagcatcgcaggcatgcttgggtacctgggtgaggtacggcagtggagcatggaagagcaggctcaggaatcggccctcaccccttcctagccatgtgacctggagtaagccactgatacccaagggcctcagcatccccttctgtaaaatgggattatggtgtcacctccctcataggacctggaactgcactttagctagtccctaaaatactgcgtagtctctcaaagcccaacttccttctctgcccaaagagcaaatgcctgcccgaagagcccctggggactttcgccaggcatccacacacaagaaatgtattagctatggatgggtcaggcatgcacagataagttggggagggagtgagttggagagaaggaggggcagaccagaggccactagatctagttagagatattccatgggcttttgtctgcaggcttatcaaaca

SEQ ID NO: 131854 - DNA, 1054 bp, Homo sapiens
tcagccagtgtacaaccttgggcaagtcacgccccctcctggagactctgaaaatggaacagaaaggtgtggtcatctgtgtgttcctctgtgatctggaaatgctacaacctttgcttctaaggcaggtagtagccaggcatggggacggggcttctgtcagctcccctttgattttgtagacctctggctcttagcaaagagatgtcctaggaaggaagggcagtaccttggtgatcctgtcttgcacatatagactggagcttcagcccattctcacctctccttcacctgagacctgtggctgcagaaccagaaactcatttccagaagcagcagaatgtctctctttccgcagggctcagaagtatgtattaagccttccattaactgcatcttactcagctggaaaaataatactcaggatgcaattttatctgatttctggcctgtaagctcctgaagggttctcttaagaaaggctcaaaaaactcctgcgctgtgtgactcggagcccagccctgtagcctccctccaaggagcaggcagctcagtggttgaccagcaagcccatcatcattcagcactactgggttatccatctgtccgtctgtcaattaaacaagtgcttatgagggcctggggccaggggcacataccgagattactaagactaaataagacacagcgtgtgccctccacagcagttcaggcgcaacctgaccactttctctatttggttaaactccagaaagttcttgactttattattcgcagttcaaaagcagcatgagcttttgtgtctgctccccttcacccactaagtgtcatgacgagcaggcagaacgcccatatagatgccacacatgctatgggttacgatataggacaggaacaccgagcttggggtatccaccatcttgtggcagacagcaagcaagccagctttttgtctcagagagaaacattacctcatgtctcaggattggttgctgcaaacccaacccaggtacagagcagtcagagccttgcattctttgtctacccagcaaga

SEQ ID NO: 131855 - DNA, 1043 bp, Homo sapiens
caggtgtgtcagtttgggcaggctgggccacctctcccccatcagcaatgggggtgataaggtaacaattgctgagaggcacgaacgctccttgtgcatcagggacttgcaaaaaactttctgttccttgagtatttgcttctcaggacagcattgggaggggtgggtgttatcatccagtgcatagatgtacaagtttatcaaacaaccgtagtgttagaattactgggataatgtttgtgatgtgctcagcacagtctctggggtggaggagaggctcctgccccacctaatagcgctcagacatgaacgtgaccttgcgacctggctgtgcaacagcaagtttgagatgcgttagttgctctgagttttgcatttttgaggagagagtgactcattgtataacctgtatctatggggctaatttgacaaattaatttttcttgtaataagtatttaaaattcattaactgtggtcactgatgattttccccttgttcttcagttccatctttcaaggctggagaaaaaagaccatttgattccaaatccatctcccctctccaccccttttaaaattcaaaatgaactgtccatcctgcccttggatgaaatccaggattccatcagtctacccacagtgggaatacttttaggtcatagtgggaaatctttgggaatcaattaactagactaatactctgctggaggaaagggaaaaagtgctgagggggagacttaatttaccatgcatcacaacattttctaagtacatcattttcaagtcagctcagcccttctgttagccatgatggagacatgtttgggtttgatttttaaaattctaatctatcactgtcaccattcctgctgcaatttaaggcttcggtggtttgtggtagataacagttgttatacttcctgcaggctaagaaggcagtgatggtttggtttattaactatcacaaagcagacaaaagggagaagaaaggtctgtgtagacagaagaaggttgtgtcaggccagaggcggcgggggaacca

SEQ ID NO: 131856 - DNA, 1066 bp, Homo sapiens
cgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaataccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtctgaatgctttggttcttcaggcgggatggcttacatttccccttcccaagttgaaatcttggatttggggcccacccagaaggaccccatccaaacccaggcccttaaaatgcagatggtgctctttcctctgcatttaggtttgctttggaaaccttttgacgttaatgatctcaccttccatttcctggcacccagcat

SEQ ID NO: 131857 - DNA, 1030 bp, Homo sapiens
ttcatacgcattcaaaaccgtgaattccagatcagatgttgggaagctgagctagtggggcccagttgccctgggtgtgacttgtgctgagcagcctcatgctctccaggctggcagtgcataccctaccacaggagctgcaggcctctgggacagagctcccctgccccggatggacagcacaacgggttatctctggagaagcccgtttcatgggagtcaccccagctcatgtcacagtggatggaggagtccttggcacagccagtggtgtagcaaggggctaaaagacagccagactgtttgggttggatctgtcacataatagtgtgtgaccttggacaaaacacttctcttctttgaacttgtgtttccccatctgtataatgggaagatcatggaacttactccaaggggctgttgtatgcattatacctaattatgcaaaatgaagccactggccctgtgcctggcacgtggctgagtcaataaatcttagctcctgtgatcatggaaacagcatagctcctttcctcttactgtgcatgtagaattcagccacagctgtttctgcttctggtcgcttccatttagcaggtgagtgctgatgctggtgttgtctaggctctatgcttggcatcaggagtccagggtggataagacaccaactttttttttttctttgagacagggtctcactctgtcaccaaggctggagtacagtggcgtgattatggctcactgcagcctcaacctcccctactcaagcgatcctcccactccagcctccagagtagctgggaccaaaggcatgaaccactgtgcctggctaatttttgtatcttttctagagacaggattttgccatgttgcacaggctggtctcgagctactgggctcaagtgatctgcccaccttggcctcctgaagtgttgggattacaggcgtgagccaccacactgtgccaggtaccacctctcatggcagagcttattgcttggtccagggaggtaaacacatagttacacaa

SEQ ID NO: 131858 - DNA, 1080 bp, Homo sapiens
gtctgccatcatggtggttattttccagtggggaaaaggataaagctcgaataaaccagtatgacataaaggatgtcagatggtgaacaagtgccaggagaaaagtaaagcaagggaagtgggagaggagtggggtccaggagtgtgggttggggtgattttgtaaagggttgttggggaagatctctgacatccgaggagagacctggaagaggtgtgtattactagagttgtctgaaattgactaaatttgttactgaattgtgtaacagaaaacaaaaaggagacgttaaacagttaactcaggaagggggttagcttttcttggcactaacaaataagatatttcttaatgaggcactcacataaggacgcctgagtgatgtgtgcctggtgacctcatgagccaggaggggacatcccagcgctgtctccacaactgtcccctgagtgtgcccagggcacaatgcaaagcatgaaattcaggccaagtagttctctgggggaattagtaagtacattcaggttcacctcttgggtttcttgacctacggacaagacttagcatatctagatgaatgtttggatcacatgtcctaaaatccctcctccacagtgtgatttctctcaggagtcgagctggagagtaggcagggggatgcttcagtctgtagcaacctggtatctgcgttggctgagaaaagattcatacacttccaggctaagtacctttttagcttttcttggtgtttactagattgcagtcttcagattgtcttataaatatcttctgaaactcctcatttgcatcttgacatgtggagtccccagctggacctggtactttaggaagggtctctctgggatggtatcaggaggactttgaatgtttcatacacgcaaaatccttttgagagtgcaggaaggtgcttctggttgtgacttgtgtcttgtttctgagaactagattgatttgctgctgctgggagacatgatttattgagcctcgcaggcaatgcagtgatacacgaggtcacaggggttgggttatagcttagatatgctttgaggcatcagact

SEQ ID NO: 131859 - DNA, 1031 bp, Homo sapiens
gtcttgttttttggaccatgataagaactttgatgttgcattccaaatgagctgtggagccagtttatatcttcctcccaactctaggctggattctgtcctgaaagctctgattaaataacttcccttttgagatctagtgtcatttgttgtttgcgagtttctgtctatgatttagtttgcctagataacatttaatctttggagttgatatttaagtcccaaaacctgtatatatttagggaatcacaaatctgcctcatttgccatgtattcctgggggtcagaggacagtcagaggtcagtaaatatatgcttcataaatgaaatcttgagacttgcagttagggatgctattccctacctctgcctgtgtccttccctgcatcagccccaggagaattccctgctggcctgtggcagtgcctcacaggtcagaacttgttttgcttgaagagcctagatgaggctcagttcccacactttgggagagaagatccccagcagaaaatgggtggtaattgacttcatatagaggttctaatggatgtgaagggtagaagcaagaccaatgaaggaaagagtctgggagatttatcttcctaactccccctgcactggtcagcagtgaaaaggctgctgggggatgttttgaaccccctgcatcaaagcagaggctaagtagatagcagactgctagagaggctacagaagaaagtctttcatggagggaagatttcgccaagtcaagtgtttctttcaactctcagaattgaaaattttgatagaaattgctagctcaagagactgaatcctcatttgggctcacacacacattttttgccaatatgcttacattttggcaacttttcttctcgttagcaattctgccaatggatgggcatggggaagaaagcgagctgaactcacaggaagctgtttatctgctttgctgcaagaagggtgaaattggctctcaagtctgaagctgggtttgcaggaccatttcttattttcatcgccctttttct

SEQ ID NO: 131860 - DNA, 1014 bp, Homo sapiens
ctttataatgtgtcggtgtgaaagggaaatggttgtatgtacaaaatacacgaggcatctgagcacctagaatgtataaggggcttgggtactcagttgaacaaaggtgatgtttggatgaggtcagccgaggatgtggctgtgtaatttgctcctagtttccaatctaaactttgtcagcaaggaagtgaaagcaataaaatgatctcaaataagcagattgtttggaagccacacatttataaatagttcaaagtaatcgtctcagagtctcagcaccccctcagaatgctgagtcatctggcattgcttatggcattgcagttttatttatactacaactcctcctgttacctagaagacgttttcatctttccacaagaaagttccaccacaaggttgaatgtttaaatatctagcattagaatgaataagacgggtggactggtttctttgtaatagccatgtgcttggcattacgcaggtgttttctgtgtattaccttattttgccctgaaaaactctaccaggtaggtaattaacatccccgttttacggattaggacactgaggcccacagtctattttagtaatgtgctcaggagtaacacaatttctatgagctagagttgggattttgatccatgtctctgtagtgaaaactactctctgcgcgttagtccacgctttctcattttcaagtgaagcagaggaacttatttacccctttgtcctttttcccctcactgctatgcctatttaagcctgcagctgtatgtttagctatcaagactcgagcaaaatcttcaatcaaaatgctgatggagtgtaaagttagcagccagaacattttccaggttcagtggaaactactgaaccaaggggcagagggaaagaagtaaagcatagagtttctgttggtggtgtttgtcttgcttttcagttccaaatttgcaagaaaatgaggaatctgagattacacatggttttcttgttaattttgaacgtggcggg

SEQ ID NO: 131861 - DNA, 1010 bp, Homo sapiens
taactcttgatccacctgcctcggcctcccaaagtgttgggattacaggcatgagtcactgcaccggctgagaagcttttaccaggtatgtctcccacccagagttcttaataaacagcctccttctaacagtgaatgtctctctcctcagtggccctgcccttcactgctggacctgctgcgtatgctttcaaaaagtgtgattctcctgcagaagggccttgccctgcccttgccccaccattctttcctcatcactacctctcacccattttttgcatcgcacaggacatgccacaaggccccagcactggaggaagtttgccctttggctcattcctctgtgaagctccaagtgcaccaagagcttttcctggtttatggaaagcatgtcaaaatttggtgtgtgaatgtgcaagtccacaaaaagggaattcaggtctgaaatccacagtttttgaaatctgtgcattttggagattcttcagtgtgacttcatgctgacccttccttcttactttagacgcttttgcttctgaaacagaataaccctctctgctgtttgacaaatagctcagatcactcctctgtccctgacctccagaaggtgagactggccttctcttctgtagccatcagccttttggtatagatgagtatgctctttcacaagggaaaccatccacgccatcatcttgaaaagacactatttaaagtttatgtttgatgtatctctaaatgcaattgaatcttcaaaaatgtgcaccatgaagctggagaaatctattgcctgttgtcagcctaaaatttgcataactaaaagtattttcataaaactagtgagaggcaagggagatctcaatcaccgatttcattatcattgagaaacttttcctgagaatgccatatagaatacatgataccacaatttgacattcagaattttaagaaaaaacataagtacaaataaagtgctaactattcatttggttttttgatgcaaagcatat

SEQ ID NO: 131862 - DNA, 1085 bp, Homo sapiens
ggtcaatctcacctcgagtaaatactaggttttgcagttgactctgcttgtaagtctcagaagtctcttgatagaaagccatctgatggtctcaaagtattgctcttttatgattagtcatgaatctgcatcccattattttaattaggcagcaaataattatgtcagatgccctcccaggcctgtttgataggtgctggcagtggttgctgaaaacattagtaatatttattgccagggctctgatgcttcagtaagggatggcttttagcttctgccttcttttcttgtctcttgcagagccttggaagtacatccataaaaggctgactcttgatttcaaatgaggcagttccatttattcattttaggactcttttttagctcttaatctgttactctttgacccaagtgtttgacaatgaatgacagaatatttatcaacttagagaatggttccatcagctctgcttcccccactctagtggtgaagaacacagcacagttttgcccaggctgcccagaataatgatgctgtatgcacatgagccatgtgtcagtggagaagtgtgtttaactgagattcaactggaactgtgtagaaatgtgtggccctgtgtttgaaagaagatgttactgtattttttttaagttctaattgctctctaattgtaacttgtgtgacttacaagtgaaaaagtttccttacactttgggcttgcagaattaataaaatttagaattttgggttcattcacctggaataatagatacaactgtggtattaatatttgtttccttttgctgctgttattgaggctgatgttcatataagatgtacaaaattttcactcagttcagtttaatgaaatgcatggaatatattcagtctgtgtgtgcactcatgtgctggggtaccaagatgagtaagatgtagtccctgcccatgggcagctgaaggcagccctgccttgtacaaggcggtagaggtggggcatagactgaagcaagtggacagtgtgtagggggcctatggagggctgcctcttggcccaattaccagagtgttcaatttgagttctgaa

SEQ ID NO: 131863 - DNA, 1066 bp, Homo sapiens
attaagaagtttttgggtaaaatttgaaaagaattatccaggcttcaagcactcttgtaatagacaagtggagagttgagtatggaaattaggtttgagtggagtaagtaccctttttttctgtcccttcttcaatttatgataagagatctcatggctgcaaattaaaatattctaggagatctaagtatggagttttgttttgttttcctccactgtcctctaaaaagcaaagccactctaggataaagtagctccatggccttttgcttctaaaaacagaaccaggaagtaaatagaaaatggtccctgagcacctagctggattgatcttacaaggttaacttgcgagacttcagtgagactggtctttccactgcatccttttcccttttgttcctcctcctacttgcccttggagaaaaggtgaagaggcaggtgtggaagtgtggctactggatgaacatggtagatttctgttgcttatcactgggctggagtctgggtggtgggcaggagaaggcagggctaatttcagggcccacaaatactgtttaataggttcaccctgttggtgttcatatgtagctctttttctcaggtttttataaaccacaagatccactgggaataagtgggcccatactataaaatgaactacgcagcttactgagcaattagcttagattgatatacagatttaactttttaatgaggcttggccacctaaaacctcaccaggtagagggtctcagctgcaaatgtctggcacagtgtctgtaactttcatctagccctggtgctgtgctctgtcctttatgtggctttgtgctgccttcggtttctttccacctctgtcttatgctgatccatccctccttatatcaaaactgatgtactaattacagagaatcatcaggccctaagtctgcagttgcttgaagttcagcctttaaagtacagagacttctttaactgtatttttattgctgtagctatttctgttcgatttgccactgcataaatcaccacagatgctagaactgtgaagatgtgtgctttgcaa

SEQ ID NO: 131864 - DNA, 1277 bp, Homo sapiens
aagacaggcagctaaactgtaagagacttttaacatttttgattttacttagacaggttgtgtgagggacttgtaaatacttcatgtaacaagattaataaactttataaatgtattgttatttaccaaaattatatataaaaattggagtttactatagaaatcaaaattatttcaacagtgatttttaatttcaaaatttagtggatgatatagctcttaagttctatctttattttaagattgttctgaaaatcaatcctgttgtgtgtgtgggggttgggcccttggcaagtattcaggtgagctcgagggactcagtgcaaaggctgaatacttggctgggattcatcagaattaaagatcaagggcttgcctaaggctgaaaaagagccagagccataagtattaaaacttaagcagtactctctctaaaaaaaatccataatcaaaattaaaaatacaatgacagtaaagcagtcatacttgaataatgaaagcattaaagtcatgtagttttttatgattctacgcctccacaaacaataagccttactgaccgctcagctgcctgaacgtttaggcaagaattacatttcttaagatgatgatagcacataactactgcagtccttcagtaatgaagagcagctgtccccagaggcagggaagcctggagtatccagtaggccacggtgacagggtcaagaaggcattcacaggcactgaacagggttctgtcgtctcatgcctggttctgcagtctgggcttagcctttgagcagatagaagccatttaatttgtcaggccctggaccaactgatatagagggatggggtcggtgtgagtagttggtggtatcacgggtccacagcagcacactctgcctatcctctctgtcatgattctctgagttcttcggcaggaaagggagttcagatggacaaagatgtcttgttgtcaaagcaggaatgcaactcctgaaaaggaatggtattcaaacattatgaagtattttctaacaaaacattgggaatttgtattgtttctctttctttctttctgctgacatttttgggagggtgaggtatttgtaaagtcatgtctttgttttcagcacttttcagttctctggtaagaagggcatccaggtcgggcacagtggctcatgcctataatcccagcactttgggaggccaagggaggtgagtgggttgcctgagcgaaggagtttgagaccagcctgggaaacatggtgaaaccctgcctctaccaa

SEQ ID NO: 131865 - DNA, 1052 bp, Homo sapiens
gtttggcttactactaaaaattgtctgcttcattactatgtgcaggtttgttccccgccctctttccccttcccccggccccagcccctgtccctatagcacatcacacaatattgtaacggcctgtttacctgtctgcatctcccaccggacagtgaaggctgggattcactcttctctatgaaatttcctactatgaaaataggtcctcagtagacacttagtgaatgaaggagtggtgaatgccaagatgcccctacagtcagagtcaacagcccatcaaccaccagttggtaaagttcgatttgttttacaaagtaaatgtgcttccacatttggtcctggtgcctgatcccattgagtttttgcaaagggccttggtgcctttgtgtttagtctaactcagttcaattgaatttagtgactgtctgctctgcaggttgctcaggatctctgtcctcaaggagttcccagactgtggggagagggcagatatgaaggactcactgtaatgtgcagtgaacgtttcagctagtagagagttacaggagttgggaacattgatagggaggcagggaaatctaccagggaaggtcagagaaagctgcagggtggaggcacctggtataccaggaggcaagggcatcccaggacgaaggcatagcctggggaagaacctggcgtggaaagtgtgtggtgtgttagggccaagcaagtatactgctgtgttcaaaacggatgttttatatatacatatctataagtgtatttagatatggatatatatattccttcagattcacacatatgcataaacgtatgtaaatatatagagatatatacatttttcccttggcaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatggtgagtaaatggcccaagg

SEQ ID NO: 131866 - DNA, 1038 bp, Homo sapiens
ctctcacgttttcttagaagttgtaagtttaacttcaatcttttcccttactgatatttgcagttcttccagcagaaacgcttttaaaggtgaatgtgttgccgctgcttccaaagccagccagcgctggctggaggccccctcctctacgtgtcgggcattgagattttcaagtaggatctggtccctgccttcagggtgctcttggttttgtgaagggggagctaaacaataaacagtaatggcaaaatggcaacgtgagagggacagtgacgtcaatacaacaatgtactctccgcccaaaaaaaattttcctggaaagggcctgggaggaagggttctgagggctgtctggaggaaggggttctgaggttatgagtagatttgggccaggaaagagagtgaggaggaaattcccagcagagtcaacagcacaaaccaaggggaagctatttgtatttactccaggttattgaattactgaacattttccatgaagcaggtggaccatattgccaacatagtaagatagcatgatttatgaaaacaggctccaggatttttagtttagacatttgtcttttgagcctgcaaattatttttgtaatgaagccaagggtaccaagaaaatgttgacgcagtacaaaaaaaaaaaagatctgctttcccttaatgaagactcttttgatctgataataaagttgctattgcaaagtgttttaaatagaattccgtattttcaaggacagttaacgtggattttttttggtaacagctttactttatcaagatatattttacatagcatacaatttgctcattaaagtgtgaaatcaaatttttttttttttttagtatatccacggagttgtgcaattatcatcaccacagctaatttcagagctttttcatcatcccataaaggaacctggtacccatcagctgccatccctcgttcccctccctgagccctaggcagccactaatctactctctatatctgtggatttgcctgttctttctttcatatgaaatttc

SEQ ID NO: 131867 - DNA, 1922 bp, Homo sapiens
gaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggtaaggaaaggcagcgccggtgcgtggccctgtccacaaccatcatgctgtggtcacctcgcatttgatttgagctcatgtctgtttgcaaagaataccttctaagtgagccatcctcctccattgtagataggaacggtgaccctgtgtggccgttagcgcttggagtcttgtggaggtggccgggatggctgcacagttgactgtgttggcctggtcaggtgtgtgtgctgagggttacccatgacctctaccagaactctaaccaagaagaatctttcttctggcacatgacaagtttaaagttgagctttaaattgtggccaactactatatcagccaagagaggttatgaaagtggctgcagctctctgtagggaggtcccaaatagcaccctgcaactcacaatgaaagcatggctcctggaactcctggggagctggtggtcaggatatagaaaatccagctccagacctgctgtcccaggagggccggtagaacttagagatttgtagatttatgcatgtgcatcatggtatttggagccataactggttctcagtaaacactggcttcctcctctctgggccctaacatcatgcaaaaaatagtagcacccttaatatttgcaacctcccacctttgaagagtaattttcagacagaaatgtggtgaaaagtatgaagggtgacccggacaagcgcaagagggagatagatattgtagataaaaaataataataatttaaaaaattcaaaatcagtcaaaatgaaacttccttgttctcatgtgaaaatatttttttaggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggtaagtagcaagcccaagcggcagccccgtctcccctgggtgctcattgctttctcaagtttatgcttatatgtaggtgtctctgctgcaggtcagccctgaaaacatagagagatccttctccttacacagctgtgcacgtggcagaggcttcccaggttcctttcacagcaagagtctctaatacgttgaaaaaagagattagatggaataaattgtttcctgtgcaaatttttttagcatcagataaagtctacagaagagatatctatagagtagaagtaaagtcagaatttctcaaatgacattttaaagaataattaatagcagagataacagtaatagctcctactgaacgtggttgagaggttgaattagataatgctgtacagtgatgagaacagtatttggttcagagtaagagcatagtagatgttgatgaccactgttgtcacag

SEQ ID NO: 131868 - DNA, 1097 bp, Homo sapiens
tgatttatttcttagaatataaatcttggagaccttatcttctgtgcagtgttgtttattaatgattctgaagtctgctaggcctcatgaagacaagacaagacaagaaactatgtctgcttcacccaacagtgtacgcccagggcctaggtgatggcctgtggcggggagcagtgaacatgtactgaatcgagtgaagcagtgaagagccaccgtggtacctacagtgattccgtggtctgcgtggcactgcagaccaaagagctgtgtttcctttactgtcccgtgaaagagtagtgtttaccctccaactctgccactgatataaaaggataccttatgcatcttggtatttgctccttaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgactgcaccaagcgggaaaggaaaaggcaagacccttggcaagtctgtgccaagggcagcctgatgtcacagtctgagtcagaacacagagctggtgcattggtggggctctccatttaatcacccactaatttgagaggatgagacttacttactgcccaggtgttgtggttaatggatggaggagaagctgtgagggctgctgtgagggccgctgctcttgctgtagtcccacagctccgccgtgctgctcctgctggagtagtggttccgggagcagttagttttcttcgtcccctcacccagctcttctcctgggtgtgtgccttcccctcctgctctcagccatgctgtcctgcatgtgaggccagcccattcagccagacgcatgcaggctgctgctccaaaacccatgctaactctgcccaccatctgttttgtatttttttcctctctgcacatagaaaagatgtaaactgacatagatacccactgtttccatctctcaaaggttagagttctattctcatttttcttttctttta

SEQ ID NO: 131869 - DNA, 1048 bp, Homo sapiens
ttctgcctaaatcattggattattgtaggattagcaagaagcacattggaaacaacttggcctcctataaagaaaaatgtattactctaatctcttcttgttcgggaagcattttgggttccttaggaatagaacgtttcctggaaaaaaataatatcgattggcagtatctgtgagagattttcattggcgaagcaatgttctgctttgttaaattttgatttcatgtgttgttggtaggaaagaattctctcaggtcgttacctccctgctaattcacggagaaagtctttctgtgaacccagggaggggcttgctcctgggactccagtgccttccaagagctccaccttcatgccagcaaggctgggttggcctattgcctttcctcatttcctctttctggtaggagagttttactgtaaagaggagagaaatgggttgggggagtggggatcaggagttgttttcattttaagatgggagaataagagtatgcttataggccaatggaaagatctagtacagagggaagaattgatgacctggagaacaatcatcagagagggtgagttctgcacgcacaagccatcatgcaccctttgtctagtagccttctcacacagggatgtgggagcatcttcctgggtgcaggcaatcaggcatgcgctatctttagagaatttgaaagtaatgatcacacaagtgaagtgttggtctgcttttagtatctccatgaaccagcaattccagacaatatcagagatatgatagccctgctctggggtgggccactgctctcacccgcacaccttgtgtccccctcactatgcccaccttcaaaccagcaggagcgaggtggggagacagctgaagacgcaggcgggctggaaggggtggcagaggcagttgttttctggctgcttgcagtgagatatgaagcaaggtcagctgttgagagtgaggagcgaggaggatgagatacttgctcaccatcaccagagagcgcagagcttgtatgattgccatgtatttgtccagcatcacc

SEQ ID NO: 131870 - DNA, 1084 bp, Homo sapiens
gagaagtgtaagacatatccctaccctgtccagtcaaacatctaatcaacgtcaaggagaaataccaggaacccagcagctgtgtctagagctggcgtgtccctatggtgtgggcagccctggccttgatctcggtcttgaatgagtgtttggtcctgaccaagacaagttgacgtgtctgaggcccaagctgtctggggatcagtaagtcttcctcctgtaagatggagatcttattattttgtcacttgctatcgctttatttctaacacccatgtaagtgtttttttaaatttaatttttcttggattacacatgtaattcctgttgtgtaagatgtgaaaaactcagagaaaatctccaaactggaaaaatcacactaattgtcatccacttacccaagccaggcactggtatggggtgttagggagctgggtggatgggcagaaggtgctgggtcgtctcctctgtccctttcaatgtccctgtactctctctttctcgtggtctgtgtgtctctgtttttttcagaccagtttccttggcttttcccctgtaagttaacagctttcccctagtcacccaagtggaaagctttttatcagaagttgcaaattggcaacccgtaggccagacctaacctgcagatttgcttagtttggtctgcaggggctgcagaggtttttttcttttcttttttttctttcccagaaaaatcttatttgatggccagtgcttaaaaatcaggggattccaactacaaattcaatatttgggcctccattgactagacctgggaggcagctaccccatcagacagagcaggctttctaagtgccccaccccctgtctccagacctccaggatgggcctcctgcttgcggggcaggagcttcttgcatccatttcctgtccaggtaccggtctgtggcggggggctcttggtggagccgccacagctctcagtgtgcctgccctgcctttaacctgtcctctttccacactcaaggctcttccaacaggcaaggctcttggttctgcccccactggctgtgtggcttccactcccttctcctttccttcc

SEQ ID NO: 131871 - DNA, 1051 bp, Homo sapiens
tgcctgccttctacctcagtgtgatgttagtaaactgcagaaacagggaaaagggcaggcagcaccttcatctgctgtgtgccaggcactgtgcttggtgcttcactggaataaactcctgcattttgaaaaccccaggaagcagagtggggaaaccatggctggacacgtctcatgaacaaatgggttgaatcccacctcctgcagctctcggttccctgaggctgcagcaagctcttatttggtctcttccttctcttgatgggttgaggatgcgatgggatagaaaatgcgggtagaatttgaggcccctgagggagagggtggaagtcgaaggtggcatgtgtgggaccctgaacgagtgttgtctttccagagctggaactgggtgacaattccctgctccctcccagggctcctgacagctcctccaagcacctgctgtggctcaaactctggaaacccaagtcctggctccttttcttccttttgtttcctccaccttccttctcccctttctcgtggctctttcttttctcagttcttgggatttggatccctgatttccactttctgtcattattgttgctgtgttgtttatattgtctctcaaaaagcttctgaattgcctgtgtctttggtttccctgaagaaagtgtatgtttgtgtgcgcatgtgtgctgtatgtgcatttgtgtatgtacacacgttttgcgggtgcatgtgtgcgcatgtatatgttttatgtgtgtgtatgtgtatttgtatagatgtgtgttaaaggacagcagaagcaactagggacccagtaggtagctttagctgtctggctgaacgtttctggatttaaaaaattctctgttctcttcagcatcgacaccatctttagcagtctacaaagcccttttttcccagtattcccctacataacacccccaccacaagatcccccccaccgcccatcaatcttaccagggcagctgtggttatctccatttttgagctgagtccctacagattcaggaagggaaaggtggctccagtcacactg

SEQ ID NO: 131872 - DNA, 1050 bp, Homo sapiens
ttaagcaaagttaatacatgcttgcatacatatatatatttatttattaatgatatgtggagaatctttgtgcttcatagtcactagacctaaagtagaagcagttgtcaagaatgtccaactgctattcatctttgtggccaaagtaaatttcagattttttttttgtaatggttttctttagtctctttattaacccatcatcatgacaagtctgtcaagtgacacatgtgaaaagcagatgtcctttcttattcctggtgcttcctaaggaggcagtgcaatgcaggagaaggaacattattagagataaaggaaaaaaccagaagtgctttctcctctcacattccactcaacacttctctcaccaaatgtgtgtggggatttctctccaccaacaaccagcagttctttactgcagattctccagtggataccagccaggtgtcctctaattcagttcaattctgacattatctactgggagatagtgtcagatcccgcaagtggagggctcagtcctacaagactaccccttacttcagatgtcagtcacaagcagttagcggtttgtgattctgaccaactggctagaggtccccctcctcaagtgtgattaatttgctagagcagctcacagaattcagggaaacactttatttacatttacccatttattataaaggatattatgaaggatacacatgaactgccagaaagacaaggagcataggcaagatactgagaagggtcacggagcttctgtgccttctccaggtgcaccaccctctgggaatagtcagttcatgtgttcagctgtctcgaagctcattcgaaccctgtccttctgagtttctgtggaggcttcattacgttaaggttcagaaatcaataccccaaaatatggggctttgacatgctgaattaaagaagcagcctcaaggcctcttggccttctccagctctcctcacccaaatcctgtctctcccaaagcacaagatgaggctgttcaccaaagttcccttatttacctagaaactggaccttaa

SEQ ID NO: 131873 - DNA, 1001 bp, Homo sapiens
ggaaaacccactctattcattgtcaactaaattaacgcttttttaaataaaaggagtcatttttaacaataacgtcagggcagcaggcatccatgaaatgtatggtcactgatcattagggttatcattctaatgtgtttactattttgaaactctagggagaagaaaacttatttttgcatatgttggaaaaatgtatcctcatgtaggatatcagggtaatatctttaatgtttcatacttaccaagataaatttgtaatgcgtattttcttttaaaattagatttatttaggagaaattgcacttggtgaaccactttctctttaattattagcattaactttatcatttttgtttcaagatgtcacagctattgttcagcactagaaattatataaattattagctgaagatgatgactggcaacatttatgtctgttcctcctcttaaatttcttgttcagaaagtctgttgttgtaaacatccccgactggaagctgtaagacacagctaagctttcagtcagatgtttgctgctaccggctattcacagacatcctcttgatataattctgtcccggagtggagttgaggaggctataaaatgtgtgggaaaacctcagaaatctttagctgcattcttttactgcactgacagtgcacgtattatgatagttgaatgtagggtgctctcctaataacaggatatgccgtctcgagcttcccagacttagcgtgctgctgctgggccttagagaatttagttaaataaaaagtgtcaccgcctattcctgtttctgccctgtcaatgaaattttagtctttataacctttccaagtaggctggagtttaacatcccaacaattcaggagactgattttctccattgtaaattctgtggaagttctggagaataatttcatcactaccacccagcagtatgcaatctagaaatttcagctttccctatacttaaaagagatgtgtgtgcaacatt

SEQ ID NO: 131874 - DNA, 1121 bp, Homo sapiens
tgtgtgagttaaatacagtggctctgataaaaatgtcttttgatcagtctttaaaaaaattaaactgaggacaggaaggtaaattaaaggggagatttggagacttgtggtaactggtttattgcaacttaatgtgcagcatcctcattagtcaagtatcatgtgcctacctaggcatgaaatagctatttttttcctgatttaaatctggaaagtttcagttgtagtacagtttgaatagttgttgttgtaaatagccactggactttttaaaaaagtatttttcttcaaaaacagtgaaggtcatcttgtatccatagagaccacatgtactttcctcattatttccagcattatttatataatgggtagagttatttacaacattaaacaaaaagtatttcagagagcaaccgttaaatattatcacagggtaaatatcagcaactgaaatccttttctcatagtttctcaaaaaatttggtattaggaaattaatagtctctcagaatttgtatattggttttcttcagtagttattctgtagagtgtgtgtgtacatatgcatgctcatgtatgtatgtatgttcatttcttaaatcatttcataaatcactgtgacttaattgtggactttaattgttttcatagtttttttccccaaaagaaggttactttacatattttattttatttttatttttattttttttgagacagggtctcactctgtcgcccaggctgcagtgcagtggcatgagctcagctcactgcagcctccacctcccaagctcagggatcctcttacctcagcctcccgaatagctgggaccgcatgcaccaccacacccagctaatatgttgtatgtttttagaggtagggttttgccacttagcccaaggctggtcttgaactccgggactcaagcgatctacccatccacctgcctcggcctcccaaagtgctgtgattatagacatgagccactgtgcctggcaattttacatattttaaattaaagcaaatcttggtttttgatggaatgcagatttacttatatttcacttagtctttttcctttctttcagaaaagtggtgtggaaacaaaatggttttagta

SEQ ID NO: 131875 - DNA, 1056 bp, Homo sapiens
agggttggagttcaaaacattaatagaattatactattaaggttgcatgtgatcactttgctgctgtgagagactctggatgctgtgtttgctggtcatttcaaaggctgaagagaaacagacatgcctgtccttgccaaatacattgtttcccctatcattctgtcactatggaagtacttgttttttctgacctgggaataatggtattgtggttattggcgtttttgttacctttcttactagaaattatgcagatatccccaattatatccagatgcacaccttatattccaaattttgttgcctgggattgactgagtacccttttgagttccctgcatcagagacgtgtttacagttgtgcttcccagtcttcagcatttatggtttcatgtttgtcaaatttgtttgaagtataaaaacgataatcttaattctgttactgatcattccttcattctctagctatttgtcacatcatctttcttttgaaacgtttagggaattaagaaattaataattttatactcattctttttccactcacatatctcactggctttgttcagaattaaattgtttttggtccctgtgtactatttccttctattaattaactgacggttgtttctctcttctgtgtttttgatgcttttttttttcttttactgtttaaaactttttcagaagatgtagcgagtgactcaggtgctagctagtgttactgatttcccccccatgttagttaataccatgtcaaatataactgaagaactctgttgtactcacagattatgcccctcatggtcagcagactattcagatacagactttcagggggaaggttttcaaaaaagtgtggctgcaatctgtaaatgcttttaacatctgcacattgcattactgttttcaaatgtttttgtaccacataattttatttaatattcacaactattctgtgagagctttattcttttatgttgtagggttttcttattttacagattgggaaactggtgtggagcggttaaatgacttactcaagattacata

SEQ ID NO: 131876 - DNA, 2032 bp, Homo sapiens
atatgactagcagccttttcatttgaaattaggattaccctctatttttagacgtatcctttaaaaatacgaattttttaaagaaaagtcctaatgttgttacttaatctctcacttttttttttttctttttactggaatcatctgacagaaatggcaatttcatttcaagagtcttgtcttatttttctgggccatgttctggttgtttttttcatcacaggattgtaacagtccttaaatattttagagattaaaattctaggtcaatttagagcataattggcaaaatagacatgttaccaaaaacagagatataggaagtttgggagagaagttaaggttcatattttaggtatgacctttatgctagtctctttctttgataaagtcatttaatttctttgagtcctagttcctcatctgtaaagtagagtaatatccacctcctgtggaattgtcatgaagttaaatgagatgctttgtgtaaagagcctggactagtgctgctaaatagatgcagctccctttactatatttttatttattcagtaaatatttgacactcactatatgccagacactgttccagactctggaattagaggagtgaaaagataggcaacattcctattcttacagagcctctatgttggctgttctgacagaagaggaagataaacaaggaaaggaataaactaaacaatttcagattgtagtaagaagtgtaaagaaaatcaaagagtgcgtggtaataaagaattgctgtggtgaaagcccacttcagactaagtagtcagggaagacctctttaaaaaggtgacatttgagtagaaatgcccttaggattttggagaaactaggcatgtgaagatctgagtgaaaaagtttcctggcagagagaagagatagtgcaaagcctctaaagtgagaaaaatgtgacaaattgagagaattgaatgaagcctagaggtgctgattgcaagtagtggagaagtcagagaggaccagctagtgtagggtcttacaagccacaataagaagaatggattttattctaggtgcagagagaagccactggagggttttaaaacagaggtgttgtgatcattagatggaaatgttgctgtggactttcagaaatgtgaacttagctgtgaaacgttagcaaactaaatactagcaacttggatttctagttggccaagaaacatgagggtaaacaatttattttccctgattaaaaaaaatcccagcaagtctctagcaaaagcaagtctaggttatctagagcaaataccattttatatctttttaattttactaagacttgttatgcaattatagatgttacagatgttttcaaaaatagtgctttgtggattgttttccttttatgagtccatgtggcaattgactagcatagcagtaaaaagtacaactctggtttcagatacgagcatgatgattgatcacatagaagcattaagttaatattaacaaggatctattgccagaatatatttcattataggattttgaaattatttagctgaatggaccttaagagttggtcttttttcctttatagaagagggaacttagattcaaaggggttaagtgattcacattatttaaacatttaaaaaataaacctggattttactattcttctagttgtaggatgacaggttcttgaggcaaaatgtggaatgagagaagatagtgacatctgtttgctttgtatctgctgccttctctgttgctcatttattttacatctatgctgtttcacacttatctttggacttagggtattgggatgtgtcaaacagttgctcccttagtgtggaaacagacaagtaaacacagttgctacacaagttgcaggcatcatatgataaaggcaagcttagtgtgttgtggagggcatgatgggtgtgtctgttaagtgtccctgtttagagtctgtttacatacagagttgaatgtccttggcttctcatttcaatttaatatatattatattgcc

SEQ ID NO: 131877 - DNA, 1280 bp, Homo sapiens
atccctttctcttttgggaagcatctgttcaaatcttttacccgttaaaaaaatctggttggttgttttcttactgcattctgagggttcttatgtataaatcctttatcagatttatgatttgcaaatatttttccagtctatggtttgtctcttcattctcttaacaatgtcttttgaagggcaaaggttttaattttgatatctaatttatcagttcttttatggattgtacttttggtactgtatctaaaaatgttttttttgcgtaattcaaggtcaacaaaggttttctcctgtgctttctccctgtagttttaggttttctatctaaatatagtgatccattttgagttaagttttgagtatagaaaacttttctatctggatgttcttaagacaccatttgttgaaaatttatcctttttctattgaattcccttttccccctgtgaataatcagttgactttatatatgtagtagttctattttggactcgattttgttccattgaggtatttgttgatcttgacaccagtgctgcactgcgttgattattcagtgttgaaatcatgtagtcttccaattttctttttttcaaagttatttttgctagtctaggtattttacatttccttatgaattttagaataagtgtcagtttttttaaaaagcttgcttgacgttttgattggaattgcagtgaatctgtaggtcaatttggaaagaattgacattttaaaattattgagtcttctgacccatgaacatggtatagcacttggtttagggcttcattaatttctctcagtaatgtttggtagtttataggatgcaagtcttttatattttggtctcgtatatgcctctgtaagttgggttctgcagagaaacaatcaataagggtgcgttgtgtgtgtgtgtgtgtgtgtgtgtgtgtgtgtgtgtgtgtgtagagagagagagacagagagattgattttaagaaattggctcgtgattgtggtgggtggcaagtccaaaattcatagaattggcaggcaggatggaaccttaggcaggatttctcttacagtcttgagatagaattccttcttccttaggttatctggttttgctctgaaggcctcatttgattggatgaggcccacccatgttatggaggagagctctttttcttaatgtcaactgattgttatcgttaatcacatctacagaatagcaatagctagactagtgtttgatcaactgggcagcatagcctagccaagttgacaca

SEQ ID NO: 131878 - DNA, 1049 bp, Homo sapiens
agttccttattaatcagagcttttgtggtgtgttggggggcggggggggggggtggtaaatccggcagttctcatggcgtttcattgtgattccttggaaattaccaaatctgcagatacatttaatgtcttgggataatatttttcttgacctataaacatgaattaaaagtgattacttttcttttgctgtctccttcctatcttggactttgatttttcttttaatccgtatccttcacagattaaaagatcattcttttttttccttttttttttccttcacccccttcctcttccccttcccactcccagaccgattcaaggcaggagtaaaacaattatgtaggttatctgttagcagttttattgcaagtaagtaacctggcttttgtttgttgttgttgagaatgtatttaagtctttttattgtccttaacactttcggcaagtctctatttttattgaaacaattttattgacatatagttgttatacaataaatggcatatattacaatgtgcagtttgttaagttttgacgtgtttatccatgagaccatcaccacagtcaagacactaaacatatacccccaaaagttttctgatgtcccttgataaccctcccctgcattctctaggcaaccattatctgttttcttttactttacattggcatgcatgtcttagaatacaatatgcactccttttgtctggctactttcacccagcattatttggagattcatccgtgttgtaccatgcaccaatagttactctttcttattggtaagtagtattccattgtatggatataccacattttgtgtatccattcaccttttgataatctatttgggttgattccagtgtttgacttttaaagtaaagcttctatgaatatgtatgtacatgtctttgtatggacataaacttttcatttctctgggcatacacctaggagtagaatgactgaatcatatggtagctatatgttctatacctacctagtttcttcttaaactgccagtggttttccaaagtggcagt

SEQ ID NO: 131879 - DNA, 1046 bp, Homo sapiens
ctctatccttgtgtttatgatctggtgtataaatactaccaattactaggcacttttcataaggaaggcactgtggtagactattatttcaaaaatatttattgcttctctctatcagggttctttctgtagtcggattatacttcttattctgttgacatcaggtttgaccatttggctttccttgaccaataaaatgttaaagtgacatgtcccatgtttgagcagatatttttcatcctgtggttctgccagtggcccttgaccctctgtcatggaaccagcatgacttagctatggctggtcccagaataatggagcagagctgaagccaatctgtgataagcatataagtgtgagataaatactgtgctgtaaggcaccatgattttggacatttgttaccatagcagaatatagttcaagcgatgatactggcatcactcaaggtgctgtatgatgatgataagacttgggcattgtcctaaaggagcttacagtcttggtagatgtattacatttccacaggttattgggagttgaggaaaaggagagtaatattacataaggatctttgaagttgaggatctttcctgacctccatctcatccctaggctgaatcagtcaatatgttttaaaccctgggtttgtgatccactactcactgtcacaacctcttattgtccaaaatttgataggcatattttctatgccctcattcaaatcaccttttttaaaacaaacatttaagaggatgaacttctacagaattgtgattataagcttccttcataaatctattaatcagcatttaatagcaagctaagaatatacccagttaaactgtttctctattatccagaaagatatcatgatgtcctagattctatgtgaattttatttgtgagcatttaaatttcccattgtcatgtctatgtgtgcttctcactctgcatgggattttaaagaaacaaaaccttggctgggattccaaaaggaatctttttttttttcttccccccgtgagaagctaaggaatacatac

SEQ ID NO: 131880 - DNA, 1021 bp, Homo sapiens
aatattaacaaatttttttctcaacagccatcgtaggaacttttaaaataggttttgcatttcccctgaaaatggtgagttaggtcatattaggaaaaataaattctagaataaatacaattttgattaaaccggttttctctataaaaacccaagacgctgtatctatctttaatgttatctattgttaaaatttcatttccctcaacagcatgcatttccatgtttattagaccaaacaacttcttgttttacttcttacctttgtttttccttgttgttgttatttaattagaaaagaaatgctgtttgggccttttcatatgcctcaaaaatgtttggttacacagaggagtgagttagatttataggactcacacccaatttgatctcctcaagtgcatttctaaccatgttttcatccacttttccttgttttaggtttctcatagaaacagcttttcattgagctaaatgtatttcctctcttactcgttcttggaaatctaggactatgtatgtgaaacttcttattcttgtacacaataactcttaagtatttgaaaatgactgttctacttcagtcttcttttttgccaaactgagggaaaaaattcttttttttttttttaaaccgcatgcatgtgacatggtttacagacctttccccatctatatcgctctactcatgacaaagtttttgtcagtttacctctgaaaatacagtggccagaactgaactgactacttccgatgtggtctgaccattgctgaatacagtgaagctattatctaggatactgtgtttctattaatgtagtctgaaatttgcattgcatttttttggcagccacattaccctttgatcacattcagcttataatcaactaaaaccttgtctttttttcatgtgaattactttaagtctaatctttgtcactctttacttgccagttgatgctttgaaagtaaatgtaggatattatgtattgcattactataaaactttaaatgaatttat

SEQ ID NO: 131881 - DNA, 1047 bp, Homo sapiens
gcactgcactgtaccagttttgaatattctgtgtccataaatacactagtatttgtccaaccatgaattctgacttttaggttagaaaatgtgttcatttaaatgatagttttaacttgagtgaaaaagctggtaatttttatcttcttttttctgtattataattttttgtcattaattttgaagatctcatgctatatgattagttctgtatatgactacttctgtaattgatgaacaactactagaatgaattattgtacttgagcacttagaatcatgtcaggagaggcatgaagtaagtagaacatatttgtgtagagataataattttactttctaaagcagtgattttgaaactcttgctgagagtgtgctggaggaagtcaagcatttcatcccggtttcaaccagtgctgttttattttgattaattttaagcgtggaagtttgcatagtatttcagttgagcaaggttctgttgtttaaaaatacgatagcctctattgttaccatatttgctcttatcacttgcctgcttaaatccttgctatttttttattgttattacgactgataagacttttctttccctagctccaactttattctttatctctgatcactttttcctttccatgtaaaccctgcattctaattctacttaaattgtttgatgttccctgagaggaaaatgttatttttacatctgcatgccttcgcacatggaactgccaccattctcacttgagctaggcagcactcaattcccttggaaccttggtcatctttccataaaagcagttattacattgttttgtaaccgtggcctcccttgagagcagagaccatctaatttatcttgtattcatactacttggtgtttattcagtattcaaatgtctgttgaattattgcatttagaatttgagaagtagtaaaattactttaataaacactaatgtgaataaaatatcccagatctagttctgtgcaaaagagttttagtgacagtgtccgacattatgctaaatatataaaaggcac

SEQ ID NO: 131882 - DNA, 1013 bp, Homo sapiens
gagttttagtcatgggtgaccctataaattgcaatttctttttctccctaaagggttttctttcactattacatgtttgtgttttcctgattccactcatgctactgttaggtgttggatcatcttacctatagcgtcaatacaaagttcatttgtaaaaactgttccgtttattttctcccagctgtttcatctgagaattttgtttgaatttcagttgccaaatgtagtttaatcggttactctaaatagaaaggttattgcaattttcacaaactaggggaaatataaatttatcttaagtttatgaacatttttatattcctgtggggacaactaagcacagtatgtataatttaatatctctgttggcatttgttctaagttaaatttatttgctgtattgttaaaatcaatgtagtaaggtgtacagtcttttaaaaacaaatctgtttctctgtggaatatttttcaaaaggacctgaaaaacatgctcttaaatagatggagtggaaattttactattaaagtgaatgtatagttaaatgtgtgatactggtattgttttgattgtttttattttacatgtgaggattttttacatgtttctgtggaactacttttaagtaggttttaattttgatttataaacaagcttctctaaaagaaaaaagttgttttgttcttcgtgattatatggtagtcctcagacttttgtagttgaaagaagtagaaatgagtgatttattaagctgtttatgtaaaatgactagttggagcaggtgatgtaatttatttttactataatgtgcagagatgtctttatcccaaacaaatttatagctgaatcgtttgctattttttgcaaatttagggaatctggaatgtgcccagaaatgaactgattgccaagtgttcgattgagtaaatatcatatggaaatggttttttgcttgtaatgacatattgttactgattaaggaccatttcttttctttttttttttttttgag

SEQ ID NO: 131883 - DNA, 1037 bp, Homo sapiens
atcccgggcccggcggccggcgagcatggaggagaagtacctgcccgagctgatggcggagaaggactccctggacccctccttcacgcacgccctgcgcctggtgaaccaaggtgaggcgccggccgttaactgccggccggcggcggttgggggccgggtggaaacgcgggggcccagggggcccctccgtgccctctgctgtcagcggacgcggcggagacggaggcccgggtggcccccggggtcgtttgcacggggacctgggaggctgtgggacacctaggggaagaccctgatgtgaattttggggacttggaaggagaaggctggggcgcatgggtgagacttgaaggaaatctttggggactcgggcacacccaggggaaacttctgggtgggggacagcgaccatctgggggcttcgttgggaacgaggttgaattatgtcatggaaggggagcgtgttggactcggggaagtagggcgtttggtttgtctaaggtactggagaaaaagctggaggaaaatggaaggacttgagggactcaaatgcagaagaggtgaagggaacaggtgcttgcattgttagcgaagtttggggaccttggaagagggttggggtcagaccccagcacctgagaggagaggagctccgtggtcccaggggaggagcccagttccccctcccagccctttgtctctcctgtgtccaggctccaacagccctggcggggcagtcagccctcccaggggatgggcagcccatgccaagccttgcaggctggcccttggagaagtcagtaggggagaagaggccggcaaaagagcaccgttccggagggcgttgggttgggtgaccctcattggtggctggcttgaggttcggaatagtggtgaagggagtccttgccattttcacacgactccagccagctcagggtgtgaaagatcctaggaagtactgcgggtcagggatacagagatttctggaggcacgcctacccgggacagtgttcccctggctttttcctcct

SEQ ID NO: 131884 - DNA, 2238 bp, Homo sapiens
gaattactgtgcactgacagtctgtggttccctagatgaatcggatctgctgctcttagtgctcgccctggcttttttattgttggaagtgaaagatgaggcagacatattctatttgtatatagatacctatattttaaaacagtgacctccagtttttgcctgtttcaaccagttcttcagagtagagtgtgtgtgtggttgaccgatggtggaggagagactctttactgtctccaagaatttaagaatatttgaattgttgaacagaaatagacttatggagctccctcattttattttaattgcaggcttatttttatttctttaataaaatgggcttgtgaaaaagtgaatgggcatgcattcctaaataaaagaaaaaaaattaagttttatttctatgccctctgaacagttctgcagttgagtttgtactcctgtgcctgatgatttacatgtatcttttattgcctgctgggctgtcatctctgtgaaagaaatttcttcatacattgcatgagatccgtggcattggaaatattctggactgtggactcaagtgcatttttcctaataaagtagctgaatcaaagttaggttgtactcaattaaggaacagttaaactgaaagtacagtgcgttatcttattttaaaagtcagaattattttctctgccgtgttgccatagtattgtgttgctaaaacgtccaaaattcttttggattctgtgtttttaccagtgttaatggcttccagttacttgaaacagatatttactggggaaatgttgccatttagtgttttttaggtattcaacttgataaacttacttttcatagaagtaattcttataagaagtatatttctcacatgtgaaggaaggaggaggtgctgctcagaatcttgtcttactgttagtttagatgacttcagactgaaacatttttctcttaaatcacaggctgatattcggaatgcagagctttatcatttaaaacattaattacacgcttatgtaactgcaaaattacaagtgttttaaatctgaagctacatgattgtgaggaagctttgattttaaatccaaccatcttgttatgggctattttttcttatttagttatatttgtgtttgcctctaatgcaactgtgttttcagcagttattcacattggagttggtatttcagcactaaattgtagaatgggccagcatggcaaaccttagcgtgccatgtaatagatatgttttatggtatctctaaactctaacaaggccttacatttgcatagtattttaaagtttccaaggcactagttttgtcctcacacttgcattccggtaaggcagatgttcatgtcttctcttttcaggaaggcagctgaggatcccagctatctaagcttttgggcaactgagatttaatttgaaatctcaggtcttctgtctctgaagaggttgttctttcttattttggcttcctaaaatgttggaatgaaatacttctcacttgctaacttcagaccctgcagaaatcaatataattagtatgattgtttccaactgacttaaatgtgtaggaaatagtatatatcctttaggaagtttatcctgatttttacagaaagtttctgtctgcacttgccttctttgaagaagcaaacattcacggtagatttatcttccaggattttgatgctgaggccaagaggcagttttgaattaaagccctcctgtgactagtgtattagtttaataatcaatgcattatgataatgaagcagtttatagatgaggtgtagtcgttctttaaaaattcagtgttcgtaaagattgatcaacttcctaactgaattactctttttctttcttgagctaggatgacaataagagatatactcctgtctggtatacattggcttttatatttttccagacttgtgtttcatcgtgggcactgattgctgattttattttcattttaccagaataactggttctcctcctccacctcctaaatgaatttgtttcccgaatatttatttatttatttttttgagacgaagttgcccaggctctgttgcccaggctagagtgcagtgacacaatctaggctcaccgtaacctctgccttctgggtttgcgcgattctcccgcctcagcctcccgagtagctgggactgcaggtgtgcgccaccatgcctggttaatttttgtatttttagtagagacgg

SEQ ID NO: 131885 - DNA, 1666 bp, Homo sapiens
tattggacattagtaacaggcttatagagaacctgccatgctggttctctgtgttgggtcccaggggtagggaggaaaaacagtctgcactggtgagaagctcctgctctcctctgtgtgcgtttgagaatgaattttcggtttgtagatgccctctttcctaaggaacatcttagtccttcaactatgctgaaatatttaatgattggatggcttagatttactgttaataaatcagcttgtggacatttttgaggcacttgttggtactgggtcatgtttgtaatctcgatactggtaacagctcagagatggagaggttattagcctagtttttcagttgtagaaaccaagattctgacagctaaagtgacttgcccatggtgacatgcttataataaaatgtcagagtgaagggtcaagctttgttcttttacaggtccattgttctttttaccatgtcctactgactctcagtaacactgagagtctaaagggctaagttactggccaacctgtgatggtataattagtgaatgatagaaggagaatcaaaaccctggcttttttatgtgcagtttgtttttcctctagcctgtgctgaattgaaagataaattatatagcatccattttcatacttcattcttcacatttctgccctaagataagtcctctgacctttttcaaaatgggttggattgcctgttttctggtgtcacataacacctggtgctcttacggtgtgatcctcatcacactgctttgtttggatctttgtctttcttggtaaagagtgagttcctcggaagacagggcctggtctttcctctgtatcttcagcacctagcatacgtctgagcacagggcccttgggaactcctgtcttcatttcagtgttacgtgttaattatcattaagggtagcagaatcagaaagtatatttggaatttagcagtcagtaaagagctttgcttcttacagctttagaggacctgaattggaggtggggatgaagtcaacagttctgcccatatcaatgaaagaaggttctgagtgaaatgcagggttgaacaagcagaaaagcatcccagtgctctttaaatgtggttgcacagtagggatccttctctaggagataatgagaagatgttgtcagatctgctttgaatcagatgtttatttacttttattctttcttaaggaatttatgaaatcactgcactctcatcaatttgctctccttctctaaactcctaatgatatttctcatgacagattaaaaacagaattttggaagccctagtcacatgccaaataaggtttcttacctgagagagttatccgcagtttcagatgccaaagggaaactccgaaagccagaggagcgattgaaaccgcaaattgagtgccaacagcaactttgatatcaaaagccccatttgcctgttgtcaccagtcccgctgagtgaagatagaatgacttatatcttctaccaaaacaatagaaggagagtgttccttggcgttggggatgatgattataaaagccaccaatttgaggctcttccgtgccagctgctttctgtgcattctctcccatccccgcaagatcttgcaaggtaggaggttttattccctgcgtgcctcctttatttttttcaaat

SEQ ID NO: 131886 - DNA, 1025 bp, Homo sapiens
aaaggacagaactcaacattgttgtttttaaataaatgtttcattatagcagaagcctcttaggaatttccattggtgatgaatttttaaaaggggttactgaaaatgtgttttaccaaaaaggcaagctcacttttttttctcctgtgctctccggcagtcttcagtaggcattcaaagtaaggatttttaaatatgtatatatttcagtgaccaaaaagaaaatagaaaaatattccatatagaaagccagtgaaattcttgctgaagttctgtctcttgagggagcctcctagaggtgcagtgctctttgtattttaatactttgcttatcacaaaaacagtcgagagtatgatatcagggatttatagtcagtttatggtatatttgtgaattcttcattctctaaaaataggttcacaaaagaaaaaaaagtattcccacagataatgcttttggctttctggaaggggggaatatgtttaaatatacttgccctgcagttgctaatgatagtagctaccatttatcaagagccttttctggtttacgtgctttatgtatgttatttcattgaattagtttaacagtcttaaaagagtaagtcattttaccttattttatagatgagaaaaccgaggtcaggaaggtcacataatttgcctaagaacacatagctagtaactggtgaatcaggattcagatctttgtctgcccaacactatgacactatgtagggcacctgttagcatcagatagaggtggaagctttgagtatgtcttgtttttcatgttttacttttgtggggaatttggattatgcagctcttcaaattacatgcctagtattggactgggtgagcagggcagttgcgtaccatacagagggcacacaggggcatggcaaaacggcataggaactttctgaccagtggcaacatctggtaggtagcatttacttgggaaacagtgttaactcaacaaggaatgagctggtgcagaaagagccatgtgattacaggtg

SEQ ID NO: 131887 - DNA, 1037 bp, Homo sapiens
attattttagttttccaatccaggaaatattgaaggagaaattcagtctttaggaagcttctttcattaatatcatgcacaaaattagcagcagctctgattgatttttattatgctattcaagacacagcacctgaagcttaaattaacaaatgaagcttccataaacagttttaagactgcatatcttaaaacatgtctggacacccagcagcctctttccacaagcacaagataccttactctgaattggtaagctgtaaatttccataattttttacatttccataatttttcgtcaatcagcccctgctgctattttaagaattttaaaaggtgctcctagcatattattgatgttcttcgttgatatgataaagggcaagagtatgtgagggcacccttttaaatgtctgttttcgatatatatcttacacttggggtcactgttgattcgtgctcccatgggagaaaatatagaaattatgatgaagataaggggcagttttcattttcaacatttttccttgttctttctctgcttcaatgtttgtgccgtttgtgctctgcttttcttccactagatggcgctccacatagctaggttaccttctttctttcgcattggtagctatttctgaactgagtcttgatcaataaacgtgcattgcttttgattttcatgcattggtatttttcatattattgatctcttaagaggcatacttgctaatcaatatttgcagaaagccatgcctttttttgtagccaccattgctcaagcgcctgaggtatgcctggcactgtagctaggttcttcacacatttcttcatttaatccatgactttcacgtgaatttagttttgttgttctcattttacaggtaagaagtggaggttagagggatttataacttgttcgaggtcacaaagctaacttatattatagggattagtgtgccctaaagaaaagtatactccaaaaacattaaattgaaagcttttgtcaaataacttgttaggatagtctgacttac

SEQ ID NO: 131888 - DNA, 1073 bp, Homo sapiens
ctgggattacaggtgcccgccagcacacccagctaatttttgtagttttagtagagacgaagtttcaccatgttggccagggtggtcttgaactcctgagctcaggtgatctgcttgcctcggcctctgaaagtgctgggattacaggcgtgagccaccccgcccagctgggttttgcttcttaaatgggcgaaggatgtgttgctacctgtggaaatagtaagcttgaatagcttcagtttcttcatctgtaaaatggtcatgagagaatctgtgtagcatgtctggtgtatctgtaagtactcaaaagttaattaggtgagtaggacaagttttcttgttttcctccttcatggagcccagcatggaatactaggcccagaattgatactcgttgtatactccttgaaatgttaacttagaagaatgtgcgtgaattcttgtctcacctgtcttaggtagggcaccatgttacttccaataaaaggtccatggcagaaagtagtcttttaggtttggagagtgaacattaaggcaaaagagtagcataatctattcaggcttcagacttttagaccctttcaggaaatcactatttatagacttctgggggaaacacccctaagactggttgggtgtctgtttctccacagtctttcctactggattggagaagttgctgttatttctccccttgttcagtaaggatcacatgcttaggctgggctaagtgctgggatgcagagcaagctaatactttatccctgcttaaagagtgttcagctcagtggggaagtggccaaattaaaagacatttatattgtggggtggaagggctgtaataaagacaagtgcacacggcactgtggtgctgcatggagctttgttattccgatctggtgagggagtgggcacttgtgtgtgactcctcacatagtggtagaaacgtcctgggctccagagtgtgatggaactaatgcaagttcacttctcagagtctctctgcttagtattaaaccatggcatctctgagctcgtagggctccctgtctggcttacagtgtgcagtgaat

SEQ ID NO: 131889 - DNA, 1057 bp, Homo sapiens
aatgcattgccctgactttgaagttgtggctgaggatgagatcactcagggagtgtgtggaatcaaaagggaaaggacaggggagggatccttgtggctctatcaccattgaaaggttggtcaaaggaaaagaatccctcagttcttcctttccttgcttacttagcatgactaaataaaaagtttactgaattctgtaaattacacctaaaactgtttatttgaaaagtttttttttttttttggtgatgcattttttaagtaggaatcttaaaactcattacttccagtgatgcttacctgcatgcttcttgagccataagctgatgagaatttggaggagagacctttggtacagagagctcagcaagtgtggtggagtagctggggtgtcacaggctcctccgtccggaaagcttcctggctcctcaaagcttctcttcattggtgaccacgtggcttccaaattgacttggacttggttcacactttccatttagacgacgcgctttgtggcttcccatccacaccagcacatgcatgctgaaactgctgctttcgttctgaatgtttttggttagtgttgctacttctggtagtggttggacttagatcttcatgtcctgaatatgaatcctgttgcttgatgagggtctaggtcatgcctcgggggtactctgaggatatgtgtggagtgcagagacaacattctagacagatatacactttttattattaacaaactttggccacaacctttgatgtataaattgccggatttccccagtcctttcattgtggctttggacaggagcaggctcacttgtctgcttcaggctgcctttctcttgggttgcacctcagttcttacttatttatttattttgagtggagcataggggcctcttccaaaatgggtagagctcaggggctttcttattgaaatggtcacatgataaaaacgggctgaaaaaggagagttccaggagaaaagcccagaaaagggcccctcctcagaagacagcctttaagcctcttgcttactgaaggaagcccc

SEQ ID NO: 131890 - DNA, 1053 bp, Homo sapiens
agactatataatggctataattaccttcaggagtttaaaatggaaaatcatgttttcctgtttagtgattttttcatatcattaattgaagaaagtatatcactcatcccagaaaatcactgcagctgctgatagacttagcccccaaaacatggatttcaagaggagatgaaagtttagctcagaggtcagaggtcagtgagagaaaattcagttcattgtgaggtgtcataagccaggatttggtagtttggttcttttttttttttgtaactaaagtggttagaagtaatagagtggagcacgtactgtgcttcatattgtgtctcttaaagttttttgtttccaaagaatagaaactgactttggccaaacaacaaaacaaatttatcagaaggatttgaggaactcctagggctgatggaagacaatggaagtagttttttaaatgcgagaacagaggctactctgaagaggaattatctggaaaggaagcagaagttcaccttactctcttcagggaaggcagttagctcttaactatgggccttggctgggctgggtgggaagaggcagggagctctgaagatacttcctagaagaaatgaaaaataaagctcagaaaacttgtggtttagttaaggtcactcaactagtttatgacaaaaaccaaaagagatctcacatctgctgatggtttaagattcttttatgtattcatttcttcatctggtacttgccacactccaggtgctctgctgagggctggcatttagccacgagtaagacagatctaaacaatttatggtaaatgctacaaagtagtatagggtgaatgcttttgaaagatgagtaaaatgattaactaggaattagtggaaccttatattaagtatatcgtgcttgaattaaatattctcactaaaggatgtggtgaccattgttttagccaaaaaacatggaccttttatcagatacagattcagtacctacttgttctacttaacttgatagggaaaaaaatgaccctcctgcatttgtttccttcctttg

SEQ ID NO: 131891 - DNA, 1001 bp, Homo sapiens
ggtgacagaggagcactatattgaagcacagaaggcatttggggaattacaagccatttaatttgactagacagatttttatagaagacataaatgaagttgtaagggagcagaatgtgggtggcattggccaaaggtcctgcaaagttaaagtagagaatgacatttgaactgttttagacgatgaggcttctccaggtgcttaatgatggcaaactatttcaggagagggaatgccacatgcatagtcatgctggagtgaaagaatgcttagggaccattttaaaaagtgagttgtaatatgacattaaatacgttatatctctatgtataatgctctgttttaagtgtctgtgctataatattaagtgaaaaaagaaaagtcaagatacagaaaatccagaatccaagttggggaattatttgaaaaagcgaaccagaatcttaatagcagttgttttctggagtataggttttcgtgatatttttctactttacacgtttctgtacatgaatgttttaataacttagtgtaacctttattaatataaaaacattttccattttttgggcaaaatgtgcctgaggtttttactcaggaggtatttttgtactgtgattgtgattctcaaggtttagtgtgctatgttaagtctataagtttaaattaggtttattaaatttattaatttgataattgtccttttagcctctaagcattctcatctgtgtacatactatctgcagtaactttgtcttaaccagcaaaagtttcttctgttaaaagtttttctagaatctgaatgttgggaatgtgatatatttgttctcttcatataaatggttaggtcaaggatctttgagagataaaacatgtctgttcctggtgtttcagggaaactttcttttttgaagtgggcttgcattttttccttgtagtatgtcatagacaatttaaaaccctttaaattactacttggtagaagcctattccatggaaa

SEQ ID NO: 131892 - DNA, 1051 bp, Homo sapiens
tgagggaattgtttcctttaaataaaagtgtgcgtgcttagtgatgggattcccagtattctggcagctgggcttacacctcctcttaagagattgaggagtttctcttcagggaagtgcctcgcccaagtgaaacgaaatacagatactgatatttcagtagctcttgataaaataactcagctgccatatttgcaatgaagactgctgttgccaagtcccatgtatgaaaacagaacttccagtcagcaatccggaatttttaagaacagatagtagaggattaccagacatctgaggaaatcccataaaagagaaagagaccagctcacaaaatggggaaggggagactcttggaagaagcagatactttaaactccaaggcggggacaggctgctgtcatcaatatcttcagaaaggatgagaaatttaattgtttccacaaagtgtaacaaaacaccataaagaagaaacagctgtaagacagtcgtattcgtaaatatttgatagcaaaaatgaaggaatcagtaggtatataggaaatgtatttaaattctccagaaagtaaaacagagagacacaaacaataaaagagaaatttagagatagcagtccatctcaggatgtccaatgtccaaataataggattttcagaaagataataaaagtaaatggggagctagaatcaggtgggattgtatgggtcagtacccagtcccattcttgctccccatttactccactttttcactctgtagtagtattagactttgtaaactctgcaagtataacttttatgtttaaaaatattttactgaaaatggcattttaacaagcaaaaaataattacatgcaaagattaaaaatatatatttgagttttggttgaagaccaataaaattaaaagttggaaggaaaaaataccacttagattttttaaagtgctaagtacttatttcaggaaaattacttcaattgccatagttaggtaaattgaggaacaattttctctcagaaacagcagcacagcagtggcatggatcacggaag

SEQ ID NO: 131893 - DNA, 1042 bp, Homo sapiens
tggcacagagaccgtggaacttccctgaactcatggagagtgagtgctagagctggcatgtgaacccaggcagtctaagcactctgctatactacctctctatgtaactgttgttattatgagtttaagtattatatccagaaactattatagtcttttctgagaacgtctccagtcaataaaatcccaacaaataatctgaataaaattatgcatgccattttgataccttatttgtgcaataaaaagttgttaaaggctcatttaatttagattgtttagagtcctaaaatgtgtcagaagcacagacttgaggacagagctctaagttacttgttgcaggttgacttgtaatggagaatgtcggtgcctgaattccccagaatcgattcatacctcattgttagactcacagctttagaaactgaaataatattcagacatgttgtggatcatatttttcccttgtatttgtcatcatgaagggatatgttccttttggaaggtaatttatgagtgtgcattgagagccttaaaaatatttgtgacttaggagccaatatttttgcaataagtgcctgaacttacaatataacagtgagtgtctgacagtgcgaatatatttaagagccctttaattgaaaagagtaagcaatttctggaggagttctgggaaggaggaggttaggtgataaattcagtttctcaacctgttggatagatagtaatataattaatttaagtggcagtgagatttaggaagaagttaataggttcatttgggatgtgttgaatttaggttgtccacagaattgtaacaattacattaataattgatataaaaatggtttacatactaataagtcattatatcaatggtaactatatttctctcctagtttttcttagtagttacaaaatgtattatggttagatttttaccccaattttagtaagtaactgagttgtagttttattttttgtattctctttcattgatgtcttaaagtatgtgtacccagtgttttgacatggttaatct

SEQ ID NO: 131894 - DNA, 1050 bp, Homo sapiens
tagtgaaaaacaggtggtgttgaaaaaaaatctacacttggcattcggagtaactagacttctattctgattccatgtattctagccatgtgacttagacaatgtctaaactttatgcctctgattagctgctttcttattactaagccagaatgaatgctgttgttctgcttggaatgatttttttcttcatctttgtctggcttttctgttgtcaattgaagcatttcttttttcaggaatcttctcatgtcccccaaaactggttcaggtatcccacctctgagttcctacagaactctgggtttctcggtatcatcatgttccattccccggttgacacttgtctcacttgtacactagactcaacatggtttatcacaaagaccaaatcttgttggctgctgcattccaaggcccagcatatagtgggtgctctgtaaatatctgctgaacagatgtcgaatgaaaaagatggtctctgaacctcctaatttcatactaagattattccacaaaacacagtagaagtggtgagagcttgttttcttaaatggcagaaaaatgttgtttttaaacctaaatttatgaaatagacataagagctttattgcaactttattttaaagacgaaagataaattgcatagaatacatggcttataataggtatttgataagtgatatctattattagtgtgatattaaattttatttgcatgtctttgtgtctcatgtgactgtgacctcattgtctccacatgcccatcatctagcatcagatagtagtagttgcaatagggtcatttctaaatcagtcttgccagaaacttccagggcacatgcttccttattgcttcctctgagtaatctgtcttcctgagttttcttacacagaaggttgtactcaagctttgtggagaataaaataagagaaaaaggattctgagtgtctcatgagagattaaggttaaacacaaagcaagaactttctggcagacctgttcgagggtattactgtgacaggttattcaggtttcatccctagaag

SEQ ID NO: 131895 - DNA, 1044 bp, Homo sapiens
tgatcaccagccagttttttaaataacagagttttgtttcgtatgacacatcaaaataggttctttggggttaggtaatacaatttaaaatatatctgaaagttcagtctcttatcaggtgacaagaatgcaaggactctgccagggtggacccctaggaactcataggttaatatttgaggttttatgtaaaacaaggcattgccatgctgaaatcactccatgaatatcataatggatagtagtgtaatcatcattaaaccagttaatcatttgtctgtctttattgaacacaaatattttatgtccttaattttaacgattctgttttgcattgttttccataaacgtccttatttctattaagtgtccacttgcctgaatcctctaaaccctgccattcccaacagagcatatggttattattaatttcttgatatatacaaatatatttcattttcctctctttcaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctactttaaacctagaaaaacaaagtcttgttatttcagcacagctctaaattgtatacacttgaaaaccatgtacagctgcaactcactgcaagaagtcaagattctacacatattccacatttgaaaatgatttatccatctcagttatggactaataaatatgaaagtattatgcaaaaagtattctgtcacataaaaggttaattataaaggcttctgcgggaagcagagtggcactgtcagaatagaaacatgattttcatgcctcagtgtaatttgttatggaac

SEQ ID NO: 131896 - DNA, 1023 bp, Homo sapiens
caacatctgcagacctggcagctcctgtcctgttccccttgtaggtgaggaaactagagcataggaactcatcactttcctaagttaacagttaataggtgttgaaaccagaacttaaatccaggcctctgacacccacgtccacactgttaactatgcttgaaggcaaaggtcttatctcggtcccctttaggctcctcctcccacatccagaaggatgatgtgcaaaatgtaggtacttggcaaattattggtgaattgataaattaatttatgggtgatttgggatctaaattgaaatgtgggtgcatgcgcaaatctggggtatagttaggatgagggtctgatgtggtttgaagaaagcatggtagatttggacaatgctcacatggggagggccatagtgttataatcacatttagagccatggtcaaggttggtccgggagtggtcgtccttgaaaggtatataatctgagttggtggctgtggtccctgaatattgggctgagtgggatgatgggctgcctgggtagactatagcatggcccatggaggccaggtggcaggagaagcctgcagtcaggattctagaagaagcatgattcattttgtaccctagccctctccttcctggcactgacctccttgatcttatttttctctctttctagggggatcgaggagctcctgggatccctggttctcctggcagccgtggtgacccaggcattggggttgctggccctcctgtaagtctttatttatccagctcttacttgctttcaggacatacagccatttcctgttggacctgcctgcagaaacactcttttctttctttctttcttcctttctttctttctttctttctttctttctttctttctttctttttctttctttttttttttgagatggagtctcgcagtgttgcccaggctggagtgcagtggtgcaatctcagctcactgcaacctccgcctcccaggttcaagtgattctcctgcctcagcctcccgag

SEQ ID NO: 131897 - DNA, 1005 bp, Homo sapiens
cgtgacagcatgctccaaggaagatgcttgtgatagtttaacccacaaaagtaaaccagtggcccccacttttcccaagaaacaactgatgacagaaatcccctatccttcccattgaacaatcctttctctcatgaaatattcccaaaccacttgtctgcccctttgtatccagccaaggatggacaggtatcctggaatgagcatgtctcccgccttccaaaaatcacccctaaatacaacacttgccagtctgagactgtctcagtgtttcctcttttaaccctagaaataaggttgattctccaactaacatcttcgaaccctctgctgaaatgaaagcaatggcagcctggtctccatcacaagtttaagaatgaacagcccttgttcattttgtcttggacccagttttaccctagatgaggctctgagaagcagcagtccctctccctgcatgggctctgggctctgggctctgagccacagcaggtccttccatgcccttgaaaagggtctggtaggccagggcctcatggagaatcatcaacaagggcatgagtaagccttcaagaaaacccactgtaaaggaacttgcttcacttggtttaactctgcacttttttccacatagttgtttgatcaaagaatccccatttcctttggaaatgctctgggaagcacctgggaggattttaatacttaaaacaacttttcacagtggccgtgtgtgatggttaataccctcaacttgattggactgaaggatacaaagtattgatcctgggtgtgtctgagggtgttgccaaaggagattaacttttgagtcagtgggctgggaaaggcagacccacccttaatctaggtgggcaccatctaatcagctgccagcacagctagaatataagcaggcagaaaaatgtggaaggagagactggcccagcctcttagcctccatctttctcccatgctggatgctccctgccctggaacactgaactccag

SEQ ID NO: 131898 - DNA, 1042 bp, Homo sapiens
tttattcctgagaaaggagcccatcccatcaagacatccctgcctctgcgttcagctgcagggttgcccaacccaccagagccagaagacagactggtcattcgagggcgtgccatcgtaagtgggtgaccaacatctcaggcgagtcacccccagcggcctgattctggagggaggcactatctagcgcatgccctcagaggaagtcctcatccttttgtgatgctgcctgctataggaaaatctatcattgattcctagggttgtagggatgtgtctcatggactggtgtccctggaaatggacatcatcatttgcccaggttagtgcaagaggcaggtaggggttggagcatggaccttggagacacaggctgtgttgggagctgagcccactttattgctcaccaccgtctcctggctccacgcagagcttctccgcctctgaggcagtcaaatgagtgttcctttcagtatccccaggggagcagggctggtggaggctgaagaggaagggcagaatccctggagagggagagctaaggctggatgctaaagtgtgaactaccccaacctgcctcactctgccatgtagactccctggtagccatgagaaagtcatgcacctgccctgtgccccagtgtgcccgaaggtagggtgaggatagcaacgcttagcttatagggctgccccacaaccagggaactgatgtgagttcggacactattaagtgttgtgaagatgttcggaagcacactctagggcctggagtctggctcttctataagcactgtaactttgggcagattaaatctaatctaatcagctgattagattagagctaatcagctgtctgtgactttgtttcataaacactgaaatggagatgatgattctgtctctttcatagaactgttgtggggaggcgttgaatgcagtgatggatgtaaagtgctcagtgcctggcgccttgtaataatagataaactatcctcagcaacatctgtactatcacattaatacactatgattaatattactc

SEQ ID NO: 131899 - DNA, 1046 bp, Homo sapiens
ttcacctctctgagcctcggtttccttgtctgtaatctgaaatgatagttcccaatctggcagatagttaccaagttgtggtttttactgtggttcttgttatcatacttaatatttttatggcaaatctatataaaaaagaacatgccacaaatcaaagtgcttggcagtaacgtgactgtatctgagcaccacgtcacagagagggagttgagcagagtcgagaagttcatctgtcttgagttctgcatggggaactggtccattccagcagggaagaccctccctgatcgaattcaaaggacagcaaactacagcccaaaggccagatcactggccagaaaccaattttacaaattgtgttactggaccacaaccatgtcaacttgttaacgtattgtcgatggctgctctcacactgggatagcaggttgagtctttaagacagagacgcatgatccaaaggctatttactatcgggccctttacaggagtttgccaacatcggataatatactctgaggtgatgactgagaatctggagttgctgccaccagctcccaaggtgcccttggataggacattttgtgggggcctcagtttcctccctggagtgctgagtggtgtggctcctcttagagggtctctcttctcttcccttccatgtattggtcaaaatgcatgaccagcggcccactctgtgtgacatctaatgaaagatattcccctgcctcccatttttagaggttagccatgtattcttaaaaaaccattacaccctcctaggttttggacatgaatccatgtcccagtggaactagaaggggtttgaggttcaatatgaatcagcgctgcctggccatggggccttgtaccagccacatcactctgtccctggtgccatcccgagtaaagtggagactgcagcatataggtgtgatgatctcattgactagggtcatgccatgcacaaggcttcagctcatggagactctgcatttcacatgggggtttttgttttgagttgagaaagagatgaaatatag

SEQ ID NO: 131900 - DNA, 1002 bp, Homo sapiens
actgtaatttacacaggactctgggccctgcagacattttacctgtttccttcaaccacctaagaagcccacggtagcctcaccccaccaccttccacattttctcctcccctgctcctctcagcccactctgagtgaggcagacatggcttgtgcattgggcctgcaaccctggacacatgcacggcagaaactcatgctcagcaccaccctagacagaggaaacccgcctctctagggtgcagtcaggcaggtctcttgaaaagtccactgtggtttgaaatctctgctgtacactgaacctgagcccacaggtggcggctgttcttctcccacagatgcagcatttcagtgaatgtttcctgggtgccaggagtgtctgccagctgcctacccccacccagcctgcagatcagagttgaaagcaaccgtgcatgctgggcccatctgacctgctggtcctcatgtcctgaaggtctggtctccatctggccccatctcctggctccctaactcctgagtccatcctgcctctgcccgtggccgtgttctgggtccatagcttgcccaaagtttgggtcctgaccctctctggtggcccctgacttgcctggtccctgattgcatgttgtgttgtgctgtgcttgagggaagagacttccagcttcagccctggcctgctgtctggccccaggctccaaaatgtgagaaactcctgaaatatggaggtcaagggcttggagttctggagggttctcatggcttatggacgttgcaagcaaagaggactgcacagaagggccattccaaacagctgtcccaggctggtggggcgaagctgggctgtctgcacagggagcagtgagcgccggcagcatggccggttgggggtagatcgggagaacgcacgtgagaaccgcagcaagatgctacttcacctccaccaggatgggtgaaccagagccaggcaaccacagtgccatagaaggcgtggagcagtca

SEQ ID NO: 131901 - DNA, 1074 bp, Homo sapiens
ctaagcgtgagaactgtgggcagtgcaggtgatgtagaaggtcctctctgcactcagcccaccaggccccaagagaccaggcctcaagaatgagacaggcctggccagtggcgtcagaagtgaatgatgcctgggctggggggactccctctagatggcactgacaggcactgccagagcagccactgggcccactgcacagcccacttccagggcccctgcgacatgccatcctaatacccacgccccctggctcctccggcgacacgctgtccccatacccaaaccctggctcctcctgtgatctgctgtcctcatccccaaaccctggctcctcctgcgacctgctgtcctcatccccaaaccctggctcctcctgcgacctgctgtcctcatccccaaaccctggctcctcctgcgacctgctgtcctcatcccccaacgctggctcctcctgcgacctgctgtcctcatccccaatccctggctcctcctgcgacctgctgtcctcatccccaaaccctggctcctcctgcaacctgctgtccttataccccatccctggctcctcctgcgacatgctgtcctcatccccaaccctggctcctcctgcaccctgctgtcctcatccctaaaccctggctcctcctgcgacctgctgtcctcatcctcaaaccctggctcctcctgcgacatgctgtcctcatccccaaaccctggctcctcctgtgacctgctgtcctcatccccaaaccctggctcctcctgcgacctgctgtcctcatccccaaaccctggctcctcctgcgacatgctgtcctcatccccaaaccctggcttctcctgcgacctgctgtccttataccccaaccctggctcctcctgcgacctgctgtcctcatccccaaaccctggctcctcctgcgacctgctgtcctcatccccaatccctggctcctcctgcgacatgctgtcctcatccccaatccctggctcctcctgcgacatgctgtcctcatccccaaaccctggctcctcctgcgacctgctgtccttataccccaaccctggctc

SEQ ID NO: 131902 - DNA, 1025 bp, Homo sapiens
gccatgccccaggaccatgggccgcccgatggctggctgtgcctggagggtgctggcaccaggaagggccaggctgggatcctccgcagctcccgctctccctccccagcagccgccatccttgccctgcctgatagttaacagttttgacaggccaggctatttttagaaacctgttcccactccttttccctgtgggaaaaaggaaagcaagttaaattttaaaattaatccaccacccttcccctcctccaacatacactgacacacacattagccacccaggacctgaagctcagcagagtcctgggccacaggaggggctgccctgccaggcgccaagaggggcatgtgggtttttgatctgggaggcggtcctgtgggacttagggtgttgtcatcattgtccccagcagaaaccagtgcagtggggaagtggcttctgggctgaagcctggttggaattcgggttcctagttctgagtccatgccctttgtagtaccatggttggcagtggtggaggacgccacagggtcagatgcccgcggtggggttcctagtctcacttcccacaaccccgtgccttgcaaagctctttcatgcccccacccgatttggtcctgacagtagccctggaagacaggcccaatcaagattttcacccaggacacatctggaggcctggcgatgaaatcaaaattgctcaaagccacacccctgggagccgtcttcctgtggggtctggtgagcacccagtggtctctagacagaaacacacccaggtgctcattggcaggtagcaccgaccccggacagggacgttgaaaaacagtggtgttagcttgaacaataaatttaaagtgaaagttaatagtcgccagtttttaactattaacctaataaccatgtagaaagaaattctgtgtatatcagcgtccttagcttggttcatttacatttaagctttcggtgaggcctttttccatattaggctttgaaagcgtctgcagggtcggggcagaag

SEQ ID NO: 131903 - DNA, 1087 bp, Homo sapiens
gcaatataaatggccaagcagccacgaaaagatgccaagcattattcattagtcatttgggaaatgcaaatcaaaaccacaatgagatactgcttttcaccagctaggatggctagaatcaaaaagacggatagtaacaagtgttgctgaggatgtggagaaactggaaccctcccactgctggtgggaatgtaatagtgcagccactttggaagacagtctagcagttcctcacaaagttaaacataaagttaccgtatgacccagaacttctacttctggatatatacccaggagaatatatgttcacacaaaaacttgtacacaaaccttcatagcaccgttgttcataataaccaaagagtgaaaataacacaaatgctcatcagctgctgaatggataaacaaaatgtggcatagccataacatggaatattattcagctctgaaaaggaatgaagtgctgacacatgctataacatggatgaaccatgaaaacattatgctaagtgaaaaacgccaggcacagaaggccacatagtgtatgattccatttatttgaaatgtccagaattgacaaattcgtagacacatgcattcaaggagtggttgctggctggtggggatggggaggcgtctgatgcatcattggatcagggtctctgggcgggaaccaactacctaccaggtaaagtgaggtcagctcctccccctttgctggtgagcccagtatcactgagtgacctgcctaggccctcagatagggcagagcagggctctgcttaaatggactgagttatatgaatatgtttgtgaacagcgccgaagggaagcctcttaagcaaaatcacctcctcctcctcatccttctcctcctcctcctcctcttcctcctcctcttcctcctccttctcctcttcctcctccctcctcctcttcctcctcctcttcctcctccttctcctcttcctcctcctcttcttcctcttcctcctccttctcctcttcctcctcctcttcctcctcctcatcctcctcttcctccaccaaacccatttcatgctcttaccaagggtgcgagattctt

SEQ ID NO: 131904 - DNA, 1060 bp, Homo sapiens
cacgaatctgttggtctctactcagaagccttaacaagctcacgggtcccgtgcgcagtggtggctggaccgtcatggagcctcaccatgggtgctggtttgtagtcgagaaagcactttaaaaacattgattacattttttaagctgtaagagtaatctctgcttattttaactattgaaataatgcaaagcagtatagaaagtgttaatcttctctgccacctccattcccatccttcggagaagcccggtctggaccctggggtaggaccttttccacatttctccaggctcacattgatgcatatggagatgtattaacatacaggaaatgggtttgttttacagaagcggggtcctgctattcttagattcctctgagacccgcatgctgacattttgacctgtgccacagcatactctccaagtaccaggctgcagcatccacgtggccccagcctgggagagcagcccctgggcctcgcccttctcagcactgtgcacattcagggacttcatattttgccatttgccatccaccgaatgaaacacattgttgctgctttcacttgcttttcgctggctgctccagaggctgggctttgctcatgtgtttctttgatcatgtggatttctctccttagatgccctgttcacgttctctgcctcttctatagaattgtgtggctttttcttatccatttgtaggagattgtgacctggagtaggaaaagactgcctactgcagatacatttcctggtgctgcagatacatttcctggtctgttatatttcttttgactttgttttcatggcttttgccacataaaatttgttcatttttctgcaatccagtatatcttcttaggaatgtctatatatataaaacatatatatacacacatactctcttattatttttaaaatttaaaacatctggaattcatttgtgcatatacaataagatagatccttgttttgttttactttgttatgccaggaccagttgattttaaaaaccatcaatttttccttgaattagcatgccacctttgtaat

SEQ ID NO: 131905 - DNA, 1012 bp, Homo sapiens
ctctctccaagaccttctgtgccaagggtgggtgagagggcctggagggagcaggtgtgggcttgaacaccatcatgtggccgcgagaccccagctgttcacgttttattatcctgaggatgcccatcaggcctctctttgtggcagcgcagttgcctctgcaggccccagggatgttcagagctcagcgtcagccccatacctggaaagactggcacctctgctgcagggcttcccaggaacactgtccgtcagcagacaaggctttttataggtctctgtttccacctgggagagacccccgtgcatccctcttcctgggcatggcagctcctggagcacaggcccaagtccagggataaacaggggcatctgctggtctgggtgggtcactgtgaccctgccagagtctctgatggttgcaggagacatctgaagtccttggcgtggcatttcaagctctttgtggcatgttttcaggctcctcaaccacccacaccctgggcaccttggtctcttctctttcctgtgaacccactctgcattcgggcaccaagcctctgcttgcttgagccccttagcctggatgtcaactctcggtccccacctgcttcccccacttaaaatcacactctttctccacatcagaccgctgggcacctggtccagctcaagcactgccttcctgtgacaatcaaagctcctcccacctcgcgcctctggggtgactgggcactgggaagggtactggtccgaactgaatgtgtccccccaaaattatgtgttgcagccgtaacccccagtgtggttgtatgtggaaatgagacctctgagaaggcaactaagcttaaatgggggatgaggatggggcctgagtcaatcaaattactgtccctgtaggaagaggcgccagagagctgcacacacctgaggaaaggccatcttgagctcacagcagcaggttagcggactgccagccaggggagggccctcagcagacatccaccctcct

SEQ ID NO: 131906 - DNA, 1060 bp, Homo sapiens
cctaaaatgtataaaaccaagctgcaccccgaccacctcgggcacatgttctcaggacctcctgagggctgtgtcacgagccatggtcactcatacttggctcagaatcaatctctttaaagattttacagagtttgactctttgggtcaacaggtggctcacacacggggcagctctgctgtgcggataccttcctccccctccctggaccaactgggttctcttgggaccccatggcttcaggctgagttgtttggggagggaaggggtggcctctgaccttaggtccctgccttttcctgtgacattcccttccctgccgtgtctccatagctttccttgccattcactcttactcattcttcccggcctaggtcaacggtggcctggtctcaaacataccttttgctttctcctctctctgctcccatcccaggggtggctctttctcactcccctttgatgatctgtgtctgtttcaccccctctatgaactcacaacacagagtgggtacaaagtaaatgcttgttgaatgagtggtctatagtaagccttcaacaaatacttgttttgtgaatgaatgaatcagagagaaacagtccgtctcctcaaggagtcctcaggcgtgttgaggagaaagtctgtcttctgccagaccagaacgcatggacatgggacctgattccttctgctgtgggagagccacctctgtctatagagatgcctgtggctcttgccctgagagcagccttctgaaatgctttcttcagaccccatggggacagccttagttgtgatgatggcttcttttgctgggcctccttgagtttttcctctgccgccacctaatcacagcaaaatcaagagaatgtagaccgctggcttgaaccggtgctaatgagtgcagatgtgaatcaagcccaggtctctgtgggattcttagttccaaagtttcacgtgagcttccgggcaatgttcagacatggttcctgcggagctcatggcgtcacccttggacctggtgatatttattctcctcatcttaggatgctttcgac

SEQ ID NO: 131907 - DNA, 1030 bp, Homo sapiens
cctgtaatcccagcactttgggaggccgaggcgggaggatcacgaggtcaggagatcgagaccatcctggctaacacggtgaaaactcatctctactaaaaaatacaaaaaattagctgggcatggtggtgggcgcctgtagtcccagctactcgggaggctgaggcaggagaatggcgtgaacccgggaggcggagcttgcagtgagctgagatcgcgccactgcactccagccctggtgacagagtgagactccgtctcaaaaaaaaaataaagatagactgtttcaaaggacccactgactgtgtggttttctatctgatttcggcatagggacggctgagttgacacacaggtggggcagctttgtcaggttcccaaagacctgccaggaagccatgggtggagagaggctgctgctttattgtttcaatgcaggaatgtatttcttatccctaattgtcaatttcatatcattacagacattctcctattcatatttcaatggttgtggcattttcagtattaagccagacacccaaaagatttttctggctgagttgatctcccacaaggagaactctgttttcaaatccccgaagactcagggccactgaggaggtgtctctgtgcatctggtaatgcatttcacctgtcggcgtcctgagccacagcgggcaccagagcgtgtgtggagccctggtggcagctgctcagcgatggctttgtcaagcgctggccagagaaggcttcattacccatgtttaacgcgattagaaaccgtggcggcagcggtaataatacgtgacatttgcgtccgcatttccgcttcacactgcgccttccaagtgttttcattcactgccctgccgtctgccaggagcacttccagaaccgcctcattctaattctcttcccttcctctccttgctgcctccagtgtggacgacgctggtctctctgttggcttacattgatcctccctctctcctggccccactggccccagcaccggccctgccacctcggc

SEQ ID NO: 131908 - DNA, 1039 bp, Homo sapiens
cagagtagacgtgccccatgagctgtcacattcgcgagcacttctgtatgcaatgcgcttagaaaaacaaaagctcagctggaatgccagccgttgctgggtggatgctgcccccagcgtggtgcaggtggtcggagactggcaggaccacctccactagagctctggtgtgctgagctcatcctggatcagacgctgggccacctactgcatgtatgagtttgctctcattttttttccattgtgggaagaacatgtaaccttgagatggtttttaacaaatttttttgagtgcaatacaatattgctaaccacaggcacaatgtcttatggcagatctctaaacttactcaccttgtataactgaaaacttgatacctatggaacacaactgtccgtttcccctctcccagtccccagaaaccaccatgtgacttcctgcatctatgagtttgaccacatcccttaactaagcagaatcgtgcagtgtttgtccttctgtgactgctttatttcctttagcataatgtcctcaagcctcatccatgttgtagcatgtggcagggtttcttcttttgaaagattgaataacatttcattgtatttatcgaccacattttgcttatccattcatctgtccgtgaacactgaggttgtttctacctcttggatattgtgaataatactgcagtaaatgtggaagtgtacatatctctctgagatcctgatttcaattcttttggataaatacccataaacagaattgctggatcatttagtagttctatttctgattttttgaggaaacttcatactgttttccatagcagctgtacctttttccattcccaccatcagtgtccaaggactccaatttctccacatcctcactaatacttgtcattttgattttgataatagtcatcctaacaggtgtgaggtaatgtatcgtcatgtttttgatttgcatttccctaattacttacgaggctgagcatcttttcatatgtttgttgacatttctatgtcttctttggag

SEQ ID NO: 131909 - DNA, 1023 bp, Homo sapiens
tggtcttaaactcctgtgcttaagccatccttctgcctcagcctcccaaagtgctgggattacagatgtgaactattgtacccagctgattttgtggttatgttttctatacattatataaatgttatttacattttatgtttatgtcagatgtaattacatctatgtcaactacaaattttaactggcgcatgatagttgcttgcatggatgaactcatagcagcttggatgtggccttggtgagggctgtgtgacagtaggcgccgatgccaaggccagccttggggtgccacggccgatcttcgtgatcgtattcagacctcacagtgagtggcctaggaatcgggtgttgtcatctctgagtttcagatgggcacccagaggggatgggccccatggcctgagggacacagcgtggaatgcggatggacacacgttggctcgggaggcctggcgctctcctctgcactcttcctttgacctcactttctttgatgtttgatcctagctagatcctggctttttcagaaagaacagtgtctgtggactttttactttgtgaagcaaggatgcacgagttgtaaagcaaggatgcagctctcacggtggtgtcactggagagtgtcaccgaaggcccactgacgagcaagggccacacacacagcagccaggggagggcagctcttttcgaggctctccggggtgccattttggcagtgatgtcatcaagtggacatttataggccatgctgtgttccacacatgcaaatcagaaactctcttccttatgtagactcgtcacagtgctgctatgtatatatacagtgcttaagagtggttggacagcttgcgtctctccatctccccacctgtaaaatggggatcgtgatagcacctcctctcaggactggcctgaggtttacaagaatcatgtgcaaagcctgcaggaaagcaagggcttcctgttagctgttattattagcactgctcttctcgttatcgttgcattagaagtgggcta

SEQ ID NO: 131910 - DNA, 1099 bp, Homo sapiens
ttcctgaaatgctcctccctggttatctatgaggctgaagtcctcacctctttcaggtctttgctgaattagaaccttctccataaggcaaggctgatgctgagcaccccactgaaaattttcctctctcccaagaccctcttctcagtccctctacttggctcatttcaggtgtctagcacgtcacgccctttaatacattttgcaagtatttctccacgagtgtgagaaagtggttttctttggtgggggttgatttttcatggcacataaagggcagcagggtttctttgggtcctgtctggaggcctgaaggtcacgctgggcttctggggagcgggtccccttcctgcagcctccctctccacttgcgtgtttctcactcctctctctccctgggaagtgttgcttgataaagatgcagcttttaattaatgtaactgttcaagattacagccggtcatcagctttctaaccagtgcctcacagctctgctggaagagccttgctccggtgatggttgatttgccattctctgtcccagcccagagaagctcccctcactgtcaacgtgccatctgtcaggtgcatgttataaagctgtcatcatgatcagctcattcacgcaccagctttagctttgaggaactgccggccatggcgttgaagacctgctgaagcctccagccagacatctgatgttcaggtctcagggggtccttgctgcttgtgtagcctgacaggtgtggccacggcaggcacaccatggtttggagtttggaaagaagagaccctgtgttattgtagagtgaccactggattgggcttctggaaatccaattctaatcagacttgggttatgcatttactatttcaataaaacatttatggatggactctggtaatcaacagccatatttttgagtacccactgcaggtgaggaaataaatgtactaggtgcgatatacatcctcatgtgctgtgctcttgatacaaagccagtcgggtaggactattggtcctgttttgtagatgagggaacttagacccagaaaatgaaggaagctgcccagagttacatgctgggaaatggtggag

SEQ ID NO: 131911 - DNA, 1033 bp, Homo sapiens
taatgacgaacccaccggctctgacctgcagtttcttctgtaaagatggggacagttcatagatctcttgagaggatgaaaaatcatgcatctccagcgtccagcctggtgcctgacatgaaatggaggcttactggtcgggagctctgacattatctggaattctccattactcttctcacacctgtccaccatcgtctggaattctccattactctcctcgcacctgtcccaccatcgtctggaattctccattactctcctcacacctgtcccaccatcgtctggaattctccattcctctcctcgcacctgtcccaccatcgtctggaattcttcattactctcctcgcacctgtcccaccatcatctggaattctccattactctcctcgcacctgtcccaccatcgtctggaattctccattactctcctcccacctgtcccaccatcgtctggaattctccattactctccttgcacctgtcgcaccatcgtctggaattctccattactctcctcgtgcccaaggcaaggcgagccaaagcttcccgttgacatgtcagtattattattcctcctctgtttatgaaagtggccaagttgatgaaggagaagggctacccaaagatgttcttttctggagaaagctgtgaatattttatgaaacataccaccaagtcctgccatggcgcctgcgcctgagcctcctgcaggagtcaccttattaaaatgtccctgttgatggagtgtgctggcgcatacagggagagcttgcctcttttcagaatcactcaaaagccataaatattttaaggagttttatctgcccactgttttctgtatgttaatctatcacaccgatcactttttcaggacaaagtatcttgccttgttcttaacagcgagtcgcaaatcctgctgtcagtgtctttcctttctgctttacctccattttgaaggaaagttctatgttgtcctcatacacacattgggactcttttaatgaatgcatgactctcatccctgaga

SEQ ID NO: 131912 - DNA, 1046 bp, Homo sapiens
catggatggcttgcttacgccagagctggagctggtttccatgaaaacttgtgtgtgtgtgtttgtgtatttttctttttttctttgctccaaagtaaatgaaaccacacttgggctgtctcaccaccgagcataattgtgatggaactgttctatggtgatctgaattaggctgcaactaaagagccacaggaaagtaagataaacatttgttgcctttggtattgataaaaacaaattaacacaattgtaaattctaacttttgtatatgccattgtctgtgctgtctttgtttttggctgaaaagccaatttagctcttcaccatgaatcattttagtaaggcaagtagatgctatctctgttggtttataactcaccctgcaaaagccaccacactgcttacactttcttaatacaggtgaatttatgctttagaatttatgacttcaggttaatctagtaaactcactttagctcttatattcttggggactcatttttggcaagaaagaagctggtagagcaacacaaatttgtaaactgagacttttagtgtcatggttttagtctcatgctagtttctgtataggagcaatgcttttggatatggtagctatttcctgtgatgggaatgcctttgcaatcaagaacgtatctcctttaatgtttgttgataaaatgaaattatttctggaatatgtatttttgttatcagtgaaatctgtggtttataaaaaaccctgcatccttaacatgattctaaatcaaggaggccaagagatacttgtttctttagctccgtggatatttcctgagggcctgctccatgccaggtaccaaccttactgctgggatagggtcatggatgaagcatggccactgtcctcaagatgcttagcatctgattgaagagagctgtatgataatgcgttttatagggtatgatgtatgattaaaatcaccaaaaataaatttaattctgtttcttcctactctaacatagttggttgtgtatgttcatgattctgttcattcatccattc

SEQ ID NO: 131913 - DNA, 1067 bp, Homo sapiens
cacaatgtttgtattaccgtggctttgtagatacttttgaaatcaggacatgtgagtcctctaactttgttctttttttcaatattgtttttgctatttggggtccttttgcaattctgtgagaaattgagggtcattttttccatttctgaaaaaataagctgttggaattttgaaagggattgagttgaatctttgttttgggtagtattggcatcttaacaataataaatctagtatccatgaacgtgggatgtctgccatttatttaggtcatccttttttttttcaagcaatgttttgtaatttgtagtgtacaagtcttttacctctttggttaaatttattcctaggtattattccatatactattttaaatggaattgctttctaaattttcttttcagattattcattgctggtgtgtagaaatacaacagatttttgtgtgctgaatttgtatcttgcaacttacctgaatttattagctctagtagctttcttgtgtgttctttgagattttctaatgtaggctcatgtcacctgtgaatacagagagttttacttcttcctttctaatttggatgccttttatttctttttgttgtttaattgctctgaggaagactctgattcgggattgaatagcagtggggaaagcaggcatgctgtcctgttcctgatcttaggggaagctttcagtctttctctgttgagtatgatgttagctgtgggtttttcatagataccctttatcatgttgaggagttcccttctgtttctgttttgctggttggatttttatgttttatcgtgaaaggatgttgaattttgtcaatatttttcctgcatcaggagagatgatcatgtggatcttttccattatattaatatggtacatcacattgatttttaaaaaatgttgaactatccttacgttctaggaataaatcccccttggtcatggtacatagtccttttagtttactgttcagtttggcttcctagtattttattgagggttttgcatcggtatccatcaggaagactggtagctttcctctttt

SEQ ID NO: 131914 - DNA, 1172 bp, Homo sapiens
agtgtggatgcgccagataagggcggatgctggtcccaggagggagagagcagggcggtgagagattcatcatgctactcagaaggcactcaatccaaaacttacaaattgtttatttccgctattctccacttaatatttttgaaccacggttgaccacgggcagctgaaaccatgggaagtgaacaggggaaaagggaggacaactatagtctaataagtagacttacgaattccccatgcttttaatgaactctcccatgaggaatgccatgttagaaatgtggttggttctcctgcccacaagttgcttatagttaagtatgttagcatgaagaacaaaataattattataaaaagacagtagaagtgctctgtagaaatgttgaaaagctgccatttggacatctcctcgggattaactatgattagtattgcgagggaaagtagtagagaagtgactggctgaggggaaaactgaccgtgcagcccattggggtggtgattgtagcagaaataaatctctggagggatctagtggaagttgagcctggaaagataacatggcgcttgaccactgaaggccaagagcaccttactgaggaatgactacttactgaggagtcactgcaggtttcggagggaagaactgacttggtccaactttgctttacgaagatagctatgtgggtaatgtggcaagatctgggaggcagaaaggcagtgggacatgagggatttatgggtggaattctgaagtgcatacaattgttctctctaaatcactgtatgggaggatgctttgttgaattgtttcattcgctgattgatgtatagaagagacacttcgatgctcttgttcaatgccagataacaccaagcatactggggaaagcaaggtattaaatatccaggccaaaacaaaaacaaaaaaacccaccgaaaaacccaccaccacacaacaccagtaggaaaacagaagtttcttgctctttagaacttctcacttaatcggaggacatgcatctctggaatgaatagcctatctgaacaagttaaatgtaatttataaacatgcgaaggagtggtttaaggaagccaaagggctgccactgggagctgggatgtctgaattctaagacaaaggagagagccgctcctgattcaatgag

SEQ ID NO: 131915 - DNA, 1116 bp, Homo sapiens
atctatcttagagattcatggcattagggttgacccagaggagagatccagacatcgaaagaggttcttgccaatggcagcacttaggctttcctggatttcctgcattggttcacgctaacgtgtgcgttctaagaaggcagaaatagtctaagaaaaccaggaaaaggcaggaacaacaaagtgggtatttggctgttcaatgttgtagggtagagtaaaatatgaaactggaaaatgagaggaggcaataatgtagaaagaaaagaagatgctgctacttttagtggcaaaaactgcagttacttttgcaccaagccaatagtttgaatagaaatgttgacagaaggaaatgaatctttattgagtgcgtgggtaacaggtactttcacatactttttcacatttagttattaaaatcatattggaaaataagtgctcttttccctgcctttttttttttttttggttagaaaactgaggctcatagatattaagtaacttgcccaaggttatagagtttataaaatgacagagcaagtagtttcacagcctggcccatgggacactgtaagaagcttatgagttacattcattatgaaatattagaggcataggaagatgagagactcaggcaagagccatctcattaaggtggaggtcacagttttaaaggaaaatttaaaattcaaattaattacaaaatgtcatagttaagaaaagtcttttaaagtagatgtggtttccaaggttcatgctgttttttttaaaaaatggagatacataaagtggctgaaatagaagttgaattagaaaaaatgtgtatatgcacacaatcacatgcatataccaccctccccacacccagcacgcatggttcccactgacaaattctcctcaaggttgagtgtgggatttagttcctggccaaatgcgacttggaacctattctgagtgggcagataggtgtctgctgtggccactggcatccatgccggggtggcccccacagctgcctcctgcatgtgcagtggcatgtaatgcatttctgaaccaggcagagaagatatttagaaagtccagcatgtagaagaattgagtatctggtgaagaatt

SEQ ID NO: 131916 - DNA, 1047 bp, Homo sapiens
ttagtgtaactaagctaactaagccgagtctagaatgtgggtgtgaaagtcaggtgaaatgtggtttactcccgtgaatgaatgatgaatggaaattagctctgaaaatgtggaataacgaccgagagcatcattttttattaaaatgatctgggtgtttacatacaaaatgttcaggatacatctgactccttctggctgtctgagggctgtccctcctccctgcacacttccctagccctgggcctcatgtcctactcggtgggggcttcccgtgtgcgtgacaagggagcacggagcacaggctccaggaggctagggtgtgtctgcttcactgctgtgcccccggggccagagccagtgcctggcacacagtgggatctcaggaagtgtttctcgagcaggagaataagtgcatggctgccttcccccaccactgagttccagggagaagcccagcacctccgtgtgcctggcacgaggtggcaacgccttagacctgccgggtctggtcacaggctccatgtgcttgtcctgagccgccgccgtgttgctttgctgaggtctctacttcggctccagtgtcatctgtaaattaactctctgtggcttattttgagaatcaagtaaagtaatccatacgaaaatgcttttaaaaccgtgaagtgttattaattgaacactgattaagctgtgtctgtctaccactgtctatcactgtcattatgctcattgaagccagagtgatgttcactgaaacataactgtaatcatgttgctaagttctgatttaggctttgatttctcatcttcttgcgctgaagttatccatgtataataaatattatggctacttatgagaaaggcattgaaacaggacttcttgtctgacacggccagctcacctttccagtgccggccaccgcacctgagtcttcatgccgggaacaaggcctcacctgcggaattgagacgttcgtgagttgtgaagttctgcctgtgtgctaggagcgtttgtgctgccctcactcaacaaaggaattcact

SEQ ID NO: 131917 - DNA, 1078 bp, Homo sapiens
ttcgttgtagattctgaatattagcctaaatagggcaggaacttctaaaacaggggccgcagactattttccctggcggcgtgaggaagaggaacgtggtcgatgcggtggcaggcgatgtggaacattgcagttcatctgtttggccacacagggctgccctttctcatgaaacagtgctttgcaccactgtgggcaccttacacaaggcctgtttcagaaataggattgagaatttgatttgggttttttttgctcctcttttacatgtaatgctcgattttctttggatttgcagagagacttgacttccttccttactttagctaaatgatttggatgagattcagaagacattctggcattatctatgaaatattgctttatttaaaatgcagtactctctttcttccttgcctaatgtgctgtatttgtggacatgatttggaggtaggtaggtggcagacctttgcagaggagacatcggcagatgtctaaggagttggagagcagtgggatacaggggaaattgcatgggcgatggtcaataattcaacaattacctcctgagggcctgctctgtgcaaggcactattctcagtgtgtgggataaatccatgactggaagaaagaaagattcctgattccgtagagcctgcattctggtaggggtgatagtaaatgtggtaatagatttaggcattttaaatctaaattttctgaagtggaattttaggtattaggtattaagaacaaaagaaaaaggcagaggaagagacttgcaggcttggcggcggcgggcgggggaggttactgtgttgtgggcagcaggacttaggcacccagcctggctctccacttcccgggtccgtccctggcagggaacttccgccaagggcagagactctgtcttacacatgctgcaacttcagtgcctacacttcagcgtctggatgttcataggtgttcttccagtagctgatggatgatggatgaatacatacatgcatctaagggaagtcacttgacattcttgagctctcatttgttaagttgtaaaatcgtgtcaaataagttc

SEQ ID NO: 131918 - DNA, 1039 bp, Homo sapiens
gtatttttattattttattttgtttttatttttatttcttttgagacggaatctcactctgtcatccaggctggagtatagtggtgcgatcttggctcactgcaacctctgcctcccgggttcaagcgattctcttgcctcagccttcccagtagctgggattacagacacacgccaccacgcctggctaatttttatatttagtagagacggggtttcattcaggtgaactgtccacctcggcctcccagagtgctgggattacaagtgtgagccagtgcgcccagcctagtactcattttataaagggagtgttggcattgaatctgtttatccattaaaacatttggcacatttcctagtgcatagtaagtacttacacataaggcattaccttattacgagcaaggccaggtattgtggccccatcatcccagcagcctgctcatgctagactagagagaggcaggggctgctgctggtgggggtgagagatgatgcgggcttgagccaggagttaggtatgggcaggagaggctgtatacgggggacattcaggtgataaaatggacacacatcagggattggcaggacatggcggggtggattttggttcctgacttgtgtggctgtggatggagggaagagtggcaggcccatgcggagttccacctggactcgctgaggctgtgggcctgtgctgcacggaggcccaggagaccatgcctagctgtccagccaagtctgagctagagacagagacatggctgttagtaccaggcaggggagaagacagccacagaatgtcagcagccactcaaggcatgatcctgtgggagaggaaattgggccattgctgaattctgcatcccagcgtctgagggatgggaaaatgcagagctgttcacagaagagcctgaagaggaagaaggaagaaggatgggtggcagaaaccaaggcattgtccagaaaagatatacacgattaatagcagggagacccagcaggagaaatgtgaaaaatagcccctgaatttggc

SEQ ID NO: 131919 - DNA, 1687 bp, Homo sapiens
tcatagacttaaatataagagatataaagcagtaaagtttctagaagaaaacattcaagaaaatcttctcagtcttgagatgggtagagatttcttgggacaaaaagtctaaaacacaaaggacaaaatggtaaattagacgtcatcaaaattaaaaacttctcttcaaaagccacttttaaagcaataaaaaagcaagctcagccttggagtaagtatttgcaaaacatgtatctgttaaaaagacttgtatccagaatagacataaagctcttacaaccaatagtaagacaaataactagattttaaaaataggcaaatgatttgaatagctaattcaccaaagaagatacgtgcatggcaaataacatgaaaagatgctcagcatcacttgtcagtaaggaaatgcaaactaaaaccatgaggagatttcattatgcgatccatttgaatgactaaaaagagtgattattgcaagcattggtgaggctacagagtaactggaactctcctatattatgaatgagaatgtaaaatagtgtgactactttggggaaatgtttagctatttattgttaaacatatacttatgtgatgacccagcaattcctcttctcccctatgtaccttaggaaaatgaaaacacggattcactcaaagacatgaccgatgcccatagcagctttattcataatagccccaaactggaaacaaaatgtccaggaacagatgaatggataaacacactttaacatacccatgcagtgcaataccacgtggcagtggagagaaacgagctaccggtatgcccaacacacagatgaatctcagaaacgttactgtctgtggaagcaagacacgaaagaatgcagactgtgtgattctgttcataaggaattctggaatgtgcaaagtgaaactgtcataacaggaggcaggtcactcgttgctggaggctttggggtgggacgttagatggccagagaggaggcaggaaggcacttttaggggtgatgggaatactctacgtgttagttgtgcaagtggatacaccagtacgttaatttattaggggtggttttgcatacacttggagtggcaacattttgttcatattaattatttctcaataaaataaaacaactttcatagttcaagagagatcgtctttgactgtctttccttacctctcagcctgtcgatgtgttcagtggccctgtattttcctttgtcacatcacttagcacacactgagttgcgacggtttccttccctgtctcttccatcagactctcagtttcttaagaacaaggaatgtcttttacgtgtctgtcctcagggcatagcccgatgtctggcatgcacattcactgccgaataagtgtatgttcagtaggatggcttcaatttattgattgcctacaatgtgagatagttgtagatgttttgcatttattatttctgatccttagtaaatgtttgctacacaaataaagaatcctcactgcattccagaagtcatggtacacggttgcacactgtcatggagtgtatagcattggagcacagcacacagagaggctggatggtttaaatattctgttcaatggcagtgtcaggattaaacccgtggatgtcgtcagatttcgttgttttacatctaaatcttcagctattgtctgcacat

SEQ ID NO: 131920 - DNA, 1034 bp, Homo sapiens
agtagagacagggtttcaccatgttggtcaggctggcctcgaactcctgacctcaagtgatcctccagcctcagcctcccaaagtgctgggattacagacgtgagctaccgcgcctggccggattagtggtggttgttattatagccgttttctatagagttttagtaacttgttcacttctggtttccgaccagagctcctggtataggacagtggtcaacaggcgcttgttagctttgatttctctgttttctcagttcggttgatcacatctttatgagtatttgtgcttcaaaacttaccaagaatgtggcaatgcctaagatagatgagagagctatggaggccgtgcgtctgccctgtggaacctggctgttattcccggactggcatatgtggctgctgctgaggaggaggagtttagtttgtgtgcatgaggtgtggagaggaggggaagataagaccatagagagagctgaaaaccagatggcttgtgctaagagctgcaaatgcgaagcaaaagatttgggagattgtttttatttgtgcttatttttttcctatcacaaagtaatgaatgatccttgtaaaaaaaaaaatctggaaacttgggaagactctaaaggagaagggcaaaacattccccaaaatctcactacccagaaatgggtgctactctcattatggcctatttccttccagtttttctccacgcatctctttaggtagctgaaatcagaccttaggagccgtctaggcctctattttactaaaattatgttataagcattttcttatcctatgcaagcttatttttaagttactgcttggtagaactgtaacgtgatttataaaatgcctcccctcttgttcgaggcttgggtcgctagtttttcccagtgataacactttggcaagaggagctggtcttctgaaatagtgagctggcagaacttctaaggcaaggagttgtgtatctgatcttttagggcggtcacttctgtggccatgcggaaacgaacctggcaggagg

SEQ ID NO: 131921 - DNA, 1125 bp, Homo sapiens
taggtgacattattagtttctaaaaaatccaaagcagtttaaatagagacaacgtcaaacaaaaagaattctatcccccacccctagaaatatctccactactgaaacaggcagaatgaaggagggaaaaccttatatttatttggcttcaaacagatctgtaatgaacctcagctttttacccgctttgttagagtggacgggttacttcaggccatctttgaaatggagaccatccttagtatgtcaacaggagttcttatggtgaaggaggttgcacagaacccaactgcagggaatgctccgcttcctgagagctgaagagacgcacggctcctgcctgccttctccaggtgcagtctcatcatcactgggcggagtcgttggcactgtccttgtctgtcaccccactagacttcaagctccgtgaaggcagaagtgctttcctttcatctttccccatgcgtagcagactgtctggcacatgacgggtgctcgacagatgcttgttcccactaaaagggtcacagacggcttgggaaggaggcaggcaaaaaggcgcagggagtggtggaaaggcattctaagccaaaggaccagcctcagcaaaaacaaggagaaacgggctttttaaatatatatatatatatatgtatgtatatgtatgtgtgtgtgtatgtatgtatgtatttggggcaatattgttgaagtagggccataaaagatgaggtcagagcatgtaaggtgagaccacaagtgaagaatcctgaatgccactttaaagatccagactccttaatgcagactgtggagccaccttaagaccgtaagggagtaataacactgtgactcacccctagccagaatttattagttttgtaaatcaaaacttgaatatcctagatttttttccttgttctgccaaggaagacaggatacagagaattttctgacattcatttcaaggcataagatatcctatgataaagaaaattattgctgtataaataatagcccctcaggaaaattgtaagacaagaaagaaaagcaagaaagcaaacgtaagactgcaagcagaaaaagaattagatgttgtttagtctttggctgactttaaaagcagtt

SEQ ID NO: 131922 - DNA, 1074 bp, Homo sapiens
ctaataatcttcatcctgtggtcccacccttaaggaggacaggatctgatgggaaaggtccgtgaagggccttctaggtaaaggtgctgtgccacccacggaaggagcgtgggtgcgtcctgggtaagagggagcagttgggtttgcctgagatccatcagtagtgaatgtggtggatttcaaacctgtgcaatcatgcggcattttctggttgtcgaggtttgtcttctgcgggacggctgagcctctctggggaccggagcgggagctgtgcaagtgaagtggctgacagtgctgtctgtggggacatctattgctgtaggggcatctggcaccatgagcttgttacagagcccttctccccgaagcaggaatgatgtgatttaattggaatcgtgctaaacctataaaactatcaccgaggaatggtgtagtcatggaaacaagtaattcagtgaaagctgctcctagggagcaccccgagaagtgggaaagataacatgtgtttctcaggttttccagaaagatgccttcctccatttagctagagtgactgtgtctgtccacgttcatgactgtctttcctgcgtgcctcaggaggaatcttctagggttgaaaatagggactgtgtgaattggatgcatcttagaaacaatatttatgcaagccagcaagacagtccagcttttctgactctcagcatccccctctgtaaaattgaacgacaatgcttccttcataggattgttgggaggcttaaatgataaaagagcctggcaggggaaagaaagaaggttggaccaagttaggaaataattcattggaacttcattcttgtatgtaaggaggaaaatgagatttggtcagtgagtccaggtcagtcacagtcctgctggttgttaacaacaagagcagctctggactaggcaggggtgtaagggcctctggaacaggtagatgtcgggtcccctgagtagctgggagtctggtctttgcccacatcagctgtgggcctttggccaggtacttagtgctgcctagcctggcttcccccaactgcaaagccaggctgg

SEQ ID NO: 131923 - DNA, 1083 bp, Homo sapiens
gatcatgccactgcactctggcctaggcgaaacagtgagacttcatctcaaaaaaatataaaaaataaataaaataaaattgatgtggaagatcatcagacaaagaacatccaaaaagctcctgaacaatcatctagtagggagacttgccccatcagacctcaaaactcatcatcgcagggaacagagaataagcagcaactaggtctgcctggagaaacccagaatttggaacaactgccttgagattcagagaatgagtaagagtttttcaagaaaacaagcagaagacagtctataccagtggttcccaaactttgctgcacattagaatcttttggggtgctttgaaaaactgtaagtccagttaaatctccaaatttaggactaggagccaggcagtgttttttaaagacccccaggtgattccagagtgcagaaaagctggagaaccactggtctattcttgcagtaaatatgagagcacggtgcaactaattcagaattcctggaatataaaccacaggagggaggagggggacagggaggcagcagcaagagcagagcgggcaggccccaggaaaggttgtcctgagggtgacgggatgccaccagaagtcacccaacagaagaggggcacagtgagattctgccttagaaacatgactgcggtgacaatgtggaagatagtggaaaaggggacaaaattagcagccgggagcccaatccaaaaactactaaaatggcaaagatgagaaatgacaagggcctgaatcagagcagtgacgcggacacgaggagaaggcgtgaaaatacttagaaaaccaaattggcaagacttggtgtgatcaacacgatgagctaacagtaaaccaactggtagtgatccgtagaaatcatccctttcctctttggacaaaaatactctgaaatccctgtcctgaacacctagctgacttgtctcacggtgagtcaccgccagcctgggcggaaagggcagtaatgagaacagccagctcagtggtccaggagacgtcggttccggctgcctgcaatggggatcacctgttgctgatgaatgac

SEQ ID NO: 131924 - DNA, 1061 bp, Homo sapiens
cgggagttccagtgtttccaggtaaagaggaaaaggaagaatctccaactgaatgggacagagagctgcttctgaggcagtaagaaaagcaagagtattgggggaggatgcagccaccaggcgctaggaacaaaaaacaagtaagactccggccctgcccgcgagatgagggtggtggagtgagaaggaccaaagtgcaggtgtgcttccctttgctcgggactcactggcacggaggccgcatccacctcctcacggccgtggaggggatgcgtgggaggcgcctggacacctacaccaacacaccgtgcactccgccaggtcctctgctctcgccagcccctgggctctctggcctcaggaaagaacccaagtttccatgaaatccctggccttcttcttagtaacacgtttgtgggaaaaactcaggcaaatagaaattgcaaagagaaaaagaaatattatggcattaagattccaatcacctttgtctttgaattctgggtaattcaggatgagtcactgttctttaaaaaataagactacgaattccaaaaattagtatttattttcaagagcagtagcagatgaggacaaagacactgaataactgtcccaatttcagagtacaataaggggggaaggggcaagttatgaaagtgaatataatgcgttcaagagcgatggctctcgaataaaattaattcctgaccacaatgataagtggaagcatccgttatcattaaattgtgaagaagccaaatataatgaaatgccaaatagacatgtttttttttcaccctagtctccagttctgcacaaagaactgaactgattccaacttcccacaggcagtttgtctttcgcctgataaacatgaggcatttcaggcaaaaagaactgcatttttctagggggggacagaagagattctaatgggagctcacgaaactacttgacctgctactaaattgtgtaatgcaaacccagcagcgtccaatggtgacagtgcgcaggggctccgaggggaggactggggagaattctgacccccccaggct

SEQ ID NO: 131925 - DNA, 1050 bp, Homo sapiens
agcgagataacatagaagaacgtgctcagaagctgataaaaattacaaaaacccataatgagctaaaagacatgaagaagaagtacaaaagaataacataaatctgaatgagaaaaactcagagatgagatggatataactcaggaaagaatttgtaatagaataaatttttttttccagcattgtagtttctagtgagttatatatacctgccagatacattaagggaagcagaagatgaaaagagagaagaaaaaagaatcgagagaaagatgattaaagagaaagtgacacacttagaagctaggcaaagaagatctaacgtacatgcatgcatgcatacatatatacatacatatatctgctatgagacaccagagaaggaaacggaaacaatggaaccacaacatgttaaaaactataattcacagaaaactttctgtaattaaaaaaaaaaacccttgaaactgttgcatgaatgggtacactgtatacatgagaatcttgacttagaatgagcgggacatattctagttatattactggacttaaagtcttttgggcttttagacccagatagcaagtgatttatgaaataaagaaaatcagattatcattggactttttgacagcagcagtattccagaagccaatagaatagcatgtatctagactatgtctagctactcatgtaatgaaaatttaagccagagatttgtaggcacagccacactaacttttaggtatacagggcttagacaaattgttgtcaacacgcaagactggaagaattaaattctcatgatttcttgaggattctactagggaagcacagccaaagtaactagagagacgttgtcataaggacttgtggtgaacattaaacatatcgttgcttgtatagctaagaccaaatgagcattcaaagggagaagatagtatgtcatggtaatctgctcttacagtatccatcacaataatttaaaacatggggggagcatgggaagtcatatgcaaaagtaattttttttttttgagacaaagtctggc

SEQ ID NO: 131926 - DNA, 1082 bp, Homo sapiens
tattacggactttcagtgcgtggcagttttgtcagagtttgaatgtgcatttatgcgttttttcatggtctaagttttggatcagctggagcagtgattagccagtctgtgtggttggttatcagagccattggcagggtgtgtgtgttaacacagattggctgggagcagtggctcatacctgtaatcccagcactttgggaggccaaggtaggaggatggttctaggtcaggagttcaagaccagcctgggcaacatggggagaccctgtctctactggaaaaaaaaaagtagttgggcatggcggtgtgtaactgtagtcccagctacgcaggaggctgaaatgggaggattgattgcttgagccctggaggtccagactgcagtaagctgtgattgcaccaccacactccagcctggatgacagagaaagacctcatctcttaaaaaaagagatacttttcaactgtctgtgcatccagatttctccgtctttaattcaaagatgctaaactgttttggagtgagcagctgtagaatttaactttttttttttctaatttagctatctacttttcttcatttttcttatattttagagaaatattatatttttgatttaatgttgttggttgttgataatgaaggcccttcaaatatgagtattttcttggaaaaaaagtatgtctctagctcagatatatgaaatccatcttttgttctaagcttattatttcgaagcaggctatttttgaaatcaaatcatgtctttgcagagagagaagctatagtgtaatgcctgtttttgctgtatgaaaaccatgccaactttaaagtacttttccagggtcattaaaagcagaggaaatattttttgttgctcttggagtttggtggttgaggcatctgtcttcaaattgccaagttttacaacttagattaaccgtatttcctgtaccctctccaagcacttttgtgatgttttgtaacttccatcgcaggcacgcacagaggctgggctgcggtccagatgcgtttgctccatgaattggtctacgcctcccgaaggatggggaaccct

SEQ ID NO: 131927 - DNA, 1070 bp, Homo sapiens
tgctttgttttcattcttacttttgaatgattaaaactgaaaatggatccaattactttagacagatgctttataaaggaaaatccttggtgcatgcctcatacccctactccgggatatgagaaagtaggttatgtttttaacaaacttttttgatagacatatatggaaagtttgtataattttgaagatgtattttctctccatgtaattatggctggaaatagccggagagaggagcagagtgtgttttcaaacctgggaatgtgtggggcctgctgtttcccatccggcattctcccacggtcatcatttagttgagtgcggccaccaggctgcccctacacatctgtcactgacttgttcttctgatcactgcaagtgcccacgtttgagaaggctgatgagggttaaggcattttctagagcatcagtggctggttaacttggggttagaacttgtggtgtcaaaggcattaactaacagtgatatttctgtttcttgaacactcactgagagttttaggcttatgctcagtgtttgcattatttcattgagtctttttgacaatcgtaattagatttgatgatccctgtttcttagggatatgcagatgtggccctggaactcaggactttacagctccaggctgtattcctccctctccatcctgccagagacaagtcctgtgtctggagtttccctctgatcttgtcactttatttcttattaacagaataaagcaggtctaaacttactttctacttggaaatggaatggtgagttaatatttggatccctcagagtctgccttgtgaataaagctccttgtcttgagtagtcttggagccactttcgttggaacctcacataaacatctgggccctgaacttggacttcgtgactgtgcagcctattgaaagattagaacaaagatgtgctgattaatatgccctaaaagagcagcaggttggaaatgagtttggggatttcatctcatttcaagatttcctgaggatcttggcctagctttgccagggaccattttgtactccccggctccttgtgc

SEQ ID NO: 131928 - DNA, 1110 bp, Homo sapiens
gtaacctcattagcctgtttccaagtctataaaatgggaatgatagctgggtgtggtggggggcacctgtaataccagctactcgggaggctgagggaggagaatcgcttgaacccaggaggtggaggttgcagtgcgccgagatggcgccactgcactccagcctgggtgacaagagcaaaactccatctaaaaaaataaaataaaataaaataaaataaaataaaataaaataaaataaaataaaaataaaatgggaatgataatattcacttctttctagagttgctgtaagttgtgaatgatagaataatgcatataaagtgctaagcactgtgcttggcttttagaaagcattcagcaaacatgtctgcctcacggctcactggttgtatcaaagggatgcaggcagctcctgtttgttgaggacccattaacagacagtttacaggcttgtgaatttggttattttctttaatccttataattctgtgtttccagtacagatattcttgtttgtagaggaggaacctcaggctaaggaaaggttgtacaacttgtccaaagccagaccataatttcagaggcgaagggcctctgggaggcgtgctggttctctctttcctgccctcactcacttgttccacaccaaaggccaggcactcggcgctgtgtccgtcgtctgctagccttgagcgttcagcgggcagcaaaacagacgtggtctcatgctgactgagcttcaggtctacagggggaaatgggtactgagcagataaacataaacatagataattgtgaatttgatccaaggaaaagaacatgttctgccttgtagacctggggaattttctagtcaggcctgctctagcagtattaatcctgtaaaataagctctgttggcacacaaaaaagatgaaaaggcagaacctctccattatcggataagctgaaactcattgataatatgagtgattaagcagccagcttgttgcatgcatttagctagatgcttttcagatattggccataatcatcacaacaactttgcaaagtagtttattacgctccattttaaggatgagaaattgaggagaggagtttgccgtg

SEQ ID NO: 131929 - DNA, 1096 bp, Homo sapiens
aaaacaagggtaagaagtgagctgcacaggggatgagggcagtgtgagatgcacgtctttggccttgtgaggttatacagatgggtggcaggctcatccctgagcctcccaacagtgcaagggaaacaggatttgtgggagatgctcactctctgtaagctaaacaagtggtttcatagaagcccagctttccctgctattgagatttaggagaatattttttgagtgttctgtgaagtcaatgaatattttatctttattttttttctgccagagttctctgtttagttggttatattctttaaatggaagttgctccaaaatgcttgtccatgtgggtttggtggctggggaatcagatgcttctgcttattgataggagttggtcagaaatagaaaaaggcatagaaagcatactatcatttataattttttttttcaatgccgtgtggttcagaaaatgcttttgcgtagttgacctcctttgaggatgcggggtggtttcttgctaacatgaagagcttcaagctatgagagaatgtgtgctgacttcaccattgccttcaagacaattgagctagttactgtaaatatgttacttttatgtaatgcatttcatgttcttcaataaaaaatttcaaaagggaggaaaacttattttgagttaaccaacatttaatacaatgctttgatagcaaggctattataggaagcatataagctgtgaagactaaacacttacattatttaaatttcagtagggcatatttaagttttgtcttattcatgctcctctttaacaaagaaataatacagaaaaagcaaaagattatttcttttcttcctcttggtttgcaggtgccctcaccaccaatggcatcaaccctgacaccagtactgagatcggacgtgctaagaactgccttagccctgaagacataattgacaagtataaagaggcgatttcctattacagcaaggtgattttatggctttgtgattttttttacacagttgtgttgtttaatcagaagtttccattttacattgtgtaatgctgcagtgtctcttaattatttatttctgtaagtattca

SEQ ID NO: 131930 - DNA, 1039 bp, Homo sapiens
gcactttgggaggtcgagttggacagatcgcttgaggtcaggagttcaagaccagcttggctaacatggtgaaaccccatctctactaaaaatacaaaaattagtggggcttgctggtgggtgcctgtcatcccagctacttgggaggctgaggcaggagaatcacttgattgtagcgaggaggggggttgtagcgagctgagatcgtgccactgcactccagtaccactgcactccagcctgggtgacagagagagagactctgtttcaaagaaaaaagaaattaagttgatcaaattagccctcatgactggagatgccctttctttaaaaggtggagggagcacttgttccttctccgtcggggggatttccctcttatgctttgatcatttactcctcagagaagagatgagataccatgtgaagaatgaaaaacccacctcattctgacccgcccccccccaccatttctccaagggaaaaaaagagagtaaaactcaacaatgtgaagataattcattatagctaatgaaataaatcaagactccttgtcacttattaaatattaacttatgctagaaacaaatgtattataagcatgaaaagcacacaaagcactacacttctgtcgttaagaacataggcccaagatggcctcctacttggggtcaccagctctgtaattgtgagaactagtaaggagatttaatctctgtaggatcttgtctcctcccctgcagagatggggtacactaagaatactctcatagagttgctgtagatgatgacacgtgtggatgttcctgacgtaggtcctgcttccgctgagtgtgaaaaaatgtcgcttttgcccctatggcattataacaacctgtgtgaatgctcactgctcgaaggggtgcctggtacctgggggatggagttctcaattctctacccacagtttatgtcaccgggtcgtgctgatttggatctattctttaaaaagtgcatatttgagatatatttttccaagcatgcccttttctattatcat

SEQ ID NO: 131931 - DNA, 1040 bp, Homo sapiens
gtttagggtatgagtaatagtagcttttcttttctcttttcctgtctgaagcaaaaaggcaccaaacttgtaacatactgttcctcagaattgcttttctgatcagatacaagtcagatttttctctaggctatgtgaattatgaaatgtgttttagtagttatttttaaaagtagttttgttttccaaataaaataccataatctgttctttcttccaggggcacaggaagttctcattgatccaggtacatgatctatgtgtttagtttcttttggttatttttttaagtgcttgtttcatggtgatgtgaatgaatggttaaaatttctggatgatgatctttggaacattctgatttaagtaactttaaatcagaactgttaaaagcttgatgattgattggtgggtccttgcttgatgggcaccccgttgctttatgttgtctgttgaagaggaggcttcttcctctagcatggctaagtgaatgatttgagaattgtgcctttaattctttgaatgcattgagcatgtttgtcctgttaattttgaattcatttgtaatcacgactttgctctgatttgtggcttgtgctcccttccacgtgagttaattctctactgcatttcgtctgtgtgttcttaacagggaaagaaatctcgtagtttttacaaaggcaggtttttcttccccttgtaatatcttctgtaattaatacagcaaaaacctcttttattacagtgcttaattatttcatgatgagctctattattttctgacttaatgagaaacaatgacagggtaaataatacaaaatgaaaacagtctagaattgaaatcagatggctgtgcttacacagcctttgtgactaacacattcgctttcatcgcctcgtgcatcttggctctgaaatgaagttgccccaggtttgcaggcgttggttttaacatttgcgttcactcctttctctaggccgtggctaagtttcctgatggagtttgtggaatgtgtagagaaaggacaacaaatgcttagttt

SEQ ID NO: 131932 - DNA, 1029 bp, Homo sapiens
agctctattgaaacacagccacctgcattccttcatctagtaattacctggctgctttcgtgctacaacagctgagttcagcagcagcaacagagactataaaagcccacaaagcttgaactatttactgcatggccctttccagaaaaaaatttgatgacacctggtatagggacagagaatagcttgacggttgccacggtaaaaggtggggaaggagctgaccacagggaatttactggagggtgatatagctgttaattgtggtggtggtagtgacttgactgcatttgccaaaactcagaactgtacaccaaaaagtagattttaaaatattttattttaaaataaatgtcaatgaacaagagggacagaaaacaccagtggttgctagggggcaggagaagagaggaacagaggaacagaggggaatgtcctgggtggcagaactgtcctatcgattggttacaaaaccatgcatttgtcaaaattcacagactagacactaaaaagggtgattttactgaatgtaaattataaactttttcatttttaaaaaagagataatgaaggccaggcatggtggctcacgcctgtaatcccggcggcactttgggaggctgaggcaggtggatcagttgaggttaggagtttgagacaagcctggccaacatggtgaaccccgtctctactaaaaaatacaaaaataggttgggcatggtggcacacgcctgtaatcccagctactcaggaggatgaggcaggagaatcacttgaacctgggaggcggaggttgcagtgagctgagacagcgccaccgcaatccagcctgggcaactgagtgagaatctgtctttaaaaaaaaaaaaaaaaagataatgaaatgagaggagccaaacatttaccctaagtggaaaaaaaaaattgggcttatgataggttttctcttatagacagtaaaaagaagtgccaggaatttaaagcaaagaacagtaagatgagagagatctccaatatacaaaatgtttc

SEQ ID NO: 131933 - DNA, 5120 bp, Homo sapiens
tgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcttactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaatcctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaattctgaggcttcatgtcattgtctttagttgaataccatgctgtgtgtcttgaagatgtccacgcttgcatgatgctaggtggcaatgccactttaaattaagccttaatcagatgttaaatttgtgagtttcagagtatgcaaaaatattaggcagagtgagtgtaaactgttcagatcaagatgctgtatcataattcaagttatttttttctggagttaaagggaagcattcagtgatacacctctctctctctctctctctctccccctctcccccctccccctccctctctctgtctctgtctctgtctctctctctctctcttgtctagcttggctatggccatagcttgatgaaaatggaccattgtgcatttctgtgacagtcaaaaagacctgttctaaaagtcttgcgactttttcagggttttttttttttttcatgtttctttttttttttcccctccagtctgagatttctgtgtggctgatggagagtgtgatttgggcgtaggtcttatttgcaaacctgctcatgttctaagctttcttcaggtagtaccacctgtcatcgcttctgcatatgatttaaatggatttttgtttttataaaagtatcataaatttagagataaaatggaggggacccagctttctttacaatgtggatctacctcagttaaacagttgggtgctattactaagtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcccccctgtgaaaagaaaaaaaaaaatgtccaagagcaaatttaacattttacaaacaataaagtccaaactcctctatgcacatatttatagcttatcacttcattttctgtgccagtgaaggggtggccagaaaaaaaatcccaagtaccctcatcattgcttttctagccattcatgccccctcttcctctggcacattttctaagagtttatttcataagcagcaaacggactgttgtcgatttcatctctcctgacctacctggtggaggtgctaatggccatggacagaaaggggcgagccagagctcgtggctttgtggaggcagaggcctgcattcagcagcggccctgtgtgcctgtaagttaggaaggctttctgacaggtaagaaaatgagataggttgatgacttaccatgcttttatatttggcagtttacaattctagacttttcctactatggcgatctttttttacttaattctttggaggtaacaatattttggagtcttaagaatttgattttataccaataagaaataaaaattagggatctttcctgtagtatatagttttactattttaaagagatctctgaattttacaagagaaccaacattccttaatggcagaactttgaaagttgatttgggaggctttttgctgcaggatctcaaaaatagagagagagatgattctacttaaatgtttttaattttctaacttccatcaggttgatacttaagctctattttgtaaagagtaaatcatcctttagtatgctgcataagatgatcagcattcttgcactttctcagtaataagacgtgccgggcaattggctccccaggacgcattgtgtttttaacctaacgagaggactttggggcaggtgattaaatttatataggtacctcaagaaaaagaacctgaatatgctgcattttctttctttagcttttacatgtagcattttgttttgcttttgttatttttgttttgatatatgctttttggaccccaatagactgttgaaagaaatttaaaaattactcttgtagggatatagtatccttaaaaaataaaaatttaaaaaaatttaaaaaaattgctgcaatatctggctcgaaggttgccctatattagaataatactttagccaaatacacctgaggaggcagacactgtgtttataagcagacaataatgttctgaatccttcctgttcatgctgctttcttaattcatttctccatgtcatcaagaggttggataacttatttctaagctcaaggttaaaaatcatgtcacctttttttttttcccccaacacagacctcagaaaaattgcgattgaggaagtagcatgatcctaaatgtgttgctgaaatcaggcagcccgagcctctggtctctccagagagcccgtcttcacatttctctattcctcagcactcacccgaaactgaacagatggggagtggtcttgattgtcaagataaaactggtgaagaaagctaaatgctgagaaactgagcatctattgtcgtgtttaagcttagctgggtcctttctagtttgtttttacagcttactaggtgaagtagtttgcactatttttgcaataaattcatggaaaacctaacagttacttgttttgtttcttactgtgtgtatataaactaatactaaaagtttggcatagtgttttttcacctccttacataacccctaacatgcacagaatgctgtaaatctgataaaatatgatgtgaatgatattttataaagttattttgtatggtgtcaattttgttttgcctcatagtatgtcagcaaaaaattaaataaaagtcctcctatttacagctgcctcttccaaaaatcttcaattcctcacctacttctttaggcacttccttctgcacaggttatgattccagctcccgaggcagaagcgtgccttcagggatggaagtccagagccctgttccacaaacagagggctgttccttgaagaatgtacttggcagagctgggcattacccgaggatttgggtttgggggatgagaaccacaggcatgagttggactagtgggagcagccatggtgtgtcggatagttggctctttctgctcctgcagcatgagaaaggatcaagaagccattcagctaagcccgtcacaagcaaagtcctgagttccgtgttgagtgtgggaacctgagctggcaccgtcctggttcgcggcctggccagccactttgctactc

SEQ ID NO: 131934 - DNA, 2619 bp, Homo sapiens
cctgtgacctctctctgacccatctctcacgctcatgagaaaaggaatgtacaataaatagaaacagaaacttcctcagtgctcatgcgcctcacttgcagaacgtgagtatttcatttatgtttgaagcccttccccaaagtgaccgaggagttgcactctagctgccgtgccagcagtctcgtctgctgtgacgcttctcggtgcggatgcagtgcacctgtgactttgtcatgggggtgcccctgttacacacacacacgctgactcttttttatgaggaaaatcttcgactcaaaataattgcactgattttttgacaacttctttttacgatgtcccacttcgcatctgctgtacttgtttgagatgattgtaaatagatttgtggtaggagaagtgacatgaatgcaacacgtggctctgttgtggagacactgcctcgtattcagtattatgtgttaaagttgtgtggacttaactctgttccgccctttagcttcgtgtctgttgaccatttatgaaggacaagttcgcctcattttctttttcttctgaagggaagttctagatcggttactaggagaacatggtctcttggtgcctgatgatttagtcctaagcagactcgttgcagtcttgtgaacactgttgtggtctgtttgattcctcgtcgcttaccgtggctctccaaagcatggtctttgagttccacccagcctgggacagtccagacgggaggcatctgctccgcctgctactaggacgcaagggcctccttgcatctctgtggtcagagtcatcttaaagccatgaggttactgtcgtgtcaaagctgtcatttgtgcccgttattttgctggagtagcagcgtgtgctgtagcccccgtgtgtcactctgtggtcaggctaccctgtgtcacacccagcaagaagtttttcagccccagaccagtctgtgtgtgtgtccgagtcacaccagtgccattacggtgccctcgcttatgcttctttcagtatgttttgccatgttattgtctaaagtgaatgtattggcttagccaaatcactacagaaggtggttcctaaataccttttagtttaaaaaaaaatgcagataaaggctacctctgaattctcaatagattcatcatgtttgctcttaagtgtagctgtccacactgaaaacagccaatatgttgcctgaataaactgaattgtgaacatctatctgttcagttctggcttgaaaatgtgtgtgccatactgtgacccacgggcagcccctcctcctctactgtgtcaggtggaccagggtcacctctgttctgcgcagctttgagattctaggattctacggccggcacgaatggcatgggagggttctctgcacgggacggcataacggcatgccatccttcaggctggcaggagcctgcgcaggtgtggcaaaatcttgaaacagcctgtgtcctgcctggcttttcactttcctatttaatataagaaagcacttttttttctgctttacctacaaatgggttgaaaatggcctcctctgtcctctcctctcttttatacactctgtaaaatcacaaaggtgcttcaacaccgactgtcatgcaaataatacatttaaaatagttgcatggtttcaaagacaatgcagacgtaattggcctttgactttgggacctcgggttactctcactccctactgcaaaacaaactaagggttgaaagcaaagcattctgttcaaatccagggccctttgtttgaaaagaacacagggcccacagctggtgttttgaagtagaagttcccactagtggcgcagtggaccgtctgatgcagacttgcaggaagtcggtcctgggaggctctgaacacccctccctgtgattaaccactttgctgtcagaaatgtcattttcccatacactgtgctgtgggcccggggcctccttcgcttctttctttgggttccatatgttgcccgatcttgaggttagcgctcgccccaatttctccatgagtttactctgagttgacaggcgatgatctgacagttggaggtgtctgggtgtttggaggtggccccgttctcatgttggctgctcatcagacattgagtttggccccggcggttctactacgtcactacctggaagcaattgcctttaacactctgctgtttggggtttcgatgctttttatgctgcgttgcgtgctttcattccggaagagctaagtgtcctttgcagtctctctgagaatgttttgtaattctgccgccacgctgttctgtgcggaccgacctcaagaggcttgggcccccgtgggtgtcccactgcctgccggcccagggtacaggctgcttgggtccgctgggctggccttgggctgtcagaatctggtccagggtgtttcgaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtt

SEQ ID NO: 131935 - DNA, 4971 bp, Homo sapiens
ccatttactatatgtagttatgatgctttttttttttttttgagacagaggagtctctctctgttgcccaggctggagtgcagtggcgtgatctcggctcaccgcaacctctacctcacgggttcaagtgattctcctgcctcagtctcccaagtagctgggactacaggcgcatgccacaattgtctagctaatttttttgtatttttagtagagatggggtttcactatgttggccaggctggactcgaactcctgaccgcgtgatctgcccgccttggcctcccaaagtgctgggattacaggcgtgagcctccgtgtccagactatgatgcatttttaataatacaaatataaatcttctccacagtatccttttaaagattttatgcgagtccaactgtctaatcttctgatctgctttaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacaggtgagtggcatgcctggctggaggtcacagcaggggtggtttttgccacgggtattggcagctgcttttctggaaggggaaggggcagggccccagcggctggagccggcaccccagaaggcctgttaatggcacggccgtcagcgtgggactcttccctctcccaggttcccgccatgccatcccgacttagtgatcgacgcactgcctcatcgtgcattaaggctgcacattctcattctctctctctctcatccctgcagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtatttaaaaaaagaaaaaagacaatatactgacagtctaatcatcagatttgtcctataggactgtgacatttattttccaaagtttttaaagaatacgggtctgtggtgataaatacagtacaatcctttttcactgttatgtctttaatgtaagagaagaatatatatatctggtttgcagtattaatgtgatagatagatgctgttttttcattttattgactatggggtgcttctgtgatctgtttggcatatcaagagtgttttggagcctggagatgggaccgcctctcagttcttagtgcttaaggacaggaatatgcaattgacttaatgtgacagcaacccgcttcccccgtggagactgtgcagcgtgtacccatgggagggacggatgtgccctccgcgccgctcgccaccctccctgccgcctcatccccgtgtgtcactcactcagctgatgaagcacaagtggaaattatttattcttgcattgctgggaaacattgatgtgtggggactcactcctctccgtgtgctcttttgtcagatgacttccatagatctatgcactgagattcgtagaaagctgttggtggtggctctgctgggcgtgaggccgtcggtcacagcgaaggagcttgcctggccctgggaggcccaaggatagcagggccagcagagggcatgggccgttcttctggggtttgcatttggggccccagacttgggtttgccaatctagaaactgttgcactaagagtgacaccacggacgattttgaaggctaacaacagacaactctgtttgtgctgagtgggctttttgtctctgtacacagttttagtaagactcaaatccatgttccgtgtagaggcgtcaggaaggaggcgagcctcccctagtgctgctgtgcgctccgtaggtcccctcttcctgctgctgttccctccccggccctgcgcgacacttacctcggcactgtggtggggtggggtgccaaaggagctgcctcctgctcagcggcacccccccccccacctttgtgctcagctgctttggaggcagcaggaggggcagcaagccgcaggtcgggggtctcccgatacctcgcctggatattggcggcaatgacaaagggatgactattatttgtgaagatgtgtactcagagtggtgtgtgtgtgtgtgcatgcgtgtgtccctgtgtgtgagtgtcttattaatggcattagtctcttctggctgtatttttttttaatctttttaaatgacagaagctcccactctaagaaatggcagttccttttgttttagtggcaagtggcactttctcctgttttcagaaggatacagacatgctcgtagcttaaattaatggatgcattcaagctaaggagggaatcttgtgactaataacttttcaaatctgaaattagattagtttccagccatttttacaatcatctggaaccatgtgtctcaaaggtgtgtttcttccacctgcgtcaggctgtctgggggatggcggttcttgtttaacatgcagatttgtgggcctgctgccacctcctgcgtgcggtacttcagggatggccagggcatctgtgtctaagcgatggcctgcagccctgggctccctggggtctgaggacccagctctggtggcacccagcagggaggaggtgcttcctgagcagatgcctgagacagactgggctggcagaaaagtaggactacaatttttgttttttttaatcattttgaaggaaaactttcatttttagtgggccagagtacttcgaaaagggtacttttttatagccctatgcttgttttataaaacttttaatactaaaaacattaatagaccaaacatctccagctgggtcagctgcacacctttgtacatgtctgatgattcagagtttaaatggctgtagttacaatttctcaggtaaacaattgttttctcaaatttttaccaatccctgcattattaggataaattttgagacagtgtaaaaacctcaaagtacagtagggtaagtcccagccctgttcacgtgaaagccagaggtggcccttccccggcatctgatcgtctgatcatgtgggtgcctggggccttgccacccttccctgtccactgctgcccccctgggcctgtcaagatttgaggggtgcccactcgctggctttgtccccatcccactgttaagtaaggtgtgccttgctttaagcaaactgaatgtgaaaattatgtgtagaagtctgggtttgtttaaaagaaaaactgggattttatctcatctctttaaaagaggtctcccaattcgatttctgtactgggactcttcctggtgtgtttttacatgttcactttttaaaaacattgatgtactcccatccttttaccactaccctatcacatttgacaagttcttgctgtaatgacgacgcaattaacgaacaccaggggagcggtggaaagctgccctcgtgtgtgagcccttcggtgacgcaaagccaccgtcctgttgttttgtgtgtcctaagctcagattttcctggtttggataaattttgtaaaactgggcatagctgtacttttagaaagggatcgttttccttaagttttggttttctctggttcaagcagtctttacatgcagccttttgattgcacatcagggtctcccttttcttttccagatgatgttgcttttcggtggtggtctcacactcctttgaatgaatgtttgcactctagaaccacaaacgatgcgtgaccattgtacagcttgcccaagagggaactgttggaagcaggcagtgacctccacgctgtttgtttgaggctgacctaaactgctatcactaatgtttacccccgtgacggagtgcccattagaacagatcatgtcagttcagttcctgtagtggggttagtaggtggggggttttattgttgttgttatttgttacttttattgctgttaaatgcaaatattgctatttattttttcctttctgctctggtttggtttggccgacacagatattccagtgcatgtggtacctaatggatatgatagaaattatttccccaacttttataaattgcctaatgtttaccttcaagtttgctggatgatttatttttgaaagccacaaatgtgatttttctggatgaattgtttttcttatatatgcagcaatgtaattttacattgatctgcggggtggtttaaattttatttttacaaggcagttt

SEQ ID NO: 131936 - DNA, 1045 bp, Homo sapiens
tgttggccaggatgatctcgatctcttgatcttgtgatccgcccaactcggcctcccaaagtcctgggattacaggcatgagccactgcgcccagcccaaagcctgccctgagcttctgcaggagcttggcctctgcatgtgccttctcagcgcagagcccagcctgcatccctggcgttggctgcgccccttgcacacacacaacctcctgggccctccaggggaagtgttcttcccattcctgagtgccaagcccccgcttcctgcatccagtcctccctgcagagaggatggtttctgcccccgtgttttcacctccccgtgaacacactcattgtctctcagaatcaccacggctgggtgttctcaacccagaacccgcacgtgggaccgttgctcacatgcactaccatctttaagcacaacctcctccctcccgtacccctaggttctccaccacgagttgctggccatccgtgaggcctgtatcaagctagaaaaagactaccagcccgggatcaccttcatcgtggtgcagaagaggcaccacacccggctcttctgcactgacaagaacgagcgggtgagtttctgcatgactccaggcagggggcacggttctcccctcagccccacaccccgagcacactcacaagagaacctgctggccacagtgccgctgtcccaggctctagggtgactctgtcctctaaggggcttcatggggacccaggtttagacactagagaaggctgtccttgatttggtgaagcttttttgttgttgttttggagggttttaagatggggtctggctctgtcacccaggctagagtgcagtggtgcgatcatagcttactgcagcctctatctcctgggctcaagtgatcttcccacgtcagcctccctggtagctaggactaaggcatgcaccaccacacctggttaattttttttttattttttgtagagacagggtctcactattttgtccaagctggtcttaaactcctgggcttaagccatcctcttgccttggcctgcc

SEQ ID NO: 131937 - DNA, 1026 bp, Homo sapiens
cggtgcactctcaacccgggaggaaggtgctgtcaccacctccgcctttccccggagagcccgaggcccacatgcctgtccttgcccctgtgcgtgctgcctcccagggaagtccccactgggatatactcagggtctgaaagttctccatggggtggttttgctgccaggggacgcgtggtcatgtctggagacatgttggggtgtcaggcttgatggagtgctactggcatccagtgagtggaggcctctcagcgtctgcccatgctggggacagccccctaccccaacaaagagcgagctggccccaggcattggtggtgctaagggtggcggtgagaaaccctggcgtgggtgtggctgcagagggagtagagggtagaagggtgagccctcctgggcctgggcctgagccccagcctcaacagctgtcagctcctggcccatctggtctggagtacactccacccaagccccccaacccgtggctattctgaagcagatttcagaccttgtgtcatttaatctgcagggtttttagtattccggttaaaagataaggattcttttcaaaagcattaccatgatacactgaccacctccaaaaggtgatggtggcacctactagcgtcagaggtccaggcgtgtctcaccgtggcccctgacgccactcctctccgcaggccgccggtgttccagcagcccgtcatctttctgggagcagacgtcactcacccccccgccggggatgggaagaagccctccattgccgccgtgagtgtcagcgcttccccatgggtcttccattgacaacatgcaggacgctgtcgaagtcccactgtcacagcgtggccaggggtccttcctgaaaggcatggggtctcactaagctgcggtagggacggccggggtcttgtgggagagaggtgtctggaggggacactagaatgacacaaaataagttctaagaagcagtcagaggtggggcataggggctcatgcctatccagccctttgggaggtctg

SEQ ID NO: 131938 - DNA, 1144 bp, Homo sapiens
ctaatttttatattattagtagagacagggttttgccatgttggccaggctggtcttgaactcctgacctcagctgatccgcccgccatggcctcccagagtcctgggattacaggtgtgagccaccgcgcccggccagtgtaagtggccttcctaagcagggagccaagtcctttcttttagttgggctctttctctcctgccctggggccctaggtgaggcatttaaatcgttttgttgataaattggagggatgagatagactcactcaacttcccttcctgagggagggaaagcctggcctgggcgaggcgggcacagccgtgctggagtctggactccaaggagcttggcgtccccctcgggaccagggaccctcttctatcaccgacctcggacagagggggacacgcaaagctcagcacagctgccatggctgcacttgccagatgggggcaagagggctggtggcagctgctgctctcggggccagctgaggaaggggcgccggcagagctgtgtgtgcctctcatgtcccttagccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggtgaggcccggcccctttacctccgcctgcggaccagggcacagtgggacgcttggcagggtggggtgcagtatgcagggggcaggggggcagggtcccttcacctgggcccagcaccgtcctggccacagcagagcaaagatgtcagacatagatctggctgctcacgctctgctggggaccaggggcgtctgcaggagtttgagcactgtggccgggtttccagacagagaaatttgtgcctcgaatcccagtgggcaaggcagagcagggcatgccttggatggccaggagatggagatgggcttccctggctcagcagcagcagcagctaccgtgtggaccagggccctctaccatgcttcccacaccaggctagtcatggatgctgcgtcgtgctgggactttagactgaaaagctcctcatgggagcacactgtt

SEQ ID NO: 131939 - DNA, 1034 bp, Homo sapiens
cctccctcactctgacagtgcctggcctgcacgtggggagagcttcacaagagctccaggcgctgctcagcagctttacggggacagcatcgcatcactgccctggggccgccacagccgcgaggcagcgtgagcgcggtttaaaggctgctgtgttacggtggcaagttagccgcatgtgacttttgagtgcacttacatgttacatgtatgtttagcacacttaacctttctcatgagttagtatgtgttaggagatgtagctctgaattctggcctcattcaggactttaagaacaattttgacctcaatgaaagtgctttgggctttgtaaaaatgacgcccttgtgttagagcctctggtcggcctgagttctctgccattcccagtgcccggtagtgaacggagccttctcctgcaggtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacggtaggtgtgggcgctcccgctggctgtggggagccgtcgtggtctccgtgggtgtttgttcctgcctaagcccctctgtgtttctgctgcactgagaaaggtgctccttttgggcctttcaggaggctgaggaagaagaggtggcttgtcatcactgccacttctgatcactgtgttcagggcctccccgtcgtcctgtatgatgccatggtcctgggcagtcagcaccctcgggtggcacaggccttggcacatgggtgggcaccccgcccatcatacagcatgcgtgttggctggatgggggaacgtttgtttaacgcacagagcgttgcaccagggtcacctcctgcccgggactcagcctatgtgtaaccactctgtgcccacctcagaattttgtggagtttcgccaaagtccatgccagg

SEQ ID NO: 131940 - DNA, 1007 bp, Homo sapiens
gcatggactttggcgaaactccacaaaattctgaggtgggcacagagtggttacacataggctgagtcccgggcaggaggtgaccctggtgcaacgctctgtgcgttaaacaaacgttcccccatccagccaacacgcatgctgtatgatgggcggggtgcccacccatgtgccaaggcctgtgccacccgagggtgctgactgcccaggaccatggcatcatacaggacgacggggaggccctgaacacagtgatcagaagtggcagtgatgacaagccacctcttcttcctcagcctcctgaaaggcccaaaaggagcacctttctcagtgcagcagaaacacagaggggcttaggcaggaacaaacacccacggagaccacgacggctccccacagccagcgggagcgcccacacctaccgtacacgggcgtcttgccgggcaggatgaccaccaccagctgcaggcccgcatacgtgttcttcaggtgccggaacatgggctccacgctgtccgccccctgcgcgtatttgcagaagcacggctggccctggatgggcatgccggcgtctctcgagatctttctgagctgctctgtgaaggacctgcaggagaaggctccgttcactaccgggcactgggaatggcagagaactcaggccgaccagaggctctaacacaagggcgtcatttttacaaagcccaaagcactttcattgaggtcaaaattgttcttaaagtcctgaatgaggccagaattcagagctacatctcctaacacatactaactcatgagaaaggttaagtgtgctaaacatacatgtaacatgtaagtgcactcaaaagtcacatgcggctaacttgccaccgtaacacagcagcctttaaaccgcgctcacgctgcctcgcggctgtggcggccccagggcagtgatgcgatgctgtccccgtaaagctgctgagcagcgcctggagctcttgtgaagctctccccacgtgcaggcc
